United States Patent 11,549,145 (METHODS AND COMPOSITIONS FOR INHIBITING AND TREATING NEUROLOGICAL CONDITIONS) - sequence listing, part 64

SEQ ID NO: 1429 - DNA, 2059455 bp, Homo sapiens
tagaaatctaaaattaaatatttaattagaactctgatttgctttaaagattggtggcattgcacaggctatattacaccctctttataatttttttgacaaaaaaaagatactgttcattttaacaggccactttaatattaatacatgtgtaataggattggaactgaaaatcagctagagatggtacattttacattattgggaaaattacagttctgtattgtaaaaacatttattttttaacaatgtacctacattaatcaaaaaattacagcatatttaataattttacaaattcttcataaaaaatatatctctgtacaaaaaggtctttcgcacctacgtcgtgacagcagcgtgtggtgggacgggagggagggtcggcgatgacaatgggttttcctgatcataatgccagcgttcttttttttaccccctttttataatagctttttgttgttgtttacaaaatattttacagaagaaaaaaattattgcagctagcctgaaaaaaggcaagatgtgtgtgtaaaacaagcagcagttttaaacagctctgaagcacgtgtcctctgttagtgtgtggtcgcgtccctcacgcgtgttcccgttgccttcagggaagagtcttctagacctaactcagcaagcacagctcctgactgccctaaaatgagatcctccaacaccttgcggagacgccgttcaacactgcacacaaccttaggaagaaactaggcagaattctcacacgagaatttcactgattttttttttcatttaaataacatgcttcaaactggcaaccctaggacagtttgactttgcacacaaaggaaaatcatatctaatttgatatgtggtttcttgtatgtatgtatgtcctgtcatttcaggatttcatagcatcgttgaccagggagcaggtcagggatatgggaacagagatgttaattcagactctgaagtcagcattttgcacctagtttgaatgactcaaacttagatatgtacaatatatatatatatatatgtatgtatatatatacactaatatgtatagtaaccctgttctcccttgcacacgagcctcctcacactttcaatcatcttctgtttcgttcaatgtgtgtgttaggagcacgactcccgctgacctcgtcccgtctactgtgaaacagcaatgtaaggattcccactggcaaagcaaatctccaaggatgtgggcaggttggccagggaaaactgtgcagagaattcagcataatgatacagaatccaacagcgtggggttcacaagacaaaggagtccctaggagaggccagtgagtccccaaacagcagagaccctttcgaccgaggaacacaacactgggagccgagctctacggaaatgtccgaatcaaaacgcgtgactctccaaagaatgccccattttcctgactgcttttccttttccacatttgaagtcctacatggaaaccttcagtacaccaacagataaatcagtcttaaagctaggtgtcaatgtgttcactccgacaacgtgaaggccaatttgaacattctgacatttctattaccaacgccaatctaaaatgtgaaacagagaaaatctgccacaattgaataggaactgaaatatcaaataataaaataagtactatcgtttcaaaaatatttttatcaaataagtataagtaaaagtaaacatgattttcactttgaatttgttacataaactacctcacggccacatcttctacttcatgttttgatttttatttgccctggggatcttatagattttatttgcatcataacttatcatttacctataatggaatttaaacttgaaaagtcactgaaattacctttccatctggaatcataaagcatgaaacaaataacaaatgaatgtataaaatatatcattgtgagaggagagtgtgtgtactttttccttccctctaaaagaacacttggtattttgatcctgaacaattttcactgagttcaaggtgctactgtggtatattgtctttcaatgcaatatcaaagatcgatggcacagtaaaagacaaaaaaaaaaaaaaacaaaaaaaaaacactgcaaaagggaaggctgcattgtgagctaaaacccacaagttcatcgactatctaaaataaattactattcacagttttacatggcaaacagaaatttctgcaaaccccctgctattaagtagtatcagagagacagtaattggatgaggatggtactaaaggaggaaaacgtgtgaaataaggaggcttctgtttttttctcattggacctcttcaatgaattcaacacgtaaatggagctaattgaagcaataataaaataaatctcttcaatactgtatttccttttaaaatctgtgccatatctaggaatacttttccctaacactccaactaagctgatgggggaatgtttagcttgataatatgaaataatgcttatatacaatggatagtgtgtataaaccctgtgtaaataatttattttttttatcagaatcttagtcattcataacacactagtgcaaaaaattgtgcattaaacattctgcgacagaacagctgactgggaaattgcaaacatccctagagatgaacacacaggggagctgtgaggtcctcaaagcttgtcaggtctcggaaggacagagtgaagcatttgtaggtgtgagcctctatcagaaaggtgtcttcttccagaaagctttttatttttttcagagtattcgtgttcatgggggtttaaaaaggaaaaacaacacaagagaacacatatcgtggtgccaccattctgtcaccgcacctgagggacatatccacgagcccagacgattgcattgaaaggcatctcagcaacacagaaatatgaaagtctgaggcattgagtatgacgtgttggcgcgacgtggcagtcttcctggagtgtgccttgatttcatacagatgcagccaggcatttagaacccacttttggaatgaaaacgcatgtgtagtttgatccgtagaagaccctgacacatttgagtagagatccccgctgcacttatgccagtagacaaggttgaagatcgctgcagtaaagccagagtggaagggagagtggtatatggcaccaaaggaatcactgcttgtccatcagaggtatggctatgaatcagtcctgttggggcactgagggctataccactgtacagactgtgttcagagttgtgtcaaacctcacagccttggcttctgtgggttttaagtttgtatcatacatggggttttcaaacgatgcttgtccattgctgttttcatgcccagcatagccattgtattgaacttttggtctcgttctaaggaaaacagaaaacaaatcattagaatcctggtttcatttgcagatttagcagctgggactgtgtgcaggagacaacgtctacagagcagggagcagtatagccaggacgtttgcaaagaaggaaggcatccacacctgcacacctgtcagtttatttgcttaaattggtgattgggagtataaaatgggttttaaaaagtgaatcgatttcaaaaattaaataaaatttttttgagacagggtctcactctgttacccaggctggagtgcagtggcacgaccaccactcatttcagccttgacctcttgggctcaggcgatcctcccacctcagcctcctgggtaactgggatcaaagatttacttatgcttcctacaaatgccccagggaaatcgggaaggtcccaaaggctgaatcggattggttttgttttggatgtctatttatcactgataagttatacggccttggttaagacacgaaactttctactactctgtaaaacagggttgtgggcatatgcctagcctttagcacggtatgcttacactaaatttcaagtttaagcttttagttcactgtcgttactaatattcacaaaaagttattttttattttgcctctgttgagttaaaaatgaatctttataaaaaaggaactatactcattattaaactgttgtcacattttctggttaaaagaaaacccctacgtacaatctatgattagagaattagaggattttcagactgaaaagacagaatcatgtctggtctgctctgtctctgtttattctttccttattccagaagaaatcaggtaagaaaaatgtgccacgtggcaaaaccagaaatttaatgtacataagcacgctcgcaaaaacatcatttgacattgggcgtcaagaaacttctgccgagacatttactagatttccttatgttacacatgctcattaagaaaaagagaagtacgtggcacatggctctgagaaaaaggcagaacagcactttgtgactgcccttggagtgggagaggtccgtgacattgtgcttggaacatgcgccagcagtgatcgttagcaaacaaatccagcccctcgtcaatgaagtgaagacctggctaaaatgttcactcaatcgtccagatcacaagctgccacagtcccttcatgtgtagggaaatgcaatcccagagtggaactggctgcagctggatgctgacgtgcaggtgtgcagctgcacccggcagaaggctgtcagcaccttgggctctgaggaagcaactcccaacatgcaagcaacagactcagaaatgagcagaaacagggtttttctggaggaatgcagagccaactcatcaagaaatatttatctctttagagcctgagaagccagtgtagagagtgctacaggcttggtgctttcctgaccaggtggtgagaacttgaagaaaatggattgatgtgctgctggcaactgagccctgggcttccttgcttctacaaaaattccaccatccctcgctcctatggcacagaagtagagaactaaaagacccaatggattgagaagtcacagtggcctcatagccgtcctcttgagaactgtgagagggaacagcttccttcatattcaacatgcagggcagcctcttggtcttggtgcagtgttaggaagggagggagtccagttgtgatgacgacagattccccaccgacccagaggaggcatcacatttacataaaaataagcgctatctcccttatctctggctctgtaatctgagatctctttccaaggcaccgccttcacggagacacccaactactcagcattgacagggaagtttctaaggtttaacgactaaaactggtgtgtatgttggatatagcccccaatgctacattgccttaaagttaagatataatcagaagtgatatttatgtataaatatgcatatataattatgtggggttatctttttaaaggacaagacaatcccagtcttatatgaaggtttgcatctttgcaggcaagttgagggaaaacagctttaatggactagaccttttccttggggttaatgtggatgccaatcaaaagcaaaaataaatttgtaggaattgtaagttcctacatatgtgtctctataaggatattatatgacccagaggaacccgtgaaagaagatacatttttgtgtatatccctttaagaagagaagctcatctgatcatggcatcttattggagaaggtagtggcatatctttctacatttactaaattttaaattagtcctgagcagaaattcaaggataaggctcatcggacttgtgtgtattgggtattttctcttccaaaaaattaacacagatgtgcccatctttaattttctaaatatcatctgaaatgtttttcattgagtcatattcttaaagaaagaacattactagccatagggaactgaagacacaggcacaagcagctaatacacctttgaagcaacattttctctactgtgtatttcaaaagtgaatataagaaagcaaatatttaaagaggctatttcatgagttttgaaaaaataatatcatgacagtttttctgttttaaccagaattaagtgaaatatctgtattatgtactgatatttatttaacctatctaattttatttcaggggatcataatttatttcttattatttgtagttaatgctaccatttcaaatagtattttagagtagtttggcatttccagattcctccaggtaatgtattatccatatatggaaaaaatgtacaaggagtttatagttcctccaaaataattcttttcttctggcatccacattaatcccaaggaaaggatctggttcactaaagttgtttgtccccaagttttgacattttacagttagcagagttttgcaaattgatgggtattcagaacactttttcaagagatggaacatctatattgcttactacatataaagagctaaatttgtatttgttgaagaaagaaatcaatgaaacatctatcaatcacagattcacagagttgaaagtggccatagagaacattctgttcacccttttgctggaaggttgaaataccttctaaaggttctcatcgttggccatggagcctgaatgtagagatagaatcctttatttcatctttcaattgaacatgaaagaaaaaaacatattatttctcaactcagtcatttattctcttatttcttagatgtattctgcttaaaaagtagggcagaaaacaacagaaaggacaacaaaaaatcttgacaaataagcattgttagtccaagaaagagcattgctctcactcatgagtgggagctgaacgatgagaacacatggacacattgaggggacaacacacactggggcctgtggggggctggagggagggagagcatcaagaagaacagctgatgggtgctgggctgaatacctgagtgatgggttgatccatgcagcagaccaccccggcttacatttaactaggtaacaaacctgcacatccggcacgtgtaccccggaactcaaaataaaagttgatttaaaaaaaaaaaaagaacattgcatagtaatataaaatacatgtgcatgtgagcacgagagcatgcccattactttaaacccatagtttacactcacaacattctcaaacagatggtgtttctgcagtacctgtgtttgtagaggtaaaatgcaaaccctgataaaattagagcaaagaaaggaaccagaatggcagccgccacagagccactgctggtgccgtggtaatgactggaagagtcttgatctgggtttaaaggatctgtaagataaaggaaatattaaatttgttgttactgtactctgcttaaacaaatacatatgataaattttgtaaatggatacgaactcttcaagaagcagacggagttgccatttcacaggaaaccaaatgatattcttttctaaagatttttaatatccacttaatgaccgggacaaaaaactgactatttcctactaataatggagaatactatgaaagagtctcaacatttaaaatgtgagaaaggcaaaagggtcagtatacatcctgactttcgtttatagttataggtgttttcacaaaactaactgaaaacatttatgtattttttctatattcagaggtcaataatatttgctgttttttcaggtcttaaggccagactcggcaaaatatgtcattgaaattatgtaaatatcccagttatccataaaaatggcattgcattcttcatatgtgaataggatggtgtcatctgtctttattttacgtacattctgaaattcacagaagagtttagaaatactcaaaaataattatagttcaatgtcacaatgcaagtttccatgaagacacaaaataatgctaaaatgtaactttttaaattaaataattaatttttctttttttttttttctgagacagagtctcaccctgttgcccaggctggagtgcagtggagtgatctcagctcattgcaacctctgtctcccaggttctagtgattctcctgcctcagcctcccaagtagctgggatgacaggtgcctgccgccatgcctggctattttttgtatttttactagagatggggtttcaccatgttggccaggctagtcttgaactcctgacttcaaatgatccacctgcctcggcctcgaaaagtgctggaattacaggcttaagccaccacacctgacctaaaatataccttttgtccattagaaaggaaggcaaatgtgaatacttcaagtatcatgaaggtgatagaatcagccaggactatggagtgtctcatggcatggcactgagaggaaagcaataaaaactcaaatccacagacctttattaagcaactgttgccaaaggaggaagtaagtttttgaagagtgtactaataaaatataattttgagatggatttggcctaattgcatggagtcacttaatgcaggtgtgcaatgaatcatgattggcgtcatctcaatatagcagaattgttgagaagaagctcatctggttttcttatttccagaatttataaaatgtcagattcaaagagatgttgctgtatttattgttttataaaccagaaatgcaaaaaatcaatcaaatattaaaaatctttaaatcattatttgtatcaacaccctttaattttcatataaaaactttcaaatgacattatttgccatttgcttcaatagatgtaggattatgactgcctacaatattaacgtccaataggaacatattttggagcaatgttggctttttacaactacttatctttttgagatctgccccaccatcacgcaaaaggaagatgccagacacttgctctcttgcaatctgagcacccaggttatggacgtgcagcgagtgaagccaattgggtgttcccaccccaggcactgtattggaagcgagggacgcaaaacattctgagatggtttaaaatttgttccatggctgaaggggttctagagccctggggacaacatgaagtgtgtgtgtatgtgtgcactgagggtggtcccagcagcagcagtggtgcagcagtgatgtccagtgacaaggggtggtgctgtccaacagagagcagtggtgccctactcagatggcaccaacttcatgggttggttgtgaaaatcatatgttagtacatctcaagtgcttacaacaatgcctggcacagagggaatgttcacacggactcatagtcacaaaaatgtaactttcctgaagccagggattttgttttgttttgtttggtttcgtttggtttgggtagctttcctcttgactcctcagaacctgcaataaaacctagaacacagtatgtgctcaatatatatttgcaaaattaaaaaaaaaagttttgtctgtatagcatttcagcacccaaatatcttttagtttccattacgatgccaaacattgatcttcaagtttctgtaattctgggattatctgtcttattcttataaatgtgtattctacttacattaaccacagttactttttttaatctgaaaacaaagctacatacttttatccataatagataacaaaattccaaataataaaatgctggaaaatctacgtgtcacaagacacctcacatgaaaacaaagaacaacacgtaagaaggtgtttgtgaattacataaccaaacttaccgtgagattatcacatgcctgcagctcctagttaatttcagttacttgccttgttttaataatttgaaggttaatatacacacattgtgttaattaaaatggcataaagggatatgaaaacaaataatataaaggaaaattaaaataatcattccttgccctacaaggtagttcctctttatagttgagggttttaaaaattgtccttccaacaatgtactcgtaatatgtgtgattatttctcttttcttatttttataattggtaatattatttgcattttgcttatgtggcttttaaccttaacagtctatttatgaggctcttccattggcatatatgaatcagatttaattttttaaggtgtgtagtattctactgattagatataacagcatttatttagccagtctactgtccagggacattaagggtgtttctaatacttctataatgttgcaatgaaatcttttgcctatatctacacattagcaggagtcgacattacataagacaaatcttaagaagtagaattattgagaaacagaatttgtaccttttagtgttgctacatcctacctaattgctctctaaagaggcactgcaatttcattcaatcattatcgtacgagggtcttcacaataacacatggacagctctgtgcgatccctctgctaccctccgttcccttctcttccccctccttgttttcccctgtccctcctcctctctcattgccctccttccacacgttattattggttccttggctgttgcaaccacaactgttgctgccactactacaatgataaatcaaacagtgtttaggtagttataaatttacatttctttactgaaggagggtgagcatctttgcacatgtgataagctaggtcattcaattttctaaagagcattattgaaacaaatgcacatcctgtcacgcaacacttcatgttggggatacattctgagaaatgcttcgtgaggcaattttgcggctgtgtgagcatcagagtgcactcacacacctagacggtgttgcctactgcatatctaggctataggtacagccagtggctcctacatgagtaacaccgtgcactatgacattatggcagctgtggtgtcaccaggtgttaggaatttgtcagcttctttataatcttatggggtcactggtgcatatgcgatcttttgttgaccaaaatgtcattatgcgatgcgtgactgtcctatataattcatccacttaagctgaacacacaatccaaggctttctcagtgttttcatagggtggtgcaatcaccaccgtagtctcacttagaagattggtgtccctccaaaagaatctcagtatctcttagctttattcttcctctaccttcatcccaaccttcaacccaggcaaccactaatcagtgtcccatctctttggatttgcctgttatggacatctcctgtaatggattcatagactatttggcctttttttatctggcttccttcacttggcatgacgttttcaaggtccatccttgttgtaggattcttcaatactttattcttcttcagtgctgactaatattccattgtatggctatattacatattgtttattcattcatccattgatagacattttggttgtatctacatttgggttattataaataatgctgctctaagcattcatgtacaagttttgtgtgacatatttttcagttcttttggctacccatgtaggaatggaattgctggagcttaagtaacaactgtttgatgaactaccagagtgttttccagagcagctgcatcatttcacatttccccagcaaagtaggacagttccagttcctccgcctccttgccaccctttgcgatttgacttttagatcacagccatccttgtggacatgaaggggtatcccagtgtggttttgatttgcatttccctgataatgattataatcaacatcttttcatgggcttatcgccatttgcatgtctttagagacatatctattcaaatctttggtcaatttcttatttaggttatttgcctctgtattattgagccataagagttcttcgtacattctggatacaagtcacttatcaggtacataattttatgtattttctctcattctttgtgtgtatgttagggttgagtcattcaatcctaatgaggaaaccagtttattgttgagtttcttacgcaagtttttgcattaaatttgtctttcaaattaattttattttagtatccacttaatgacaatcacgttttttggtttatctactgactagagaaaattaggaggttatttttatccataaaaatagatgcttgccatcattcttaaatgaatggttgctgttgcagaattacgtaaacacaaacttttctaattagttgaaggggggacttacttatgactcaaattattttgtaaagtaaactgtttttcctgacaacaagctcatcatcacatgagaataaaaatcccttgttaaaccaagctgttattttgttagattaaaaagaaaaggggtaatgcaaagaaaacgtgtaatagcaaactgatagttcaggtcaaattcattggatcagtcaacttagacatctacacagcatcctgtacagctcactggggtgtccttcaacaaaattactagagcgtgtgctacagagagaaaggaggacaaataactccaggattcggcttagagcaagagaaaaaacatcacccatcattagtgttggtctaatgcatttattccatttcattacctcaaaataatataacccaatttaacatataatctcagccactgccaacattataatgttcttctatttaataatactgtgggttgaatagtggaagtaaagtattttatgattaattatcctttttttttttttggcttttctacaggccagtagactttttttatattcagcactttgataaaagtcttacaaaataagttcatcagtggtaatcattacaaaattgtacactcacattcctccaaaaggtggctctggtatcaaagcctatatggtaatattcttctttatagtaatactgtgtgaatagtattctacaagtaggagaaatatggtgccaaggttgttacaaaaatgcgtttccttttatttgtgggttgcaacaattataacgacttttgtgcaaaaagagctgtagcatgcacaaagcaatgcttacgtggcctctcaatctcgtaacaaccttgggaacttctatactgagatttaagatgaagaaataggctcaagaatattgtgacccatcctagatgacaaaaataggaagcagacgaggtagcattcagatctgatgattgtttccacatatgttcctcctttaatcactaaggcaaaaatcaaatagtacagaaagctataaagaaggaaggaggacttacctgtctatgtagaataagctttttctcatttataagtcaaacctctttccacatcaatatatagtcctcatttctttaaataaatatactgaataataattgtttcataggtagtataatttgttacataaaaatactcattgaagcaattctttcagcatagatgggcaacatgcggaggttatttctaagttccactactaaaacaatcctgctttggacacgcctgaatatgcagaaaacaatttacacatttgcctgattaaaaattctagacagaaaattgttggatgaacaaagtactgaccaattgtatctacccatacatccatcaaaattaaacatgagcatcttttcctgctatcaaccccaaaccaattattaaaactttgtcattctgataactaaaaataatcatctttgttactatataaatatatatatgtatatttctgaagatctttttatatgtttgttggccacttttaattactcttactttttttttttacttttaagaactcttagttttctttgggtaatatactttgcttatactttgattttcatctttttctctcttatttttaatagctcttgatatagtgaagatatgatgtctggcacatttattgcattatttccggctttgtgtttgtgtattttgctattcaaaataattttttttcattcagctgtaaaatatgttagtctctctcattatttttgtttaggtttcttttagagtcgtcttttccatttcttcttagaaacatcattggaaagccaaactgatatttgctttaaaatatatcctaagtgcaacttaccttgcctttctagcttaaattttccaaagtcttttccatgaatgtcaccttgaaaagtaaatcctcctctttcaagtccagatgacacctgacacataggaaagaaaagaaaagaaataaaaaggtatacgaagggatgaataatatcctcttttaatatatcttttaatacaactgttatatctcatatttagatactactggttaaatgttttatttttgccatggcttttggtgacacatttatagttaaagatcagaaaccaacacagaagtgaactttaactaacatatgcaaatgctcacaatctcattttgatctcgaaaatgatagcaaattttacaatatatccatatgttaactgcactttctaagggaacacaaacgtatgaattaagaaataatctacattatgtaaaactcactttgtgtcccagctattgggcagggtacatcatgtatggctgtctacccttaagtcagatagtaaattagaacacgaacaaatggttaacttgcaaagaacggtgttaagggggatgtcttaaatctttctatttatctgggaatgatttcttttagaacgagcagcgtggttatcaagcggtcttggaaaatttctgatggcaccactcacgatataacgtagcagtaacatcatagaccctggatttcaggtcttgttctgtcctcaacagtaaccacccctttaaggatggccagttcattgcttacttcttagacctggtttcttcccttataaaatgaaggaataaaatggccactctgtcaagaagaggggcagctgagttttcaaggggcagacacaagacagctctactcagaagcctccaatccgtagcccttgcatctgcacagagagatgattagaaagcctgtgctttgtcacagaccttacacatgtacttacataaccatctagtccccagttgtcattttcgaacttgcttacaaaaatatctgcctggcctttaatttgaaaagctttcaggagtaagtgggcctcctccttcttgtaaatgcctgtgaaaagatcagcagtttaggcttaccttggagaaagttagtaattcagccctttaatccatttgatgtggaatgtggtacggagatgataatatcatcgataatagaaaactcaaacagaaattgtatttttatttgtgaattttagcttaggagcttccattttcccctgaaaatcacttcttaaatccttgtctatcttgaataggtataatccactccactaagttcaatatccttattccacagaaagaataaaaaataacatatttgattttgctaattaaaaaatctctctctaaaaaagtatacagtaaaaatacatcacagaattaatgtaagaatgaaaatgataatacacatacagtgcttaaaatagtgtttgccatataaatcgaggctgttttattttattaattgtgtgatgattttaaaaatctcatgaagagcacatgagttaagaaaaagtattaagaaataaagtttggagacatgcagtatctgtatacgaatctcagattcttgacttaatatgtgcataattttgagcaaatcagttcacttttctgtactcgttttgtaatctctaaaataagaaaataataccaacctctcacggctagggagaggctccaatgagttacagtatatacaaagccaacagaacagtaataagtacttaatacttactagatcacctctctgtgaaaagataacaggtctatttctgctcacaccatgcgtttagtgaattcttcgggacctacctgtcaacttcagctccactggcgaggcttcgctgaaggtggcattcaccttactgcttgttgcattgaaccagtcaacagttagagtggcgggttgtcttttccctaaatattcataataccccttccacagtgaattgacgaaaaagacatctgaaggaactgtgggaaggggggaaacagaccaatgtcagcacacacacaaacaataaattcagacattattaaacacagaaggcatcatactgcttagcgagcgatcacagatgagggcagtgatgaagacaagaggagcctagtgcatcgctgttcacagcacgtgcaaaactcaaaagaagcaggtgcgaagattattatggtatgcaagtagacacttgtgcttatgggtttcttttattattattagaagccaaagcatacctactttaacagcccttccaagctcatgggctatggtgaactggtacttctaatgctagtttagtttttattgtgcttagcaagaaatatgtttacctgacccatgaaatcactactgatatttcaatgatatccaagtctactctttgaaagacttggaaggctccaaagaactgatatatataatacgagagcaatgccctgtctcgaaaaagcttacatatcccagcaccaagtggacttatgaagacaaagccctttcacttcagagtctttattttgtaagtagagtccctctctgtcattcatactcttctgttcttctttaatctctttatgtaatatattccatgagtaagaagagatgggctcaataatttcaaatgtttcttttatacatgtcttttaaattcagtaatgaaaggcagtctttttaaagcacagaatccatcgacaggaaaacttaacaaagattattgagatatttcttcttgttttcacggcttaagaaaaaaataaacttatttttcatgtgtctgtttaaaaatgtgtataaaatcctgccattttcacacataaacgtgaattgtagtgtataaattcacatgatgatttcagcattactctttgttttctgccttctgatgtgcatgaattatttaattagataagattcatgataagcataattggtcaaaacacattgcttgagttgctaggtggaaatgaagattcatgtctccctaacccattttttaaaaagtccatttatagtcgcaaataatgaggacaaaagtatattgttcctatacccatgcttttctttccagcccaactggccattttcttgttttcctaggcaggctgaacctataaaacttggcctagcaagagaagggttaaagaggaacagaagataatagcttcctttggccttttgtagaccccactttctcataataatagtgataataaaataagtaaaaaactcatatatccacacaagtatctaacacatttgcttataaatcactgattttagacacatctgcttagccactgtcagcacaacagaggcccccattttaatcagcaacctcaaaataactttattttccattactaaaattaatagcctttaaagtacataaaaaatatcttccctaattagaatttatatgctcttctgaagttactaatccacttgttcaagcattcacttaagttaatcttgttgaagtttcacaggaatgggccaggcctggctgggtagggtaagatacaaccaatgtcttagaagtggcttctgtgtattaaaataggaccacgagtcatgtggcagaggtcatctttctgggtctttataatttcacttgttgctggcagcccgcagtacaatgcagcagccacatagctgagctgtactagaatgtaccaccatgatgaggaatcacattcaattagcacttgctttccaagagtacaagaaaaggaatattgataataatgtttgcacctacaaaaggagtgtatagatatttcaatatcttaaacacaaaataagcaaataaaaaacaaaacacacacacaacaataataacaaaaagaggctgtgttttgttccattgaagaacatgttgcctggataaagagcactgacttctgtatgtgatttttaggtaatatttaaataaaatagtctagaaagctttaaaaagcattttatattctttattattcagattggagaaattcctttcatcatattggcacatttttccttgtctaagaattaaatgtgtcacacagcatcctgacaatatttttccttgtctaagaattaaatgtgtcacacagtatcctgacaatagcaatacaaatactctttccatgtttgattctaaaatagagcttatgtccaaaaaaaaaaaaaaacagtgttaaaacctgaataaagaaagtactagtcaagtgatcttatatatttacaaaggatttctgtttctgataaaacaacaacaaaatacccaacttaaattaatataatttgggatacattttgttatttaaaaataatttaaatttaaaacacagaacatgccagatgattttgtatagtaaaaactttccttgggaaataggactgcatctttgcgatttgctatataatgcttttagcaaaaggtgccacatacaacaaaaaactataattaacattttagaaggcaaagcatgcctagatgaatggagacacttggaaaaaaattgggctccatgtctgaactgtttacattaacaacttatgctgtgaaaatgcctcattgatatgagcttcctcatttggaggaaaaaagtcgcaaccctctttataaggctctccattataccacatggaacgaccaatgttttcatttctgcctaccaaatgccgaaggcaagtttgaatgaaacagggtgtgataacaccaaaggttttctttttaagggaagtaatgttatttcattaacaaaccattgttgtgaaataaacagaattccatgtaagcttggtgttttaaataattgaaacattaacttggtcgtggactaacggattcagaaatttaaatgttgaaaatagtttcactgtgcagagtagagaacaaatcactttattggattgaaatctagaactgttctggtatacaaacctggagttttagtaactgtttcattaacttctctcactcctttacctacaagtaaaaagacaaattatcattttaaaaaaaacatttatttttgagtaagtttgaaaaaatgtcaaattgaagcaattttcctttctccagatttttttaatgtacaaaatatgaataccttatacatatacattttaaactcatgtctttacagcagaatattcttggtgtttgtgggaaagcggagtttaaggatgaaaaatcaatgtacatctatctacgtatatttccatttaaagtgctacaacagagagccttgcaaaggagggtgccttctatgacatttcttgtatcctgtttggaataccctgccacatactaaaaggtaacaccccacccaaataaccatgatgttacagtccctcttcattgaccaataccccacccaaatcaatcaatttatacgttactactgaaaaattcaaaattatttccattgcagaatgttcattttggtctatcaagttagatttacgtcataatttcttagctttcacagttttagatcaaactacgaattaccattttaaaagttttcattcttctatttctaacagggaagggcaagggaaacaaaagtctctttaaaatccctaatatgagaactataaataggctccaggaaacaaaacctaaagtcactgactgtctcacacgccatcatttttggtttatgctgtttagactccatggatttataaattacaaacaggggagaacctgtaagtgtagctatcgtcaaatctgacccaggctgatgactctcacttgtaaacacacaaatttgtaattaatggatcgtttccatgtgaattgcttttgtaattttaaaaagcagaatcaatgtcagggacacataaactgaggttttaccacaaacagcatgtggtcttaaaaataagacagagtttcatttacctattctcggatacttggtgacctttattcattttcatctctaagaactacttttcctgaaactataccaagtattattttccttttaactcagaatgcttttctttaaccaaatagcttttctcttttggcttgaaataatgcaatcattttattatgtactaattgcatactaattgtactatatatttagctatgccaccattgcatcaaacactgaggatacacacgttcacacacacagctcacgcacatgaagcacgactgaggcaggtggcgatgctgcagcctcatgctcttacttatgggtctcacacgtggacactagcctgatgggcagctgatcctttcccttgctctttggaaaagtatgccactccttgatcaatgacttacttttacacacaggcgactttcctgtccatttcatgtctgctttacatgttctgtgctcagatccccctgcgaggaaaaagcctggatggcaggtgtacactaaggtgtagccgaaagtaggaagatcgatggctctcacatccgcgtgtgccggggtttctggctgtctgcaggcatgagctgaaacaacattaggaaacattgagactttgtttattgtaaagttagcacatgtgtctagagaaattaatagattaaaatagtttggaaatggttatgcagtcaatatgtatatatacatatatatacacatatatatgtatattttttttggtagagatgaagtcttgctatgttgtccagtctgtgctagaactcctgacctcaagctattctcctgttttgacctcccaaagtactgggattacaggcatgagccactacacccatcctatatatatttatacataggtaattatgtgcaaagatttagagatcacagctttgaaataaaaacacttctgctatactaccgaaataaatatgttaaagatccttaaaagcccagtcttataaattatagagactggtgaatatttagatatgccttgattttgttcttgtggaaactaccaaatttattactcaatttaattaattattttgataaaactttaatgtgtatttagaaacttaatatagattcttattttctttgaaatataatttaggaataaatgagactgtgatgtatactctatatctcaaatcactccattccttataaagtttgcatacatgctgcaaataaaggattgacatattattataaaacaagtttacaattttatttatttatttttatttatttattttttatttattttttgagtctcgctgtgttgcccaggctggaatgcagtggcacgatctccgctcgctgcaagctcctcctcctgggttcacgccattctcctgactcagcctccccagtagctgggactacaggcacccgccaccatgcccggctaattttttgtagtttttttagtagagatgggatttcaccatgttagccaggatggtctcgatctcctgacctcgtgatccacctgcctcggcctcccaaaatgctgggattataggcatgagccagcatgcccagccaagtttacaattctaaaattgtgcatgcagttgttttgaatgttgtcactatttcactaattagtaaccacaacaaatacctgatattatcaagctccatattatatataaacatgcatatatatatgtgtatgtatatacatatatatgtacatgtactatcaacatataatttgagtaatgatttagagcagagataattttaaaataaatacacccaaaaatcacaccttatatactgagatttttataacattctattaatgtttttatttttaatacagtaagaataagacaccgcatttcactaaattcagagtgagtgaaatgaataattcacatactactcatccatatattttttctaattctcatgattaagtcacaaaataaaatgtgatccttaagtatgtatttgaatgatcaattcatatatacttcctgttatagcaagaataattttttaaacacttctacttagactctgacatatgacgttattcagttcatcctctctttggtaatttgatgtaaatatcctaggagaataatagcacgtacaaataagttttccctctaagaatgttcaatataacattatgcacttatcttcggtttcatgcagtttctcagactttacagtgcctgagaatctcctggagcgcttgttaaactaaactgtcccccttctctcctccctggctccctccagaggctctggttcaaggtcaaggatggggcttgagagcagccttcacagcccaatgtccagccaatggttatgctgccagttctagggaaccaaactttgaggacatccgaaaatttaggattagggaattaaaaacaatttctcattatttcccttagtggtaaacacgtctcagacattcacaataaataggtgacttgtgatgggggtggaagaaatcacacttacgtatacattcggtctgtatcccactccatgttaaattggcaaggcaggtgcgagtcgtggaaccttgaatatggtagccttttctgcacctgaaaaaaaccgtgcttccaacctagagaggaaatccaatactagcttcagaggccaagggaatatacgaagtgtcaactagtgatacctgaaagtacacgcccgagtaaaagtacagcagcaacttttcaggttaatgtcaagccactgtctaagtcaacatgtacattttaactgcctgctacagtgttacacacaatgtagattgctcaatgaataatgtaagatcttctcgaattttgaaaatttagacggctgtttgggtaaagaaattatgccttttctgttttagagttctttcttttttgtttgtaataattattatttcctttttcatttttttcctgccactcacatttgaaacaactggtatttattagaaaattacttttgttagcattccaaggggattggtcaactcctactcatacagagtccaccaaaactctacctgtctttctgatgcttcaaactgtacaaactatttactgttgtctgaatgtctgaggcgtcttcctcaccaggtcttcacaaagctaacccccacttaattctctgtactttgcttaaactgcacatccgctgcagattcttctctgatcctccaagaatgaatcacattcagcttgaatgcatttccccaacgtatctgctccactcaccacagtgtcctggaattacctgtatatttattcacccatgtgtgttcctaatttaaccagaggtgccttgaggggcagattcctgtgatctgtaaatgtcttttttagagaatgagctatggtcgtgtgttgaggggcaccaaagatcatccatggttctgtgtatctgcagcatgaggccagcatgactcatgtatacagggagaggaaagcagcccccagggaaggcgggtttgcactcatcccagcttggcttgggaccagattatttccttaaagcttgacttatgaaggcacataagtgcaccaagttagcatccaaagatttgaattcccctcttgtttcttgctctgagaattttaaccagttatttaattccctgtgtctgccttctcacaggcataagcccatacctcccatgttgggattccgggaagaataactacaagtaaaatgcaaggaaatagttggtacactgaatagtgtgaaaggatatcaggagaaaaaaaatgctgcttctagcacttgataaagtggaagtatgaatttataaagaaaagtacaaatttatctaaatgtcaaatcaatagctaatttaagattcaatgatgggaaagcgttgactcatttactcttgattgattgattgattgactgatcgatttaaactttagagtcagggcctctctctattgcccagagtatacagcacagtggtgcaatcatagctcattgcatccttgacctccagggctcaagtagctcccatctcagccttctgcacagctgtgacaacaggtgcaccttaccatgcccagatgattttttgtattctttgtagaaatagggtcttgctatgttgcccaggctgttctcctggcctcaagcgattcttctgcctgggcctcccaaagtgctgggattacaggcgtgagctgctgctcccagcccacttcctctctatcaggaacggtgtccatcaactctccatgcaagcatgtttgcaattccaaccagacctcctggtaaacatgctgacattctcaggaaggtcatggataacctgtatcatttactggcagaaagaaaatacagtctccttctcaataattttttttttagcagaatataccgagccactgcaaactgattatcatacactaaccctggagctacgggtttcggggacacgctggctggagaacgggaggtagtcatttaagctgcaagattaacatagcctaacacagggacatttcacactgaaatggctcactttgtgtaagtaaggtttcagcatatggtgctaaagaaaacagacaaaaatctcattggttactttaaaaactaaaatgttcctaataaaggaagaaataaaaacatttggggagagctgcatttcatggtctcaaccttctccttaaaacatggtgtctgggctctttaaattattagtaaatcttgctgttggataaaatcaattattcgtgttagtgtaactaatttgttataaggagggtgaaggatttatccaaccctattagtgtcatatgataggttatagaactatgttgctaaatacagtcatcattgacttttaattactgtaagttgtacataggcaagttaagaattgctcaaagcaatggtgatcaaaattttatttttcttagtgaatcagtgagagcgacatccatatatagtattttccaatattccttgacaatttggcattaaatatttatatacctgaaagtatttacttgaagtttaaggcaatatttgagacataatagaaaatgtgctagagtcagtatattattagctccctgtaaggacttcccctgtgggatgcaagagagctacaaggaaatggccactctgtgtccgagcgagaacaatgggaatattttcgtgctcacgagagatggggaaagtggctgaggaagaaggttttttattcttaattgatgagatccctatataattaacttttgttttcaaagtcatccaaccagataacagtgaagttatgggagtacttaagatggttaaaacattttatttcaagcttcattaccttccacttttaggtatttctccaacgttcactgaagtgttagtgttcattttattaaaagtcaaatgaacgttccaaaatgatatttagtacgctaataattcatagaaatttaaagatcatacggagaactaatttcacaagtaagtttagactaaggggcttacatacattttctcctatttttatctctagaatttaatattatttccccactatatccagtccctaagtggaaccttttatgggtagctaatcagtgacaagttaccccaatctgagaactgccgtgagaatttaacagacaaataatagaatcatgcatgatttcaaatagaaaataatgtaatagttgctatgttaatttctatatgaaattatgcattattccattattatctagtaagcaagatatatatatatatatatatatatatacatatattgattttgacagttaaaaacacatgtagaaatcccctttgaacgaattttattcaggtaaatataacatgaataaggtatgatataaaaaagcactcacatatgtttaagtaacaaatatattttatatttccagaaagaaaacatagtaaattcataatgaactacctcatagcctctggagctattctgtattccaaagtgtggcgtaccagggtctgggcaggtgttatgagcaggatctgaaatttgtgatttaaaaagaaaagagggcaccagatatagttattgtgagaattttaacagctttcactaaaaggtctcatgaaatagagaaaatattgttttgagaaatgtgcaagatgtttttcaggaaagttaaaaattaaattgctacttttatcttctcttcaagacatgttttttagatgttaacttttagactttaagtagttcagtatgttcttcttatataagaataagtgcattttttttccattctctggcttttttttctatagaaatatatttggtcaatgatatactatcttcaataatgacctatcactatctttttgcttattaggattcaataattggccatctcatttggttacccattacattattctgagtttctttaattaattttcctcaacatttcaaaatgaaaaatatatttaatgcttcataatggaaccacatggaaaaccaagagtgacatttttcaaaaaacacaggacttgggtaacccagtggcacttcagctctcttacttgctgctctacagttaccagtagaaaaacaaaacagataacttcttaaaacctgttatctagagtgactaaccttctagggggaagaaaaatatttttagtgtagagatagctactgtatagcaatagtttaaatcaaatgacagcaaatattcttctaattagaaaaaatgcttcaatgacaatatttctttaatactatattttctaggtggatactattcaatttcttagaaaataatcaagactaagtattacttttttactaaaaattagtagaacacccattattctgcttagtaaatctcaatgaacaaaattaacccagcgataaaacttgactctgcagcaataaaacaacagcaagactgtctctctggggagggctgctttagagaatgttcctacctgcacctttcccctaaacaatgcaattggcagttaaggtagacagcggagagagccactgaggtcagagaacaaagtctagtagctactttagcagacttctgacttattttgcatgatttaaaagaggtggcacatcagtttagctgatgagtgcgcaatcctactcagtgcaaaaattattaccttgtacagaaaactgtctatggaaacactttctatgtaatcacaaatgacccaatttcggaatgaagcgtcctcatctccaaatactcccaggtatccccagagctgtatgataattattaccaatgcaggtgggttgtatgccgctccacgtgccgtcagcttggcagactcttctggaggatcccacgagtataaatggagatttgcactggaagaagacttcggacttataggtgaaacttttcccactaagtcgcccttctgcggggatgccagggtctccgcagaacacagctatggaagataaccaggaagaagtcagccttcaacgtccctggatcagcttcaccaattgagcttggtaactagtttctgttaaatctttagctttaactattaaacaagaaaaacgctaaaaggaggccaggcacggtggctcacgcctgtaatcccaacactttgggaggcagaggcaggcggatcgcttgagctcaggagttcgagactagcctgggcaacatggcgaaacctatgtctacaacaaatacaaaaattagctgggtttggtggcacacacctgtagtcccagctactcgggaggctgaggtgggaggatggtttgagcccgagagattgaggctgcagggagctatgattgaaccactgcactccatcctgggcaacagagtgaggacctgtctcaaaaaggagactctgcccttaggcaacacagtctcaagtttgagtttttgtgtattttagggctattattacccaccaggaaggtcctcagattgtaaccttaggatgtgccctggttatccgtccctgttgcagacctgcagtgggcggaacaaattctgctgtagaacttacggagacactgggggatctctcctttccacaccccgcgaccttcacaggagaggatggcggagtgagagagctggtaaccgtccatgcagctgtaacttatgctggagccccagcggaaatcacttccctccactgttccattctgcaccggcggcggctgaggacacagcacggctatttccaaagaacaaacaagatcaacattccggagctcccgctgcagcggtgatgttcaaacgattcccattttaattttacctgaattacaaatgacatctacataggtttttaaaaaaaaataataaaagaattgccaaggaagacagtacatcaaaataacaaaatattttttagaatatttcttcattaatatcgatgaagtctataaaagcaaagtcaagtcaaaacatataggattgaacatgacattcccaatatatacaaggccaagaaaggaagaaacgttcttgcttaatttgtgtctttttatgatggttaccaaagacaattcgaatgaggatttggtcagatgacacaaatttataggcacagatggtaagaatttttctggccatctgtattttttatttaaagatggcatatagtttccaaaagacacagtcggtccatctatttactgaatatatttttttagaaatgcctgaatggttaaagaagatgctgtggaataccatttgcaagtgtttcatcacagccttggagcctgatgtccactttatggggctgagaagcaagcacgtggttgctagggaggatttccccgagggtgatgtcacgagagatcaccttccccactctagaaattatactaaaatgcacaaagggaggcaaaaatccaaaaaccactgtctaaaatccttcttctctgaagatacacaacttccctagtttttgaaatgaatggaagtttccaagtgaccctgtaggtagcagaaggcactacaaaagaacaaccgcttgcattttgtgtgttcaggctcatgccttctcacgtgagaaagacatgccaacacacacaaatcacatgtgcacacccaaaagttggaaatgggtccttccctcaccactccaccttctactgatctgttcactcgttcaacaaatccttcctgagaccccacagcgagggctggggaaatgcgtgttctggcccaagggaatgtccagggggaggccccagttggaagagacctgagctacatgggtcccctgggggcagggggaatgggaggagacaagttcaaggagggacagagagagaaagaggtcccatctggtagggacttgctggccgtggtgttgttacaaacacaatgggtactagaaagaggataaaaatccacagaattatgcatgaagcatattttattggcaatttccatcatgaccatttgacctgaatactgccgacacaacgtagtgcattttcattcaaattcaacatttatttagcgtcagctatatcacaggtgcagtattaagagttacaatacaaagaagggaaggcaatgagatcctttgactctactgggagacgaaagcaggatggtccaagaacacgcccatgtcagaagagagagaaagccatatttttgagcattcaggtcacatttaagcctctgccacatttaaccatgtgtcttgcagaactcaccgaagatgaaaccttctccataagctactgagtgtcctaactctccctccctcagtattttatttgttcctagtctaataaggaggagaatgccatcttcttatgtttggtcactgacagctttcaagcccctctctccccctcttcttgtccttcctctgcaccagctgataagaaagtctggatagttcttctttgcttctggtaaataaactgtcaccacgcaaatccctggcccttgcacagccgccactcagccctgctccctgtcactgtaagagccaagcccactcactctgctttactgaagccaccttgatgagttgagcctgtcttgatttgcccagagggtccagtcacataagtcataaacctcttcctgccttctcggccagtgtcatcttcagtctcggcaaccaaaccccatgaaacatcacggtgctaacactctctaccagtgctctgccattactaggtgattggctcgtctctccaacctgcctctaaattcctacaattagattcaccatgccacgaacacctcacacagctagggtcacaggtttacccaggacagcaaagcactggggttcagacacagactctagggtggcgtgaccgtcactgaaccccgacatctccagttcctggtttgtgatcctaagccttttcctctacctcgctatgagttagtttttccatctgtaaaactgagattaaagtattataaaaataaagtgacttaatagttgcaaattgctgttcaagaattcctagcccctagaagggctacataaatgcttgcaaaattaaacaaagcataattcaataaagacttctatacacatctgtaaaatccaaagagtcaccaaacaaacctttgcagacaggtttgctcggattccacctgccgtctttggtacagcgaatagtggcggatgtgactgcttccatgacatagcctgggttacactgatagctcacagtcttgttgaaggtgaagtcggtcccaaactggatgccatttgctagtgtgcctggatccccacaacttataactaataaacagggaacaggaaagaatcagagaaattcatttaccatgaaatgaattagtcaccatttctattcaagatactctctctgagttgctattcacagtggttaagcagtgaattaatacagcaatactaccctctgtgtgatgatttcactgacccgctgtcagaaggaacacttgtattttgagaatcactgatttctgttccgttggcagctggctgtcagatgctgacttccaccccttgactagcccctaattaggcatggggtataatcagaaagatgaagcctgcagccagagaaccaaagacatttcttctttctctgcagacccagtggtctacagacaaagtctggacttttttggtctcaattttacaatgtttgactgaactggccttttaaagtagcttcagccatacgaataagcaactggaaaaaaaatcttaaagtacttaagaaatacagccacaatgtcacacatagttttcccttttttcctctatgaattaaaaataaaaaaacagtataacaccttaaagtcattttttttcccaatggagtgaatttcatagtaacgtctgagtctaccatgatgtctgcttactaacttgtgcagtcgggagcagtgcctgtccaggtcccattggctgtgcaatgccgtgtcatgagccctgaggtcttgtagccttcccagcaggcatagatgaccgagctggagaacagaatgccatcactactgacaatcattccgttggtgggtgtgccagggttgccacaggacacggctgttaggcaaacaagaacaccaccacacacagtgagtgacccagcatgaaaatggcaaacacaagagaccaatgggtatcagtgcaatagactacacatttattacaaacccaaagcacacaatcctatggaagttccttaacatatggcttactatggctcatatgtttattttactgattagctacaaatataaaaataacctttcaattcgtcttttctaaagtgaactatttctaaacaaattaaaacatgagttaaagcactaaaagttcaaggccctgttattcagggactgaatgtttttaatagccttgctatttggggattgaatgtttttaatgccgtgacagaattgttgtgatttttaaaaaagaatatctatgatattagcaacactgaagcatcttcctttatgtaatcactgtatttttttaaaatctaggcaattcaggtcctattttacatctccaggagaattcactttggaaaataaagaatgcctcagaagtatgaatgactgtacttgaactgctttgtaaaatggtgtcctcaataattaccagctctaatagcagctgtgttaattggctttgacatgattgaactttacatttctctcaaaaggctcctaatgccatgtacaggcaataaggcctcaattaacgatggtcagtgcaacaggtctacactctgtgcctattttttacgctctttagtcagtaaacaaaagcaagctcggctgccgctgggtacgtttcagggtgaacatttcaatctacacttttttttttcccttttttagtcgagcctatttaccagaaagattgctacattttctccttagtactgttgcaataatatacaataggcaggtaaataaaggaagtgacccttggctggttaacaagaatatatatcatgagactgcctctgagctgatcaaaatatttaaaaatacttttgcacatttaattgaaacaatttcaaatctggcctggagaacaaagatatatttttcttaaaagaacatggaagaaaacatcctgcaaaatttgctcagcacagagaagtcactgtactgggagtcgagggactacccttctgattacatagaaataaagcacttgtgctcaggttgaactggatcttgtttgaaaaaaataatacaaagtgcacacgctggtgcttcctggtcccgtgccaatggcagacagaagtactcaatcacagccctcttctctgatggttcacggtgtgacttccaaccccttctaacacagacctattagtagtttcctggttggcatatgagttgggatgtatttaccaatccagaagcacatactatttaaggctctctaaaacttgaaagttttatgataactatactatatatcaaaatttcattttgcaataattaagggttggactatccaagacaactattcattcaacaaacacatattcctcacttactgtgcaacaggtactgtgtggatgggctaatggaaagcctgtcacagaaagggagtgagtttggtccaattcatagtttaacaaaccgaaagaggacactgatgttattgttacattgtattctaattacatttgctattcaattgtatgtctaaatcttcaaaagccacctaggtagaaccaatacttaaacaagtcaaataaccgatgaaaaatttcaattcagtttgtaaggaaactaaaatgttagtttgctaatattgttaatgaatgagtaccagcataatgctatcctaatattgggaatgtcccctcaaatattgtactgtggaaagtaaaattcatgattagtttttttctctttttttggctgacaaaaaccactttcactcacggttataactatgaaaatgactagaaggcaatgtcaacatatccgcttttctatcaatgcaattatgtaaaattataagacaggactaagactaaaacaaaacaatagattaaatttagaggagaaaaaagaacaataaattagaagaggaaaagtaaactggaagaagaaaaataaattaacctgtaagtttaaactttgccatattttctctttcctgagtttattttcttttgaaatatgcttttataaaaagtacattttgttaacgtgacttcttcagctaaaacataatttctttaactcagcatataataaaatattatgcttattttaaatatactttattatttacaaatattagtactgttcattttgcatgctacatgacaaaaattgctgttaaattgagttaaatagatgtgaatatctgctcatgcaagttaaataaacctgagcaatcaatttaaattccttagatatagtgcctttaaccataaaatgagtattataaaaatacttattcccggctgttaccaaattacccacgctatatgtaaaatgcctagtgtgagatctgatgtattagtggtagcaatgagttagcttgtagcttatgctattgttattttcatcatcatcactcttacttattgagtaaagtgtagctttatcataatttcatctgaaagagaattaagagttccctaatacagctgaaactaaatattttagttatgtaatgcaacttcatgagatagatccatttgaaatcttaagcttgagcctatgattaaaagactagatggctaacaaaagcaaatttgatttaatgtgaaggaaatatatctgcaatataaattctttgagttgaagaatttaaaaagatttttcgtttagaattataatttcctcctcctttttataatttattcaatttaccatcagtatctaactttttgacagatttagaggaaataatttcatcaggtttgcaataatcttaactaggggattagtcaagtcatagctagtcatagaagctacgcttcctggaaatgcaaccactggttacatcctttttcatcgagaggaactcacacttcagtgatttggacctatgataacaaacaaggaacaaaatgaaaacctacagattctccaaaatgtatttcaaatttttgctggtgtgtgtgtgttcagtcactgattttatgacttttatacataatttgttgccttattgggtgtaacatatattgcagtgggcttattcagcttcccatgatgtccgtatcatataatgcagttttagaagtaatcaattttgtgaggcatgatatatttgagaaatattttcagcattgcaacatttttgtaacttattttgtgtatgcagcttttaagggctaagtttctaattttttttcatagaaaacttttaaatgtctaactttagaaagcaaaataaaatttttaaaaatactttgcattgcctgagttagatagattgggaagtgaaacgcaattaagctctcattcaaataaattgtttaatgtgtactttgctggactagaactcatagtgtgccttcatagccccacagaggtgagattgctaaggaaaaacattgcccaccctcaactgttataattttgttcatcttttaagttttcaaaactgaaatacttgaggtaaacatgatactgaatgtacagtctcaagtgaatggccatctttgatagaatatttcatattccactttctgggagtgtcagagtctctgctcttcatacaccaagttcaggctgcaaaccagggtttaggctcaattattgcatttaatattcttgaaaacagaaggatagttctgcttttaatcagcatcagattatatctataaagtctgaataattattccagcattcacttattgacatccagccctctttgtaactattgaggaaatattttaaatttcaattaaaatactgccgatgagtgatctttcagcctctctgtttttaaacaatggagaattaagatccagaaccaagactttgtgatcactacatagaatcaggtctagagccaaaatgtcacaattcacaaacccaccatggtgctttccaaaagtcccgaatgataaatgctacagatacattaagctactgttaaatgggatttgacagaaacgttgaaattttactatggaaattgttttaatttattggcaacattttttgtaactccacactttgttataactacaggattaaacaaacttcacaaaaagattataagccattcttacacaccctttagtcagattcatccactgtttacattttgctcactttttctccctctgtctctctaaatatgtattttctaaggtatgtgagtgtaagttacagacatgacaactctttagagttaaatatatcagtatgtatttcctaagaacaaaggcattctcttacataaccataatacaattattaaaagaatgaaatgtaactttgatgcaatgttgtctcatacacacccataatctaattcacttcaagctcttggacatatttttaatagttgtcttaagatcctgtgtcagttcgccacctagatcatctcagggtcagactctaccatctcggtaacgcctctcataactctcttttgctcagtgtaggacccaatccgagaccacacattgcacttatcgggtctcttaaatctgaaagaatcactcagacggtgtcttttctgaacttgacgtttcttcgtgaacacgggcaagctgatttgctgcatgcccctagggttttgggggatgttattgctgctgcttcaggactcgattcaggttacgcatttcactggcaataccatagaaatgacaatgtctcttttcagtgcctcatatcgggaagatagaacatcaccttgttaaaatattggtgataatggtttatcccataggattgcttacctgaagtactatatgaaagagtagaaaacactctggttttggtgagaaaacattgctctcatgtgcaaattttaatactgaaatatctacaagatgagagggaactgaaaacatttgcatttgattaacaaatttatatcaatttatagtgtcatacttcagttaaaaacaaaagtatgatcctgcaattcgtgactatgggtaaccatttctcactactaatcagtggtatttgacctaagacaacttttttagggcctagtcttaagatttatactactttgattgtcaagaggcaattcagagtaaaaaattatcttggattatcatgtttgtgtgcacatatgtgtatgcctatattatatgcatatatatacatatatagtcaaaaatagtctttgagaaaaaatatatacactatgcatgggtaaatataatatataaatatgcaaatatatgcacaaacattcctatattaatatttagcgttattttatatgtgaaattaatgttacatagattatataatatagatagatcatatacatacattatttctatttacctatatagaatgtataatacaataaaggcagaagtggagacagtatagtcaaggacaataaatgaagattaaggaaactcaagttaaatttctcacattgatagtgtgtatgtgagcttactcaagttggtaaaattatttggttggaaagtgtttcatacatacaacaatacatattgaattaatttgtataacctttttagactgaaaatttaattgaggagtttgcttgtaaagaattcctaacatttacattcctatctgtctgaattctaaatcgggttttgaactccgaatacatggttaccatcacctctcagttcacctttgcttgaggctacatttctgatacacagtgcagtgtctataaggtgtccgtggctattcttactgtcattactggagcataccaccacttcctacgatgcctctcaaacattagaatcaagtagacccactccaaaatagttcatagaatataaccccagattcctgtgaaatagagtgctccacacacaggggccaccaacagattggaaatgacgtgtgaaggaagcctgcttccagcctgcggaaattcccatcagtgatctgcattggtcctgctcactgctctggaaccccactcactcactgccaggatctagaaaacactggcaacaccacatatagattatcactgggagaagattagaagcttccgtgttacgaactttcaaacaataagcatccgtgtgatgggacctgtggatacttggaatacctccatgcacccagtcatgatttctgatgatgcttccacaaatattgcggggaaaagatttaattgtataaatagtacaaacctctagaatttttgtagaattttgccaggcattttagaacgagctgtgtggttttaactttcaaggtggaccttaaggcttctggctactcaccctcacacaccggctgcagtcctgaccatgacccattgagcaaacacgtgcgttcaggggagcccctcagctggtgccccatttcacaggagaagcggagaagactctttgtcttaaagtcatcaccaagccgagacccatgtgctggggtccccggatcaccacagaatccaggattatttcctattgaaaacaaacacatacggcaatccacaattgtgttagacttgttttaagcagagttgtcacacttaaagataatgaaaagttgttgaaatttgtgtttcacatgagttatggttacacaacattctgcaatcttgtaagaaagaatttctttgtgatagccccaaaatgaaaagaatttaggatgtggctcccatgttactaacttcacaatagcctattcaaatatggttgtgagaataaacgacgtttcctttggaaggaggaaaatgccaggaatggtaaatgcatcacgtcttcactgaaaaggtaggtagagagcaaaaggaaaatggggctttaggtaaacagggaatgtggggaaaaaaaaaaaaaaagtcaaaggagaggtttagctcttcagaattgtgtccagagttgctggttcgctgaattttggttgtttaagaaacattcgtgaaaaaaataaagataatgttttttttcttccaaagaggacccatgcggttaatggtggtagaggatgatggtagaggatgatggtagaggatgatggtagaggatggtggtagaggatgatggtagaggatgatggtagaggatggtggtagaggatggtggtagaggatggtggtagaggatgatggtagaggatgatggtagaggatggtggtagaggatggtggtagaggatgatggtagaggatgatggtagaggatgatggtagaggatggtggtagaggatggtggtagaggatggtggtagaggatgatggtagaggatgatggtagaggatgatggtagaggatgatggtagagggagggaaaattaaccacataaaaaagaataaagagcgaacagggacacacggagccatggccggcaagcgtcctctcaaatgagatccagactctcctgagaaccccggaggagaacatttaaagtaatggtgtctaacgattattgcgaagatgaagacaatatctataagagcggcgtatttggctagaaatgcaatactaatttcaaataaatgcataattatagggcttttcaaataactgtaaatcatcattatttgaaatcactatttgaaaagttatttgaaatctgtaattctgtcagttcactcgtaagcccctcacctgtgcagtggggcagtgccccgctccagtgactgtcttcctggcacactctcgtgtcgttgcctatgaggctctcgctccctctgcaggagtagtgcacgacggcgccataggtaaacagctctccagtgaggacggcgttggcagggacccctgggtgtccacacgatatagcttcagaaaaaagataaaacaattgagtacatccttccagttaaaccactttgtattggaaaatctcccatacagacacccatactgacatcatgtattaaagaaaaacacctaaatattctggtacttatgtaatttgtgagaaataccaattttcagatgacacttcctcccctaatttctttactgaaaaggaaaggtcccgtttatgaagtttttgttttgctaaggtagctttccttatggtagaaatttacatgtggattttcaaggagacagccatactgcctacatttttccatcgacccttaactatattccaaatgaacagtattataggaaatttgcgaaagtaacatggatgcattaaaactatttccacgatgttttcagttaatatgacaatcatattctttgcttgcggacatgattctgtcaaatctgcttaatcttcaagctcacatgtctaagaaaaccattctaacagttactctttgaataaggggcagtctaatatgtataagtaaaataataataatcaattattgattcatttgttcttcaaattgttctataaaataatctcattatttcccttcatttccttaaaattataccaaatcaggcctaaactctatttataaatatccttcaaaaaggcaaactctgtaatccagattaaaataggatagtgaagatttatttttcctttactgtacagtatcaaatgagggctagcaatggacaaatttttatctatatgcaaaaataaccgatttgagactaccaaggaattactcaaaggcgactgctttagtatcctagagtaattccatttggtaacgagacacccagaagggttatcaaccagagaggtagatttgaacgcctggaagccatggccatcccctgagtcatatcagccgtcactttctgtcttacatggacattgattcattggagaaccggattttatccacatagagtccttaaaagaagccagtgagacctgaaacagtgaaatgctggataaatgaccatttccaggtgaaataaaatttatatcttatttaaattttaaccttcagtgaaacaatatcacagcaaaatcagacatggagctcagctgctctagagcatggaaaagcaaaggcaccctgagatctttggattcccaaagtgacgacaattccaactgttaatgacaccaagcggagtgaactggccaccccggaaaaggagagccagctaaaccccagctcctggagacttgaggaacatcagcatcagtacaaaaccaaatggaagtctcacacaagccagtggagacataaaagaaatgttctgggacagacaaaaacaaaactaaaccaatttctatgaaaaattcccatgtgtgaaagcaaggaagatgagaatgcagacataatttgaagaccgtaacacatttacagatgcattttttgttaaataaggctgagaatttttttgaaagttaccactgtcgttctccacaggaattaattgaattgttgaagttagaatttgagatgagtttctgtgtagattagaggaatgtgagggaaactcacttggagaaaaaaaaaaaaactgcaacactaacccattctcaaaatacacttcacagtgctaaaactgaaaaggcaagaggcattatcccttttattgtgtatgtggtagatccgattcataatgtaagtgccatttccctcctcatttctatttttatttttttagagatggggatttgtttgctggccagcctggagtgcagtggtgcaatcgtaactcctggactcaagtgatcctgccacctcagcctcccaatgtgctgggactataggcatgtgccaccatgccccactagtttttattttattttttgtagagatggagtctggctaggttgtccaagttgatctagaactcctggcctcaagagatccaccttccctggcctcccaaaatgctgggattacaggtgtgagtcacggcacctggcctccactttctttatggatgtaaaatgcataggacaaagatcagattttgattttaaggattgctttgcttctgcctaatttcaaaaagactaaagagagtaacaccttttcctaaatcttcagactatgatcttaagacatgattctcttttagttaacagtcaatctgatttttttttcaagtcaaagaaaataacactttggctatttgggtaaaatgatatattcttgctaatcttcatggtctaaaatacactgacaataaagctgtaagaggggccataaggatcatctataattatctctgcccagaagaacacatccatttttcagagccatatcccttcccctgatttaaagattcaattcacaagccaattactatcaggatatgaggtttttttaaaaaaaaaaagaaagaaagaaaaaaagatttaataacaactttattcatttattttttatctttatttaagttctgggatgcatgtgcagggtgtgtaggtttgttacgcagggaaatgtgtgccatggtggtttgctgcacctatcaatccatcacctaggtaccaagccccatatgcattagctatttatcctgatgctctccctccccctaccctactgacaggcctcagtgagtgttggtcctctccctgtgtctatgtgttcagctcctacttataagtgagaatttgtggtgtttggttttctgttcctgcattagtttgcagaggataatggcttccaagctccatccatgtctctgcaaaggacataatctcattcttttttatggctgcatcacgttccacggtgtgtatgtaccacgttttctttattcagtgttttactgatgggcacttgggttgattccatgtgtggttattgtgaatagtgctgcagtgaacatacacatgcatgtatcatgggatctaactaaacaaaagagctttagcactgcaaaagaaactatcctcagagtgaacacacaaccaacagaatggatgaaaatcgttgcaatctatccatctgacaaaggtctaatatccagaatctacaaggaacttaaacaaatttacaagaaaaaaacaaccccattaaaaagtgggcaaaggacatgaacagacacttctcaaaagaagacatttatgtggccaataaacatatgaaaaaagctcaacatcactgatcataagggaaatgcaaatcaaaactacaatgagataccatctcatgcctgtcagaatggcaattattaaaaagtcaagaaacaacagatgctggcgaggctgtggagaaataggaatgattttacactgttggtggaatgtaaattagttgaatcattttggaagacagtgtagcgattcctcaaagacctagaataagaaataccatttgacccagcaatcccactactgggtatatactcaaaggatatgaggtttttattgtagtcaccatggactgtaccaggaatgctcacaaaacccaatcaggtctcacagcactcccttctttggccgtagatgccaggtcaacagacagaaactccacaccagagcacttcgcccacctgggctgagcgagagtaagacgcctggcggggaggtcctggctgccgtgtctgagctgtgtggaccaggcctacctggtaggctgaggctgaaggcaagccatgagaaaaacagataaaggcatcattgtccaagtggcatccaataacctgggtcatttctcctgagcataccagcatcccccgacccttcaaatttgctgaagttgtatttggtgatttctggccactcgatctacagctatcataaaaactcctacaattggtgatgggaggacagaaggaattaaaattcagtgccttttaaatatacttacggaattttctgctgatggtgaccttgcaggggtctctgcacagaaattgggaataaccctgacttacccaaacacttgggcagggatcggtcccataagccatttgccatacaggtcaaggctgaagatcccagcaagtaaaatcccttcttgcaatggtacaggatactcattccatactcaaaactctcagggaagttctgttgcccgtgacgaatggcattttccacaaagcctggatcagaacagttcaccactagaaaataaaacatttcacacaccatttagaaacagctagaaataacaacaaaatagatcagaaatgaaggcgaattcctcatcattttagaaagttcaaaaactgacaacatgatggctgaggctcatgaaattccactctcacgatgaattctccgctttggaccactctttttcaagaggtgtcaagaactggtcgaccacgatagcaattttcacgtgaggctaatttcctctatttcctagtaatgtttattcaacgtaaattctgaagttagtttccttggttaagtttttgtgttctaataatggtcaaatagaactagctgaggttcgtttaaatatttttactcaagtgtggtgttttagaacagtctgtggcacaccagttaattaccccccaacacacatacacacctacttgcattagtgctttaatatgtgtgcctaaaataattttgctctatgtagaacgcaactaaaaatgacaattattccatcaacacctaacagaaatgcaaatcaagccagcctctgacttaggcctcttctccttttagaaacaggtccgtggtgaggcagtcttctgcggcatgcgggacatgctgtggttcctctgaaaggcattagcctgaatgcctgttggcgtctgtgagggaattagcgatgtgcttttgcaggtgcagaggaaaagaaagaactctgattacctcatgctttgacccaccccaccagtgaatgaggcagctgttccagaggccacagtctctccagatatttctggctcagaaaagcactgtgcaaatgaatctcgggcggcctctgcacatcatgagtcccagaagctgaagacaaaccctgtacccaaactgtgcgttttatttcttctctattcaaaaaaggaaggcagagggcagaatcaaggcttacagtgttcccttttagtgcagtagaataatgttctatgcttcctaaaacacccctgagtttacagaagaaagtcttgagttcttttgaatcaaaaaagccaaaacaaacaaaaagccatgtgtgaagttcgggcaaataatttttaaggcatgtacatgcccctacagggcatgtatctgcaatacaattgtaaccaaatctctgaaatagcaggaattacctaatgtgagaaattctaattaacttgaaaatgtgattatttgtataacctggaagacacccacatcgtcccattcttacatcaagcataagagatggaatcagctcccccatgccatactttcataaggagacggacagtcccgggctggaacactaaagatatttttgtgtttatgtttgtgcttatgttgctcttaggagactgtccaaaaataatttcaaactgtgtttgtaatcaaagcagagaaagccacttaggagaaatgagtggaagactttgaccatctcccactaaggatgaccgagagaaaccaaatggccccgggatgccaaaggccagattgagctgatgccaccatttctcctcctcctcctcctcctcctcctccatttcctcctccacctctgtgtcctttcttcctcctcctcttccttcttctcctcctccacctccttgtcctctcctcctccttttcttcctcctcctcctcttcttccatccctctcttccttctctttctcctcctccttctctttctcctcctccttatcattttcatcttctctttggcccagcctctcttaaaggttcactggcagacatttatttactggtgcagtaacaacaggatccagtcacacccttctccttgcaggcagagaaccaaatgttctctgagttccaccacggctggtgaaggggaatttacaatatgtgaggttcataaccttgctctgaaactaaggactaaaattctctttaagggtcactcttgccgtggaaagaggtgcgcaggagacaataaacccctcattcttgtaaatcattttgcaaccttacattgcattagaattgcttggaggatgtgtattaaaatgctaagccctaagttcctaccctttcctttacctagttcactacccttaaaatattttgagcagtaaaaaatgtttgaaagcaataaatattccttgagccccatgtggggaaactcagtggatcctaaaatggaagaagcatggatacaaatactctaaatcttctcatgcaccttttcagtcctacatagagttgcagtcagaagtctttctttatgttccttcctatttaattctgaggctccaataggagatacagctgcaactatgtgctggaggaaaaacagggcaggaataatttgatttatttgtccatgatagaacttccataccattgttgcaaatgggtgtgttttactgtacagagaagaatttatctgccagaagagtttgttagtgaccaaccaatccacacaagcacctttcccatctgtatttgttttgtcattttctatgtgaacaattcctatccagggatctgatggaaagaggcttatgtgagtgacaggtgagctattggtttgtaaactagaaggagaaatggccagtgaagttcatggtgcggagatatgtcaggcccacctgcagcgactccagacctggttcatgacatgctgttaagtatagggtaatgcgtcagaaagaaataaagaggctcactctagacggctgcacctcatcttaacatcttaatgcctaatacactaagacttgatttccaagtgtgaaaacctgacatggaacctgattttgtcagctgggaggaatgagaacactgatgtcttatatacatacagctcagcgtggattttgtcagctggaaggaatgagaacatgatgtcttatatacattcagcccagcagggagaagttcaaatgaacacacaggctgtgttctgtggcgaaagctgggtatgtggaaaggtaaaagaagaaattaataccgggatcaataacaggtccaaagtcacaatgacaattgaactagaaatacataagaatcaggactcctgaacacatgtctggtatagcataataataaaaggcatcagcattccttggtgacaggaatcccagttgcaccccacccctttttcctggagaggaccagctggaaatcttagccctcgataggattctagaggtgactcattaagctattttctctactctatatacactccttactcagagatgtcttcttaaagatgctcaagttgacatacgaatatgggtaacaggccaggtgcggtggctcacacctgtaatcccagcactttgggaggccaaggtgggcagatcatttgaggtcaagagttcgagaccagcctggccaacacggcgaaaccccatctctattaaaaatacaaaaattagccaggcatggtggcaggggcctgtaattccagctactcaggaggctgaggcaggagaattgcttgaacccaggatgcggaagctgcagtgagccgagatcatgccactgcactgcagcctgggtgacagagcgagactctgtctcaaaaaacaaacaaacaaacgaaaagcaaatatggataaacataaggtcctattgtttattctctttcaaactttcttgaggatcatggaggtccttcctatccagtaatgtccccattctcagttaagtgaacgtactgatcgcctgatgaaggaagcctgaaaacactgtgttttgagatttgatggtgaattatttgagcagttttgccagctctaagagggatcactgttcccgtggcatgcctcacaccgtagtaggtctcagcaaagcacccgcactatgaccgcggctccacctccaggagctgccctgtcctgccatgtgctcactaaccagtgtttcccttttaattcccttcttggggacaggaagcaaggtgtgctccacatcctcgcttctttccagaacccaaagcaatggcagtgttttcctgaaaaactccctaatgacagagaaacgtgataattcccatcccaggttccttctccagctgttgatcaatagaaacgaagccacctgtctgcacgctggtctcttataggcagcttggctctaagctgaagggcagtaacagggcatcacataagagtctggtgtcctctccatggcacagatgctgggctcttcgggcagacgactcctaacataactttgcaggattcgtatctattcgattccagcctgttatgtgatgaggaaacaccgtgaacacttcaactgttttttaattagataatgtaattccaagttccatctgttgttctcagaaaaactttttataatcagttcttatattaaacagaatctatatctgatatatatatacatacatatatatttttttttgagatggagtcttgctctgtctcccatgctggagtgcagtggcacaatctcggctcactgcaagctccacctgctggattcacgccattctcctgcctcagcctcccgagtagctggtactacaggcacccgccaccatgcctggctaattttttgtatttttagtagagacagagtttcactgtattagccaggatggtctctatctcctgacctcgtgatccgcctgcctcagcctcccaaagtgccgggattgcaggtgtgagccacctcgcccagtctttctgttgtatatttttaacttcatttatttattcattaaaatgtattacttaacgataattatagataaggctttacttgaaggctctgagatgattagagcagaaccgtggactttcacttgtatatccaaaatttggcaaaaaattgtaaatctaatcgtaacccaaagtaaagcacttcccagtctttggcatcagcactctttcctacaagcacaatagtttttaaagaaagtataagcaactatgatcgaggtcgtgcctaacttcttatttttgtagaagctctgcctggggccaaatttgttcttatgtgtgttgattttgaaaggcaaaccatggaaataaagcttagtttttaaatttcaatataattattatacaaaaaggaaaagtaaaatcgaaactgtcagattaaactttaaaagctaaatgctatgggctaagcttttatgtgaaattaaaaattaatattaagcaaaattggcagaaatacactgttacagtatgaactggtaactcctgttccctgagcaaatagaaaactgttaattactaagaaaaaaaataaaaccaacttagtgcaagttctgtttttaaatggctgtgagtgacattctgagaataaaaggcaactaactttccatacatttggaggtgcactgagagaccatccgtttatgtcgctgcctcaaatcggattcacaggaaacgtctgatccacgtctgtcaaattctgctcactggggcaaccctcaacagcagtgactgggagccgagcaaacgcacaggagggagaggtaggatgctgggaggagcatgggatttaaagaaacctgtgcgttgaggctatttatttactttttcttttttcccccgagaccacgtcttgctctgttgcccaggctggagtgcagtggcattatcttggctcactgcaacctccgcctccctggttcaagagattctcctgtctcagcctcctgaatagctgtgattacaggcatccgccaccatgctcggctaatttttgtatttttagtacagacagggtttcaccatattggtcaggctggtcttgaactcctgacctcgtgatccacccaccttgggctcccaaagtgctgggattacaggcatgagccaccgcgcctcgcctcattcttttacttcatgagtgctggatgaacggccagcgaagatgagcaaatagaagttgtcagagacacatagtggtaattttgggtctaggaagtcaggaatcccaacaagcccagcatcccgtgcaaagcacatgggtttggaggtaataaacttttcaatcgtccataccaccatcgacttcagattctgttggtgttttttaactcacacatatttatgcacgtatttaatccaacacgtttgactacacatcacctggacaagaggtttacatacccaacttaaaaaatacattgaaaatgttttaaagtataacttctttaagtttgaattttaagttaacagttaactctgaacagatactggaacaaatcagacctgagcttaaaattttggcagaaaaaccattattttaagaccatcattggcctcaaagcgactcaaaatcaatatacgtcccaatataaactgtgacacaatttttatgtcacaaaaattgtgtacagaatatagaaaccttaattctgtaagcagactggaaatataccatgttcaaagctttattttgttttcaaaaagaatcctgtggccccatcatgcctgtatcactagcttctgcctagttcaggaacacgcaaaacacatgatatttccacatgtaagtgagggaggagactgtggtgtgatactgctacactgtttcaccacgtgaggcaggagactgtggtgtgatactgctacactgcttcaccacgtgagggaggagactggtgtgatactgctacactgtttcaccacgtgagggaggagactggtgtgatactgctacactgtttcaccactttccttacaaaggttctatacaaagtcactaaattacacaatgcataggcaatatataggcaatactccttatagttttcttctgaaattttacttttcttaaaaaaaatattcaatgaagtataactgataaagtttaaagggcactgttcaaacaaacattgtcaactgattgacatacaaggaagaaagtcataggagagggtgactcagcttcactcaaggagctcagtgggaaatcaggcaaggccttaagaagttgctttgtcttaacaatagctgcccggagcaacaggtggacgggtctggtactttcaatttattctacaaggaaaccggaaatgtgctccaggaggccccagtggcttctgaactgctccttctacattctttgcatattgtgatcgaaaagaaagaagggaagggaaggggaggggagggaagggaaggggaaggggaaggggaaggggaaggggaagggaaaggggaagggaaaggggaagcggaaggggagagagggagggagggagaaaaccgtctccatagaagaaggaaggaaggaaggaaggaaagaagggagggagggactgataaccaggttacagctatagttttggcttttaggtgtgataaaagaaatacgttataatttattgtaattgacaattgtaattgattgcctgactttcctgcgataatataaactttgaagaggaaattcagattccctgaggactcactgtctgccaggcacttggccaagcattggtttatctagagctctcaaaaacctatgaagagggtactgtggctaccacttccttgattcttcatctaagaaaactgctgttctcccaggaagtcgagcatgaactgtaagacctgcagctaggactaggtggtgtgggtgcaaacacatatcagatcaacccctaagactgtgttttctctactcagcaacactccctctaaggcctacacagatattaatattttccccagttcatttattttttattttttttgagacagagtctcactctggctcacccaggctggagtgcaatggcgcgatctcagctcactgcaagctacacctcccgggttcacaccattctcctgcctcagtctcccgagtaggtgggactacaggtgcccaccaccacgcccagctaattttttgtatttttagtagagacgggttttcactctgttagccaggatggttttgatctcctgacctcgtgattcgcctgcctcagcctcccaaagtgctgggattacaggcgtgagccaccgcgcccggctctctagttcattttttaccaaagaaaatatgcctaatgcaaaggaaaaacattgcaggaaatattaatttggtgcaaaagtaattgcggtttttactacagcaatagcaaaaaccgcaattacttttgcatcgacctaataacacaaggaagtggcatatgcaaattctctacaccatcatatttacatcttgacttcagagactcttgcaagtacattccctcttaactgattttaactcagccctaaggcaaagttacaactaattcttaatggtctctccgactatattatttccaggctttggatgtatttttctatcatattttactgataaaataataaacagcttatattaagggcatttagcatttgcaggtcaagaagaaaggcaagttaactctctgagctattaaaattttaattaaagaggcattaattttataaggataattcttgacatgaaaaattcttcatgatatatgattacacaaaaaggcaggttataaaagagtccataggaattatatgtaagcttatgtgtgtatacatcatatatataaataagaaatatataagtatataagaaacagaaatatttctttctatataatatatacataaatatatataagaaatatataaagaagtatatttctatatatataagaaatacataaaatgcaataaaatctacaataccttttctaaaaatcaaagcttattcactactattttgaaagatgattgatacagtacttctcttcggatataactcacaatttttgctgtaaggaatgtacactgcattatgagaaatgaacacatgacttttaagttaacataaaatcggaggatgaatgcccccataagaggggccttccctaagcacaagagtgatgcgggttcatcaccgtttccctctgtgccaggggacacaccctgccagcggcgcgcataagggcagcttcggggagactggagtctcagggtccctgggctcacaccaacctcctgctcttgacaagctccttcccatccacttccttaagcccaagaggagctttgttaagtcacatcactgcaattggttcatttaagttctgccatacatgtgcaggatgtgcaggtttgttccataggtaaatgtgtaccatgggggttggctgcacctgtgaacccatcacctaggtattaagccccgcatgcgttagctatttttcctaaaacctattttccccagttattaaaataactattttagctattttaacattagcttacatttcctttaattttaaaattttactattttaacattttgagaatatgttattatatcccatttttcattaacactttagtacaactaaacccataatgattctttagtgaagtttttgtggttgtttcctttttgattcctctaccctaacagaacattcactaaccccatattttcttaattttctttatgcttatgtacataagcatatctggacacatgttttacatgtgtctaaacacccaatcctataaaattatgaaagaaaagaaaaaacaatatcttaatgtttgcatgcaatacacaaattattagacaaagcagggaaacagtatgtgaatcatcctgaaacgatgtgagacctggtaaatctaactggtccctcactgaactggctcaactcttaggcatagtgacacatagtttagaataggggacaaagtttccaagaaagctcctctagggaaatatgggcctccaggagagtaggaaaatgtgattctcaaaataaacctgaagatgcttgttttcattccttcttatgacatcttcaactgtataaattatttcatccagaaagatactactactaataaaagggataccttcttttatttattttttaatcttatatgcaaagatagtgttactgggttgagtataatgaattttctttagtctcctaaatctgagttttctaattgatcacaagcactgcagggctggatagagctgcatcctgtgaagggttgaacctgagaataagcaggctacccagggtgaggtggatgttgtagaaatctgtgtctaattccgcctcacagtagcacggatttacctggggctctgtttcaaaatgtgggatggggtctctgttttgtgccattaactaagtgctgcaccagggtcacactcaatgagtcctccagattacacacttgagaatcttaggaagtagttaggaaaagaatgcaaagacaacagcacatttatgtgagatacaacagcctacaactcttgtgagaatattttaaaaagcacacacagtaagaatcagaccatattgcagtaaacagcaagaatccctggcaattttgttcagctgcttttttttaacttgaggtttttgagttttatgccattgtttcctgaagcttcaccatctttatgagtctgtcctctttgaaatattgttttttcctgttttaataacatgcatataaattctgtgtactagattgaatcttagttctgaaataaaacaaaacaaaacaaaacaaaatggaataatagaaaactaaagcaggcagacagctagggatgatccaggcacttctaatcaacatgacatgccaatgatggtccattaacctcctcctccatcccctgcttcatcagatatatttgaaaaagcagtttttaaaattaagtttgtttctatttttctaggaaaaggcaagaagtttaaaaaacaaaggctacattaatcctgaagagtttaaaatgcatcaacgaatttgtttaagctgtgcaacagacatggtatctagtggaccagagacagtatctgggatacagagaatgatgaataaatatgaggtgtttttaatttcttcttctcttccttgggataaattagaagaaagtggaacctacatacaaaaaaagcttttcatacttaaaagcccactcttttgagttcagttaatctctcattctgcaagaacaagttttgtgtccaatgcacagatgccacggcagattgggtgagtcttcctagctagcaaactcctctggtcgtctgcatagttatctacttaaagacacgaataattgtattgatggtgtctagcacatcatttgggatatagtaggtgctcaacaaatgtggcattgcatggcctagaaggctctagggggatggatacagaatgttctgatacacctaagacgtgaagacataattatgctgtccccctgtgtggaggtaactgggacaacatttgtggacattcattctcaatggttccttcagtcatgcaatttattttctgtcacacaaggaagagaaaagagtttgattaaagctgttgaatctttccttaagtccttgcagctgcatgagcaagaggctgacactaatatctgtcttcccatcgccattccggtcctcatagtttcttgtagatgtgcggatttcatgtattcctctgagaactgaatgagttaacgtgattgtttcagccatatttagcacagtgtgcaataaatatttcatgtatagcaaagcctcctggtgctagagacagtgggacaagatttcattcagctccggttgacacatttcagggtatcccctaaacccatcccccattttccatagcccctgactttacaagtgagcctctctctacgaacccattattatataataatcctatatagactatacgatcgacttgctaattttcaagctgaccagaccacccacattatcggcgaaagcaggaggttttgagcaagaaactagggacacctctgtgagcgattccattcctcctccctcctaaataagacacaatagaagcctgctttctggggagagtgagaacaaagtaactttgaggattttgttatgaatgtaagatgctctctaccctggaagagcgagaagcgatgataatccccatgtatttgttcagaagtattcacctacagcacatgggcccagagctatgcaaggtattgagcaaatgagatagtttgaaacttcgcatctgttagctgagcttattggtcagaggcatcatcccagggaagcgcagaactgctctggtctttcttcattcaccgcctttcccacatttcaatgtgatcttttcccttcagttgtagattgctttccatagggtatattagcaataggaattgactgctgctgcagatacaccaattcagataaacttgggctcatatcttttggcagcaaagccttatacaatatacatcatctaaaaggtgattttcttattgtcttgtccttcaacaggccaattatttctagggtgtgtcattaagggtatttattactttatgtagaaactacattaagacactcaatgttcttccacttaaaatcgcaatgctaaaatacttcttaatacacatggcactctgataaatttagagcttttaggttatatacattatttaaatttctgtaacagggtaaggactaaaacacactaaatatacatctacgaatgaaactgtcactgttggagatttttttggcaatgcaatcaatgagttaaatggaaataataaaaagtacaaaagtttatattcatcaaaatgaaaccagaatcattttctaaaaggccagatatggccttatcctaagacttttgaaaaatctcagagaagagaaaacatttctttaaaaaacaacctggaatttgaatttttttaacaacagacgtggttcaaaattgccatttccttatgagcaaacatttttgaaagtaaaacttgttaattaattgattaatgaaacataccctttttaaaaaaaagcaaaaatgcgagtgaatatgagtcactgaagtattcaaacgttgtgaaagtaatagatgttcagaaaagagtattcctgtgtttaaatacataaatagcatttggtctatggctgtatttcccatctgagaactgcagtagtcatggacagtcacagagggaaaatggggctgtttttaataaattccacctattacaaagaagcagtgggtacaaaagtcacaggaaatttcgtttaagaaggtgactacacagcgaaaacctgacgttatttcctactctactgtcaagtacagatgcttaaaaatatgttaaatcagtataaacataacagatttaaatattccatatgagaaacaaccagcttcttaaaattttagtgtgtatgtatagcaattctttcaatatttatcttaattacattcacatgatttaaaagaaacacatgcatgaatagtacatatgcatgcacacacagacacatgcacacacatgaacagacatgcacacacatgaacacacacatgcacacatacatacacacatgcacacacacatgcacacatgccacactcattgctgggaggtagaggagtagggaaatggggactgcttatgggcttagcgttttgttttggggtgatgaaacatctgggaactagacagaggtgatggttgcacaacatggtcatggcgaaagcgcccctgaactgcacactttagaacggttaactaggtcgagttttgatttgctttgttgttgttgctgttttttttttaatgaagtctcgctctgtcagtcaggctggagtgcagtggcgtgatcttggctcactgcaacctctgccttctggattcaagcaattctcctgcctcagccttctgagtagctgggattacaggtgtgcaccaccacacctggctaatttttttgtatttttagtagagaggggggtttcaccatgttggtcaggctggtctcgaactcctgacctcgtgatctgcccgcctcagcctcccaaagtgctgtgactataggcgtgagccaccatgcccagcaaactaggtctagttttatgccatctgattttcttttgagatggggtcttgctctgttgcccaggctggaagtgccgtgtcttggctcactgtagccttgacctcccaggctcaagggatcctcccttctcagcctcctaggtaggtggaactacgggcatgtacctaccatcgcagctggctaatttttgtagagactgagttttactatgctgcccaggctggtctcaaactcctggactcaagtgatctccctgcctcagcctcccaaagtgctgggactaaaagcatgagtcactatgcctggatgaattttatctcaagaataaaataaacactgaaagaaaggattgtccaatatcatgtgttggagcttcatccagtacttgtgaatcccaaagcagattttttttactcattaaaaactgcttccctttatatacacttatgtgaaattttacgtgcgttttaaaactaagaacaatgtataaaggccacttctagttagtgaagtccttttaaattggagacacttttccaaaatttgaagcaacaaatgggtgtggattgcctgtctgggttttctaaatcatcccccttgttgaaggtaaggttatattttcctccttcaatgcatttattgccaatatcctgtaaactgcagcagagggggctactgtctgcccctgtccggcatcactttcctgatcctattacaaaagaggagtgtcagggcactgaggcagaggcaaagcacagcccaactctcagcgtctcccagatgccaactggatctactttaaaaatattttttaggaagtcggcttccaattatttgagaaggatccatctttttttcatcaaaagcaagaataaagctgaattttcattaaaatgaaggaagcactcaaaggtctcccgggacgtatagatctaatcctctagtgtaaaatacaaagggaagctcttggttttgtttctaatgttttaaaagacgagcgtggctaaagttttaggacgtagactgagtgccacaatgaagacagctcccgtctcggcccttatgacttcaatctggcctggagttactcccctgcattgaagaaagcagacaaggctcgtgatgttatcgtcaacggttgttctgaaagtaagaaaacaggctgggtgcaatggctcactcctgtaatcccagcactttggtgaggtcaggaattcaagaccagcctgacccacatggtgaaaccccatccctactaaaaaaaaaaaaaagaaaaaaaattagctggacatattggcacaatcccagctacttgagaggttgaggcaggagattcacttgaaccctggaggcggaagttgcagtgagctgagatggcgccattgcactccagcctgggcaacagagcaaaactccatctcaaaaaaaaaaaaaaaaaaaaaaaaaagcaagaagaagaaagaaagtaagaaggaagaaagaaagtaagaaaacaacattcaaacaaccaaagaagtagcctaagtagttgacctcgtgtgtactgattgctgatggtcaatttgggtcattctacgagacatacaattaaagggaattgatggatgagcattttcagagtaacattgccttgcagtgggtggattctttccccacacacagaagtgtgcacctgctgttgttgctgctgtggtgaggacgcaggtgctgatgtcatgcggacaactcagccggggcagtggaaagttcccaaaatgagcaccagttccccacacgccatcgtgcccactcacgtgataccactgccatgttttacagaggaaaacggatgctttttgactaaaagactaaaacttttatgaaaaacaactcatatgtggtaaatgtagaaattaaagccatcaatgttttatctttatatggaaagtgagtatagctacatagaaacacacagtaaagtttttataggatcaattaattaaaaaatctaattcagaaaattatttatagacatctttatcattcaatttttaatttttttattttgggttagaaacatagaagcccttcctgataatgttcctttgtaatttaataaattaccatattaaaaccaatatctcttgaatatccataggttaaaaaaagaatagtgaaactctatttaaatctcagactttatacaaaaattaacacaaaatggatcacagactttaaaatatatcaaatgcaaagtgatagacaaaatagaggaacacttcaagatctaggtcttggcagagttcttagacttgacatcaataccatgacccagaaaaagaaaagacgatgaatttaaaacttgtgctgctcaaaggaccctgtgaagaggatgaaagtcaaacgagagactgggaaaaattctgcgaatcatatacctgacaaatgactattacacagaataaagaactcttgaaactcagtcttaaaaagcaaacaaaaaaatccaaacaattccattaggatgtgagcaaaaggcatgaacagacatttcactgaagagtacagatgggaataatcaccagataaggtactcacgtcgttagccatcaggaaattgcaagtgaacaccacagaaagctatcaccacacatctatcaagaaagctaaaataagacagagtgaccgcaccgaatgctggacaggatgtagagaaacttcatcgcccacacatgttgggtagggatgacaaatagtaccgccatgctggaaaaatgcttggcagtttcttataagactaaacttgcaaataccgtatgtgccagtaccatttacactcttgggcatttttcccagaaaaatgaaaacttataaccacacaaaatcgtgttcataacagctcgtagcagcattgtttgtgacagcaaagtctggaatcaacccagacgtccttcaatgggtaaatggtgaaaaaaactgttacatctgtaccatgaaatgctactccacaggaaaaagggactgaattattgacacaggccacaacttggatgaatctccggaaaattatgttgaataaaaaaggcccatctcagaaggctgcacaccacatgatttcattcatttatataacattcttgaagggagaaggtcagagaagtggagaccaggttaatggataccaggaattaagaatgaggttgggatgcgtgggtgtgtttataagcggagtaaggcggattctagtgataatggacattctccatcttgaccacatcaatgtccatatgctggttggtctaataccctctaagtttgcaagattctaccactgggtgagagtgggtaggggacaaaaaggacctctctgtattatacctagtgcctgcctgggaatctacagttatctcaaaatgaaacattttattatgaatgtatttactcattcaacagagaaaaggaggactttaatgggaaaaaagagagagaattgatgacattttatcctaacaaaaaaataacatactgaacatatgacatattttacatattccatataaacacgtaatttagtaatttaccatgttaaaacataatgttaacatatttgagctgaaatattttttaaaatgagagactacacattagatcagcttcttatcaggataatcacccacaagacctccaatgttagattttcactgagataatgctgttattaagtaaagaaatgaagcatattgctaatgcacgcacacacgattgtgaggagctgagggcagggtgaggcatgtttgactctggaagtatcaggcctgtgcagtaaactcagctctgctccgtatggagtcctgcggcctccacaaagagtcaccgctagctctcttgagctccagagcatattttgctaggccctgctccatacttcctaaaacaccactgcacagttgtcagtcataagagttcaactgccaaaaagattgaattatgctagaatgagaacacagcagtgttttgcatctcctcttatttctcgtgattgtgaaactaaagtgaaagagatcatttcaaccctaattctgcacatcagatatttcccatgtaattattaaaggaaaaaacaaacacaaatacaatgaaagaagaagaaaagttgtagttcaggtgaaatcagtaaccatgttcctctctctgtttttatttttggagggagaccatgtttggatacaatgaaagctgtgattgaagcaagctcacccctgtgcacctggggctgaccaatgtccctgggcttcttaagctggggtggttccctcctctggtcaggggctggggctcggcggaggcaggggcactggcttcaccccctcactctggtttcctttgcattctgcactgtggttagttgagtgaactgggtttcatcagtgtgttggtcaaaacccaagcattctgatcctgacagtgactagtattttagggggaaacagaggtaggagtctttacttagcctttgagcttacgccaagacctccaatttagacctgagccagaactctgcagctgagtagccaacttctatacaacttctaatcattttttaaatgacttgggttcccactctgctatcagcttatttgaagatagctcccgtgggagccctaggataagagaggttcttgtcagagaaagagacattgataagttcctggcttcaatttcatcttaataccataaaaaatacttgcccttcacactaaagtacaatacaccaccaataagagtgatgttgtaatggaaagtaattgaaatgaaatcttaaacatcatgagctcaaacatctagaaatgcaaaaaagaacacaattttcttggaaactcagatttagcagaggtctctgtgactacgtttaaagaaatgaatcaaaaaataaataattgaaaatttaaaacagtaagaacttcgtaaagacagtcataaaattagaagcataatggcccccaaatgctaactatacagggtagaaataaatgtgtaaatacatgaataaaaagagaaatagaagatgagttatctttaagggagataattctagattttcgtaattgaacatctggccacgagacaggaaaaagccatggagagctttgtgcttactctcagaaatgctttcacacctgaatggtgagagtttgcagaactctttatgcattacccttgattcatggagacaggctcttgatggtgttactgggcagcctagaacactctcagagcaaagggctcattcctggatgctgttcctacctcgacacgtgggcagagggctactccactggccgttgctccgacactgggctcgagacacgccctgcagcaaatagcccgtgttgcaggtgaaattcacgacatcattcaggttgaactcactgccattagtgaatccgtgggcagggtttccagggtgaccacatgtgatggctgtagagagacaggtcaacgtcattgttaaatattgaacaggtcatcactttcccttgggattattaataagaaacatgcaggcatgctaacggtatggactgaaggttttccactaaccaggcagcttacagatggtatttatattcagaagggaatattgggagctacaaccacaggctgacactacaggcttttaatataattgtggaaaataacaaacacctgccaaacacgctttctttaccatcataattattatttctctcttgaatcatgacagaataccaaatgatttaaaaacgaagcagtgaaaaacaagagatgctaaaaattcttgtattaatcatgagttttgaacattttctccatacacaccagctgactctgtgaaaccctccttttgagacagtatgggatttgtctgatactttttaatgtccatgtataaattattgcaatatcaatttacacatcatgaaattagcaaaataactaagcacactcagctcctatttttgttgagaatctctgtcatatgatcctttgaaatgcagtgaactgtcaatatgtcatgccccagataacagcaagacagatcagggagagatatccatcattcaccctttcaacagaaacacactacagtcataaaactggtgttttcttcctcatttatcttgtcaacaatttttttcctataagtaaagcttttacccgtgaactttgtacatttttcacatcactattacagataatctttgtcactgttttatccacatttcttttgtctacttcataggaaaatatacaatatttctaaaaacaattggtttaagggaaattgggcaataaagtgagagtacattgttcgaaaaatagtcaatatttacaatatttatcgctgaagttatacagctcaaggttgatcattcattacatgtaattttacctctttcttttttttcccttttttttttttttttttgagatagagtcttggtctgtcacccaggctggggtgcagcggcacgatctctgctcactgcaacctccatctccagggttcaagcaattctcctgcttcagcccctcctagtagctgggattacagatgtatgccaccatgccaggctaattattgtatttttagtagaaatggggttttgccatcggccaggctcgtcttgaactcctgacctcaggtgatccacctgcctcagcctcccaaagtgctgggattacaggcgtgagccaccacgcctggccaattttacctctttcaagtaaaagaaagaatgcttacaaaactccctatattcttgacgaagcaatgacaaaaatgtatgcaacacggatgaggcagggagtgccgctgtttctaggactgcaaagctgcccagcagacccagactctgcacctccaccctcctactatcagcttttctctccacccagtttatcctgtgataaaatcaaggaggaggaatccatgacaccacttggccagggatccatttacaatgaattgataagcaaattaaatgtggagtcaggaaaaggagtttgaaggaaacaaaacgggaaggagatcaaaaaaggaaagcgtgaacatggcacctctcctgttctctttctttgtataggcaaaactgaaagtttgctgttcccttttacagtgaagattaaacaggtgtatattgtgacctaataacaaaagacaatgtggcaaaaggaagcatcgatgaattcgtccacaaagagtgcacttacggacacagacaggcgtttgtccagaccacttgtggtcttgcaggcatatcctcacggaagttcccacaagccggaaaccaggattgcactggtaaaccaccgtgtctctgtaactgaagccatctccactaatgtgaccgttcacaatcgggtctggggaaccgcagtggccagctaaaaatgttaaaccaattttaaaatttagagtgtctgtcatttataaaagtagtacattcacaacttttattatcaagtcaataacagtattgaaggcgcaacatattgaaatctttatcattacatatatatgtatacttttaaatatagtttttcttttttttattattttttttcagaaatcctggaaaaaataagtaatatttctaatatgaaatggtttgtattttcctagttgtgattttcccatctatccatttcacttattttgcttacctgtattcagttatttaccttgttatactattttcaaaacaaagcaaaaagtaaagaaggaattcttggaattaacatgaacagggcttcttaacctattgattatgggtagtaaggagatcggtgaggggggcttccagtcagatagactagataatcaaattacctgtgaaattccaaatggaaagacagggatcagagaataagttcaatttcaattatgaaaatctgagttatgggtgagctgatgtctgagtaaaaatggcctggaatcagttgaaaagagaagtctagagttccagggacagatgtgctgaagttagcgtggacttgggacaacaggagcatgcacagctgacagctgaaactaaaggtggcagggcttactcaggtgcacagtgaaagaacaggaaggagcgcgagatcgcgacaggcgtctttacttaaggggagacagaatgtccatgtagatagtaaaacaattgacaaacatggcattgaaagagctttagtaacagagcttccacatggagacagaccctctgacattattccactcactcccaccattttttttctttttttttttggcagggtcttgctctgtcactcaagctggaatgcagtggcaccatcacggctcaccgtagcctcaatcccttgggctcaagtcatcttttggcctcagcctcctgaggagatgggactacgccaccatggtacatgctgccatgcctgagtaatttttttattattattatttttagtagagatggggtctcattatgttgttcaggctggtcttcaactcctgagcttaagcaatcctcctgccttggcctcccaaagtgctgggatgacaggtgtgagccaccacaacattttgttaccttctcttccatctccctcttctgcctctttactgctctcacttttccttctttcctttcctccaacttctccttttctctctctcccttcctcgcatatatggaaagggtattcttattaaattaacaaaatatacaggctgaagagtaacttacatgaattggacctgtgttacacatgggttttggagtcacaagaagaggaaaaacattcaccatgagttcctaaataatcatctttgtcactctcctatagttgcatcaacatttctttttgcttaattcacaggaaaataaagaatatattagaaaaacaattgctttaagaggaattttgcaataaagtgagagtacccgtattctaaaaataataatcaatatttatctttgaagttatagaaagaaacttttcgtaggaaaacagctacagaagccttcagtccatgcaaaatatcaaggcggagactttccctgcccacttatttccccaacagggaacacaaccaatgattctccatacaagttcctgcacacccagatttgagaaattacaaaattgttgtcatactcctttgggattaagtatatccttctagggagatttaaaatcataatctatatttctgcttaaaacaaagtttagaaacattgtgttctcctattttggagaacaaacttattatcaggaaggtaacattgcagaggagagagacagaagagaatctgatctctgcctcaactcgtagaagagattagaccacaaaaagccaggctagatttggctaatttttgtgcattggcaggtattccagtcaatcggatcaataagtcagttctggtgatttgtcccaatcactcccacatatgagacttgatacaagcggagaacgtcgatgagggtgaatgttctccatattgtgaagagagaccccctgaaggcacaagtgttatcacaggcacagaggacattgtctctgaaggttcccctttccagacgctgtcctttgcacaacgtgctctgtcgtgcatgggggagatggagccatcgttccaaccctagagacagggagacgaggactggtgagagccagaagagcccatcagcccagcacaagagatcccagccatttctgaggcgaggcatagaatagctagtttctagaaacacacaagaaaatgacaccagcaattccttttggaattacttctgaagcctggaaccactccaagaggaggggatgtgggaccaaaggcaatagtgatgtgaaaaggggtgcattttaacagagctcctctcattttagggaatctgttcaggtctcattcttgacttagacaaacaggactccttttaaaccttaatatttttctgaactgagttttttgtaagtgcacatagtttgaagttgcactcttctttgggaacctggcaaacaaggacttgtaatggtcaaggaagcatctgtgtactctagaaatcaggcagcaagcctgacagccatgactgtaaataaagattcccaacagcaactcctctctgacacatggtcatttcggttctctgaggaattggcaccaaatgcctaaagaaaacagaggatgtccttcaaaaacatttcattttacctccttgcctgaagaaaaaaaagttatgtatcagcaggattgcctagtatctaagcttcctaatacagaacaattatttcttcattgtggcttcctattttgaaacaatgagatagcaatctgtttttcacctgttatcactttccagccatccgttaattctgttttaaaacattcaaaatctttgaccaattatagtctattacaaatagaggataaccacacaatttcactcacagaatactctttaacccaaatcttaatgatattgtgtcaatatgttgaggaagggaaaattgcattaggaggaatttgaactcaatgaattttgagctctattttaaatttaagattctattagtctatgatagtattattctatatgctttgtatgtgagttaccttttcttttaatatctctgatgtagtcttggttttgagtcatctacacaaaacctagaaagcctctctgtcttccctcaggatgaaatgtaatcaagttcatgcttctctgctgtgtctctaccatatcagtcacacactgagtacttgttgaaatgaacagaaacagaataacctcaccactgggcagtcatgtcctttacattgtctcctatgtcaccttcatgtatttgacaataattcatttatttgacaataatttcatgatgatttgttgtgggttgcaatgttcttggggctggggattaaacaaggaataagacacaatcgcagagggtaaacgcagaggagcagctgtcacgtgcagagtcctgagggtgtgcggacctagcaggctgggaacgagtggaaggaacactcagccatgctgaggaccaggactcctggtgaaagaggtggcatttaaagtctgaaggatgagcgcttgttagccaggaaaaggtgatggcaagacattctagccacagaaattagaaatgttatatatttttaaagcatctgttaaaatatgaagactatgatgtcaaatgacccagttatacatttgctaggagggtgaccatttgcatcctgtccagcttagtacatagtaggtgtcagccccactgcgtgactctgccactatttgaagatagttgctacaactccactgagtatgcacagtagcaaaggaggataagcaactctattcactgaattttttttttaaagaaatgaacgtggggtgagggcagccctgcacacttcaaaaccaaatatcatctagtgataataaaatactgaaattcctcagtggaccttacactatgatgccagagcccagaggctgtgatttgtcttgattttgcagactttgtttatttattattcattgacgtttagcttcagtttaaacaaaaactgcccaatgtctccaacaggcaattgtgtagcaacaacagtcacagctcggacatcatgaagcctggatttcttgagaagtgtgtgtcagaaattgtcctattaaagtgtggaaggaaaaccttggcaagaaagcaagtgacccactttactcttaaatcaatcttctgcgtgaatttattagtctactagtaatctgaacccagcaggactgagaagcaaatggttgaagaattaggaaagaatgctatgcaactgtaaattcatatgatttttaatccaatgtatatagatagacaatgtaaatatatcctcatggaattgcagaatttgcttttagctcaagcacgaattaacaattcaattactaccacacttcatgaattttacattttaattcttcattttctccatgctgagaacaggtatgactgtggacagggtaattcaccaaccacttaaaatggttgagagaaccagtaacggaaccaagaatgaaatggtctgctccagtgactccgttttacacactgttctacaaaatatgtcattggaataagaataccgtggccaggcgcagtggctcatgcctgtactcccagcactttgggatgctgaggtaggtggatcacctgaggtcaggagttcgagaccagcctggccaacatggtgaaagcccatctctactaaaaatacaaaaattagctgagcaaggtggcacatgcctgtagtcccagctgctcgggaggctgaggcagaggaattgcttgaacccgggaggcagaggttgcagtgagccgagattgcaccactgcactccagcctggacgacagagcaagactctgtctcaaaagataataaaaacaataacaataatacggtgaaacttcagaaccattgaggtgttatacgtatggactgtgcagtaccctgggtgggacccaggaatttgaacgtctttcctgagttacaaagagtttccgtaccataagctttgaaaatcactagcttttcagtctactctattctgtgtctgatgaaagctttgttactccaaggaggaactggtaccattccttctgaaactattccaattaatagaaaaagacggaatcctccctaactcattttatgaggccagcatcatcctgataccaaagctgggcagaaacacaaccaaaaaagagaattttagaccaatatccttgatgaacattgatgcaaaaatcctcaataaaatactggcaaaatgaatccagcaacacatcaaaaagcttatccaccatgatcaagtgggcttcatccctgggatgcaaggctggttcaattacacaaatcaataaatgtaatccagcatataaacagagccaaagacaaaaaccacatgattatctcgatagatgcagaaaaggcctttgacaaaattcaacaacgcttcatgctaaaaactctcaataaattaggtattgatgggatgtatctcaaaataataagagctatctatgacaaacccacagccaatatcatactgaatgggcaaaaactggaagcattccctttgaaaacgggcacaagacagggatgccctctctcaccactcctattcaacatagtgtcggaagttctggccagggcaattaggcaggagaaggaaataaagggtattcaattaggaaaagaggaagtcaaattgcccctgttggcagacgacatgattgtatacctagaaaaccccattgtctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaatttacaagggatgtgaaggacctcttcaaggagaactacaaaccactgctcaaggaaataaaagaggatacaaacaaacggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgaatcaccaagtcaatcctaagccaaaagaacaaagctggaggtatcacactacctgacttcaaactatactacaaggctacagtaaccaaaacagcatggtactggtaccaaagcagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacagcttacacaaaaatcaattcaagatggattaaagacttaaacgttagacctaaaaccataaaaaccctagaagaaaacctaggcattaccattcaggacataggcatgggcaaagacttcatgtctaaaacaccaaaagcaatggcaacaaaagacaaaattgacaaatgggatctaattaaactaaagagcttctgcacagcaaaagaaactaccatcagagtgaacgggcaacctacagaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactacactgttggtgggactgtaaactagttcaaccattgtggaagtcagtgtggcgattcctcagggatctagaagtagaaataccatttgacccagccatcccattactgggtatatacccaaaggactataaatcatgctgctataaagacacatgcacacgtatgtttattgcggcattattcacaatagcaaagacttggaagcaacccaaatgtccaacgatgatagactggattaagaaaatgtggcacatatacaccatggaatactatgcagccataaaaaatgatgagttcgtgtccttcgtagggacatggatgaaattggaaatcatcattctcagtaaactatcgcaagaacaaaaaaccaaacaccgcatattctcactcataggtgggaactgaacagtgagatcacatggacacaggaaggggaacatcacactctggggaccgctgtggggtggggggaggggggagggatagcatcgggagatatacctaatgctagatgacgagttagtgggtgcagtgcaccagcatggcacatgtatacatatgtaaccaacctgcacaatgtgcacatgtaccctaaaacttaaagtataataataaaagaaaaaaaacttaaaaaaagaaagctttgttactgtttgtaattataaactgctattatattttgcttaaaatgtctcaaatagaaaaaggggagttattttaacaatctttctctaaaattggatttgaaataaataaaagctaccaaacatttgaacaaagcacagagactggtagcaagatggatggagtattgagtccattttcatagcaaagaaatagagtatgtcgcaagcaaaatgtcaggaagaaggctcgagagggaggaaaggcctaatttcttgattggtcaaggtttccctgcaaactacatttgtgccagagcagtcaggagggcagaaagtggctgaattccctttgtgaggtcagttgagtctgaggttcattagggacacacacagggaaaaccactcactccattatcacccgcacagtgtggcccacccttagaccaggggaggctgcacacctgcagtttatagaattcaacacgggagagcaggggcctccgcaaggccagcctctcaaagcctttgtttctagagttccatgtaaattccactgcacaggtcttttagtgtaagttataaaacaccttgctgagagaacaaaaggttgttttgtttgttcgtttccagtagagtgaacactcagaaactggctcctgaacgaatccggttccttcagaactccagcatgcccccctgggtgacctatgttttctggaaagcggttctacaaagctgtgttttagaggaggaatcttactggcagacaggatttggctttgtttagctatccgtactgtttctgcaacacttgcttttgctactgaaaggagttatgcggtttgcaacctaaaaccaccacactgattgtcagtggtgactttctgagtgactgacgcaaggtggaccctcaaagagacctgaggtacttgttggccgatttaccttcacatcataacgcacgcagagtgaacacctcacatgcaagtacagcaaggtgagagtctccgacaagtacctagacctgtgtgattttggaaatgggttccctgatttggaaatgtaataaagttccactgtttcacttctcccgcagaaaccccatataccagtgggaatgttgccacaatgtctcccatgacagcggacagacctggagccgtgcattctttggggaggaatcggctccttccattggagctgtaggatctctcccctctcaccaggtctcccacacacgcacttttgcccctagaggggcctacttgaagctcacgtcttcagtgtgcaggtttgtagcaggacaaatactaaatattggtccggggattagaacggaatccatttttagaaaatctataaaccaaatattcaacctcagtatttgctttgtgattactggtacttattgctgaaaataaaatacattacaaatatcctgggcctgtaggggaatacaatatgctttattctatccattctatgcaataacatggtctttggctaagtcagagttatttgggcagtagattccaaagccaatttgcaaacttttcttcagtattaacaaatggtcataaaatgtcaggtgcatcagattcacttataggcaggaaaaactattattagcagtacacttcaacggacatattgaagtctcttgatctccatatgctaaagaaacacatttgaatattgataactgaggtgtgttttttttgcctccaagtgcaatctctaggggcaatgctgaccgacttagcccatgcatagatatgcatatggtatcacagagagtgtgtggaatttgtccaacatggaggtattgggcttgcagagcatacaacactctgtgctgtttgtgacagcatcaaacacgggcccgagtcctctgccacaaatccatttgatcagatctctgcttcacacatcttagtgaatgacagcttttttaaaccagtttggtttgaagaaaacctcaaaccagggccatcatttggactgtctttggggctttcagcattctttttatctattcctgtctcaatgtagttcctgaatataccccatttccaccttcttccctgggcctatcctgcctcattgtcctcaagctttgtctgcagtcttgcctgccggtgtcacgtctttctgtccctcaaacttcagtccaaatccaccgcaggtgcgcatcttccacaaaccccaaaggaagagctgcccattcatacaggaggcaaagatctccctgacttcaggtttctcctacaataggagagcctatcttcggtgttgcctgtttaaaacacccagactcctactcttctactgtgttttgttttagatgtagcaggtggcattctaatttttcgtacctatgcacttcccctattggactgtgagttctgagtgcagcaccatgccttgtgcatgtgcatcaggactcagctcaaaacctgccctagagcgggtgtcagagttatcagatcttttccaccatctcgtggccctatcagtccaggctcttatgaccaggcggccgtcgagagttcgaccccagcacctgcttgtttcaggcaagtccgacttccttgggccgcactccgcatctatgctgttgccaccagggttgcagctcttgatttctggaatggctttaccccatgcctgcttgctggaattccacccagaatcagcacggcttcccccacatctactcttctgtcagcctctaggttgctcccactctcacctggatttctcaagtaatgtgcctatatttcccttttgccattattctattcccaactttttttttttttttgagatgaaattttgctctgtcactcaggctggagtgtaatggcatgatctcggctcactgcaacctccacctcccgggttcacgcgattctcctgcctcagcttcccaagtagctgggattactggtgcccaccattatgtccagtagtagagatgaggtttcactatgttggccaggctggtctggaactcctgacctcgtgatctgcccacctcggcctcccaaagtgctgggattacaggcgtgagccaccgcgccctgcctattctcaactttttattaaagctacttggtatttaccttatttactccttagagtatagatttcataaaagaagaaccaatcttattaacctctgaatgctgcaccatagttcttgaggaacaagaaaaatatcattaaatactattcagaaatatgacagaaaaacccaccgctgagaagtttgctagttattccccagccactgacaatgcatttggaaaatctgagaactggtatagggagttttcctgactaacatacagaacatattttacacttaagacggtatggcaaagatgggggtggggcaggggaggcagtgctaatctttctgctctgctgtgatataagcattatcataatcagttgttttattaaatattttatgtggatctttccaaaatacaaggcaattgaagaatatatttaaacttgactatctaagaactatgaataactacagtctaaaaacagtattttgaatcatgtcatctagctattttagccacataaataaccattatattgcatttacagaacaattcatctcctcatggttataatagcgcaataaatgcaaacttatttctaacaatagcaaaacaatctaataaaaaatgataatgtcctctatgtgggaaataactcaagctaccactaatatcttgaatactagagattgaagaggtaacatagtggagagaggatgggttcttatgtgctgaaaagtctaaatgatgtaaatgttttcaaaatatgaatgtgggattctgtgacaggaaacctagaccacaaactataacctcttcctagtttgtgtgttctctgttggtttaagcaaactaccgcagagaagataaacaggagaaaataattaagggatcatgtagatcacaaacttcctgggtggattagcaagtgcctgagagagtggataccaggtcagcattctcagtgcttaattctgtggcctggggagaggtgtagcattacacagtacagttggtaaattagagcaggtccttggcaatttacagaactctgaactctgggagatcccagtaataacgcaggagtgatcgtgttgatgaaggtgggctaaattttatactaatgtactcggatgcacctgtgcattactttgctcaaaatctatttacaatgatatttacatgcacactccaatttctcacaaggttcttcttagaatccagaccagggacctaaaacacagcatggattgagttcttgaatattaggtgtagaaaatcatcttttctttccttaaatacagctgtcctatagttgacattctcaagactcagtctgtcaacgctcatccattcctgtgtttggccactccagctgcaatactcaaaaaggattccagcatattctcccatgttggaagtcactggaaacaactagcatgccagcagtatgagtcatgttgcgatgaaactgaagcacaatctcaggaaacagtattctttctagtagccccaaaaataaactacaaaatatctcagccacaattcagggaaaaaaaatgcttttgtcaaaaaatcttgcaccaggatggaaaacatattggacctaaggtatacagcccaagggaagttaatctaaagaaccaaagtggaccctgcttttgcataaagtcttagttgtcttgtttggaagatccacctgtttaaaaatacacaaatgaaaggggatgtggggattttttatactgattccaaaagctctctttctctgtacacagtgcctgcttcatatgattggctgtgtccccacccaaatctcaccttaaattgtaataatccccacctgtcaaggatggagacaggaagagataattgaatcatgggggcgggagtttctgttctcatggtagtaaataagtctcacaagatccaatggtctcataaaggggagttcccctgcacacgctctcttgcctgtcaccatgtaagatgtgcctttgcttctcctttaccttccaccatgattgtgaagcctccccagccaggtggaactgtgagtgcattaaactcctttcctttataaattacccaggctcaggtatgtctttcttagcagcgtgagaacagaaaaatacactgctattacaaacccatgaatggaagtatgcacatatgatgtctgcatcaaccctgggccttgtcttggcagatatatgcaattaattttatgtttgtttcttttttcccacccacatgttcctgattaagatgtacagatgtcagcatggtcttcatgctgactctacccgtcagggctggcactgatatggaaaacaacttcccacaactagtttcttccatctttcacctgatagcattttaaatatttgaaaatagttatgaatgactactttacttttctctctgtcagagtaatatcaaaaattttccagcctggtgtggtgcctcacgcctgtaatcccagcactttgggaggccaaggcgggcagatcacccaaggtcaggagttccagaccagcctggccaacatggtaaaaccccgtctccactaaaaatgcaaaaaattagccaggtgtggtggtgggtgcctgtaatcccagctactcaggagggtgaggcaggacaattgcttgaacccaggaggtggaggttgcagtgagctgagatcacaccactgcactcagcctgggcaactgagactccatctcagaaaaaaaaaaaaaaaattccaaacagtcctcaaagatcataggtaccagatccatcaccacaaatgcatagcaattcctcaagagcccacttaaactattaaaaaactgaagtcatgattctggatatgggattcctgggcgaacagaggatgggaagaaccttattaataagactcagcctgagcattgcatggcagcacttgtcacatatgagcctgctcttacccaaaactcccaagttctctgcctctacactatgaactcagaatttcttctcctcatatacattgcaattattttatttctactctgagaaaaattttacattaatttctattatattattttgtttgtcctatcgtgagaatttgagatcctgaatccatcatccaatattattttcactctttcaactatgccctgatcgaagataggaataaaatttttgattcagaaacatttctgaatagtacttatgaatatccatctcataacaatattaaacaaaaaaaaatggatgcaaactcacatggtgtcttggaaactatattagttctatgtgaaaatacatttccaaagttacttatgaagaatatgcttgggtatctgctctatatatcatcaagtcaatttatggtttttgatagctagcttcttttcctgcttttcctgttgtgagaacaatcacactggatatgagtttcactctaggattcttcctttccataatatctcaccaagaacactgccagtaactcagcagtgtgatttttagtcccctcagctgattcggatgaaattctcctgggcaggagacacaacttcattgagaactctgaagttctcttttataagctccttatctttggggcgtgccagtttctgattttaaaaacgtcccgcctataatcccagcactttgggaacctaaggcaggaggattgcttgagcccaggagttcgtgaccagcctgggcaatttaggaagaccctgtacctacaaaacaaattgtaaatagttagctgggcatgctgctgtgcactgtggtccaagctacttaggaggctgaggtgggaggagcacttgagtccaggaggtcgaggtagcagtgagctgttgttgcaccactgcactccagcctgggtaacacagtgagaccctgtctcaaacataattaaataaataaataaaaacctcctaacctgtgtattccataataaagcttcttcatgatgtgcttattacacaccgtatgtgtgtaacgaaaatctcatgtgccccacaaatataaacacctaatatgtatccataaaaattaaaattaaaaaagtttttaaaagcttcttaatgaaaaaaaaaaacagaactgaataagcatccattttcataccagtttcaagaatgaatttggttcttgtttcaagcataactgaggcagctctcttggggttcctcacccttcacatcatttccagtttgtggtggatttgtccctccggacactctctttaaaaacgcattgcattctcttcaacatgtcctgggacagttgctttgcttgaaaattgaatttcttgcagaaaatctggtatagctgtctctgtttgtttgggtaatttcccattttttcctgattggatgatttgctttttaaagtcatagttttgggggttgttttgttttgtcaaggggtcatcatttttagagttgaagccatgattatatagacacagttttcagaatatatatatatattttgattcagaatcacttctgaatagtacttatgaatacccatctcataacaatagtaaacaaaaaaaaggacccaaactcacatggcgtcttgtgaaattatatatatatatatctccttaccaactgcatctttagtaacagtcatttccccactacaagtatctcgtttaccccggcatggtccagatgagcctgaaggttactcaaggacatttaacttggtggaaacccaaagtgattttcaaaagagccgtaaccatggaaacagggaaagggttaattcaaataacaagttaagagatggaagaaaagcaatagcaagactgataggcgagagcgtgtcagcatcctggcagtacaggatgaaggacacaattagccaggcagaactaaggcacaaagacccttgcacctgccccttgcatgcgcctccagaggggactaatccaggttccagagctcatttcacttctagttaacacaacacactcctccttattggtctgaattagcatgatagtattcttggttttatgatgttgggcaaattctgtacttctctatgctttctttcttatctgcaggtcgaaggaataagcacttcctgtacgttctaatcagataaatctcacaaatgccatgtgcattttaaatcatcaaaaaatatcatcatttataacctgcctccaaatatggcacctagttgatatttggattatggaggtatccatttgctactctactaaatatttgtgtagatttaggattgcagcctctgttcccttcatctatcttagagtcatacaatctactcaagcaatatcatctctgttctcctacctttttactcactcatccctattttcctctgagtctcacatgcaactttatggtttcttgtggacatatgttcttgctgagtttcacatgctgtcgccccccagcaaaagatgtctttgataaaggaatatgcttcattaccatgcttcacacgttatgaatctcaaccctttccgttacagtggtagctgcaaaaactatatttattaactttcaaaatgtttgtgctaaatgaattactcatggtttacccattagtatgtacatatgtatgtgtcatttctaatctttttctattttttccctttaaatactctatgtctcttccaattttattattccttatatgctgtatccaatatctacaacacaaatgttttatatattataacctgggcatttttcttcttccttattttcctctgagcaaatggactcatttctgagtgaatcatctttcaaaagctgctaagatgtattgcatagcactgagacatgtttgggggcatctccaggcagccaactattcaacatttatctcatcctttctactccaaaaccctaactttcagacacaagaataacacaagatagataaaggcttatcagggatcaataatccccaagctgacccatcatttaacagttatgtaaactgaatgtatcacttaatctcccaaagcaccaacgaaggcctttcctgcatcctgtattggtaatgaccaaaaggatgagattacggatgtttgtaagcagtagagcagcaatcaactgtaagttgctgttaattttcatgtttacaattactaatagagatgtggtacatactgtcagacgtgagtgtctcggaccacctagctccctcccagtggaactgggctccttcagaggaccaagctccaggcagaagagcttgtccatatcaaagctgcctaaaggagagtgctgttccatagccaatttcagaaggatatttaggaatgcatggaaactcctagaaggacttgtgactctctacatgaagaagcatacatagtccaaggaaatgtcatcgtctactgaaaactgtaatgaggacacccaacgacagacacatatgcacacactcatatatataattgtgttcaataatatataatgcactaaatatattacataatacactagacagagtgagaaagagtgtgagaaaccaagcagcattcctgtaagtcctgcagtgatttaaaataagtagataatgtttcacagacaagtgtgagaacctccttttggtggttggtttttctctagggttactactgtcctttcatcttgtttcttcaaattctcccaaatgaaaagaagaacaggttttgctatttgaagtttactgggcctggcttagttcctgaagtgatctttgcccatgcagattcagaagcttaaagctcccagtttctatggctttgagtgatttaaaaaaaaaaaaaaaaaaaaaaaaaaaaaggaagaacgcgtggagaaggttcagaagaaccaaaggcaagtaaggtattttacaaatcaccagcagacctactaagatcactctttactaatacttgttctttaaactgcttattcaagatttttcatacacttattcaaagaattttccaatggaaacatttttcaatccattttttaaattatgcagaatattttaagtttttgaaaaaagaagactacattattgtagacatatagcattttaaataattcactgtacttatgtcaatttggatgaatataacttcaattcattgacataattttaaaatttttaaaaacataaaatgtacaatatttttgaaattcatttttgtgtgtcctaaaaccatgatggcatttgagtgcaggtacattctcagcactcttgcaagattgcctttatggcacttaaggcaatatatgactttcattcattgctcggattaaaaacaaatccctgtagatactcaaagaaaaaatcacactgggaggtgcagcatttccaccccaggtaggatttaaggcattatagcaagaagtcatatgtgttacacagctgtaatctatttctaaggtttatctgcattaagtaagtgccagaacacagatgaatttacccagacatcgagtttcgctgccgctccagagcccatttgccaagcactctctgacatgagaccccacaagcgtgtagccggtgttgcacgtaaatatagctgtggccccataaactgtcaacgttccaatcttgttgccatttgggggaaaggaaaggcttccacacgagataactagaaggaaaaacaataaaatgaacatcaattcagttatgcagattactcctgtgctccaaacaaacaaacaaaaacaaacaaaaaaaaccaaaaaactatttttagtcttaattttcactaagaacatggttgagagtgtctgcttagggctggatagaccagtcacttaagaagcttaattttccatctttatgctcctgaaacaaaaacctaaaagcttaacgtggattccaaaacattctagattcctccaattacccattaacttttgttgttgttgttggcatggagtcttactctgttgaccaggttggagtgcagtggcgctatcctggctcactgctacctctacctccccggttcaagtgattctcctccctcagcctcccgagtagctgcgattaaaggcgcctgccaccatgtcccgctaatttttgtatttttagtagagacagtgttttgccatgttggccagactgatctcaaactcctgacctcaagtgatcctcccaccccagcctcccaaattgctgggattacaggcgtgagccactgtgcctcgacccattaatgttatttttattaccatcctgacaggtatagctgaaccattcttgaaaaaatacacagtatacaaagtataaatgcagaagcgtgtcaatcaaataaattgtctatctctctacctttctttccatatcaatcccaagaattacatagtagtaattaccagaagcctcaggagcctatcaggaaataaggaataccaattttcttcaccaaagcccatcagctgggacaaagtagtgtggtattaaaatctaggacttcggaatgcaatagcagtgctcagtttatttgtttttttagttacttgcataatttgttgggctcatgagctctgtaagaatgctgactacacagggcatttggaggctttccacaaactaaaacgtgcatacaaactagaccttaactgggtgtcgatggggtgaccctatgccccatgtttacacctgccgtcttagcacagttattgatcgtgtccattttcactcatgaaagtactccagtttggcaaacaagttaatggtcaccctcattatatattcttactacaccactgaaatctctgctcttcagattcagaaacacttgagcacagaagatcatggcctctcaggggagggaggaactcacaaggttatccagcccaacctatcatcagaggctgaaatatgttttgaacaggtaagaatgaaagtgttagaaaagctattcaaagcaagcattaagagtgctaggtgagcactgatgtgcagggtgcttcgctgcagcctgcagtggcaaacatcgagttcttccttattcacagtaaaccacaagaggcagtaaagcacagtgaggaagaacacggattctggctgtaggctacccagggtctggttctgccagacaggagccaggcagcacttgccaattttctaagtctctgggccctgttatgggttgataatagctcctactgcataggcttgtgcattagattcaaacggaagccatccctcgcacataagcaggcttaatcagggttaactaacaatgaaagtataaatcaggacctatttagtcaattgaaccaaaagtagaaaaacctttagagataattcaagtgaggaaaataaagtgatgcatgtaccactaaaaccagcccttttgttgttgtttatgtagacagagtcttgctctgtcactcaggctagggtgcagtggtacaattgtagctcccagcagcagccctgacctcctgggttcaagacatccttctgctcagcctcccaagtaccttagtgcatgggcaccaccacgctcagctatttatttttttaatttattttttgtagagatgggggtctcattgtgttgtccaggcttgtctggaactcctgggctcaggcgaatcctcccatcttggccttcccagaagccccagaccttttaattaagctgtctttactccatgttatgataggacaaccgaggctctatctcaaatgttcagacagagacacccagactgagttttctgtggggtgcactaccagaaattgggaggtccaactcgagagtccatcacgaccagcacactattgttattgagacagcctccacgatttattggttttggggattgctaaactattacagtgtcatatcgtttgcatttagtaatatgctaatatgtttgctctaccaaatgttaatgaactcgagtaggatttagatttttacaatttgttataaacttttcattaagccttttcccaaacagggtgaacttgtccttcaactatgatatttaaagatccatttgtagcaatttaagataattggatcttgtcttgaaacttccatgcttgccagaaaataacaatgaggtctgagtcgaattcttcttggaggtttcagcgcaccttcgccttcaatggtagagaagcaagaccacctccctctgctcgtatggctgtttctattgttgaagcctctgttaaaaatattctggtgacaaaactattttaagtttgtcctctaacaagatttactcaattgtaaagaagaagtaatggagcaaaattttagcttttcagtagctgaataatagaatttcagacccagagtttccttgtatggtagtaaactcaatgcattaataaagatagcagcaataactcggaaatcttgcctgactgaaaaggggaagcccctcactactaaaaataggctttgtcatacaccgaagggaaagccttatttttatgttctttttcctctgaagtttctaaaaatgaattgcttacgtttgcctttttttcatttcattaaaagtgtgtccacgctcacagtccgcagtgcttcctctgaactctgggagcaagtctttgcacaaaaaagacacttggctgacagcatccggaaatcacctgcaatcccaaagcctccggaatgcacctgcaatcccacagcgtccggaatgcacctgcaatcccacagcatctggaatgcacctgcaatcccgcagcatctggaatgcacctgcaatcccacagcatccggaatgcacctgcaatcccacatccatagcatctggaatgcacccgcaatcccacagcatccggaatgcacctgcaatcccacagcatccggaatgcacccgcaatcccacagcgtccggaatgcacctgcaatcccacagcatccagaatgcacaatcccacagcatccggaaagcacctgcgatcccacagcatctggaatgcacctgcaatcccacagcatcaggaatgcacctgcaatcccacagcatccagaatgcacctgcaatcccacatccacagcatccggaatgcacccgcaatcccacagcatccggaatacacccgcaatcccacagcatccggaatacacccgcaatcccacagcatccagaatgcacctgcaatccaacagcatccggaatgcaccggcaatcccacagcatccggaatgcacccgcagccccacagcatccggaatacacccgcaatcccacagcatctggaatgcacccgcaatcccacatccagagcatccggaatgcacccgcaatcccacagcatccggaatgcacccgcaatcccacagcatccggaatgcacccgcaatcccacagcatccggaatgcacccgcaatcccacagcgtccggaatgcacgtgcaatcccacatcgacagcgtgttttctcactgtccctggggattccaagccactagcctctgttcccacaggaaagtctcttttttgtctctccttcaattctatgattatattcacgttgaaatatatcaactttaaaaaacacttgtattgtgacatatcagttctcatacctgtaaggacagcactcctatcagaaatatgaatattacttgtgagtgtgacaaataaacataaactcaagagtaggtcttttcaaatacattctagctaaaaaaaaaaaaaaaagctaaatgaacatgcagacctccatgaagaataaacagctggcaagagaatgtgtgagcagggaggggctctttaatatgaataaaaggctcagtggactcacaatggctgtttgcaaatacacgaaggcactccgtatagatcagagtcaggaattgttttattaggcctagagagatagagctaccatcaatcactggatataagtcacataggaagcctggcacaaagtaaaaatgttcaaacatgaaatcagctgtctctggggcaatgagctgtcactacagttatttgatgttagctgggcattgacttgtgagaatattatcaagaaaattcaactgcaggtagtcctgagtgatgtccaatgtccactccagcaatggaacgaaatgacaatgactacgctgtggtttcctcggatatagacgaaatacatctgctgataaacacaggctcccatacgtttaatgatcaatccaggcctgcctccagtaacaaacagcagatcttcaaagaccagcccggacacagacagcccagaatttaggccatgttctttgaatatctacaatattacaaaattccagtgtagctcactgagtcagtgtgtgtgtataaaattaaaaatgcaaaaattattttttctggttcagggatttctgtgataaatgtttttctttttaaatatgaacagtaagtcgaacaataaataaatgtaataagacaagagtaagagccttctacttgtgtaaagactttgtgctaggaaggtgtgtagccgcctctacatattcaattttaactttctcttattgtttcttgaaggacaggactgcagagctcactgtttaagggtgactatgctctcctgtccattcattcatggagacctgagtttttctctagggacatattaaagtagcctggagttagaacagcacaaacccttcaaaaagtggtaaatttctcagcggattccacagttgtcatgaatgtgattaataggtgatcaaggctcacctcttcatctggagctacctagacaagcagaaagggaaattctatttccagctcctaagcaaataagtaactgaaaacatttaatttctgggagatcttacaagcagggccactctaaaatgaacactggggagtcaaaaaaaaaaaaaaaaggaaaatgactgctccttacctgcaccaatgactcgggtgatgctacccttgaagattccgttggtcctgatccaacagaacatagagagtgacactgtgtatcttctatgaagaagctagcacagtgtggaaaattggccttacaaaaatgtgtcatgttcattacttttaattaaggaattaaattatgttttaatttcctggggtttatcacacacttatttaatagtaaattatattattaccaggattcatggtgtggtgtgtgtgtgtgtgtatgtgtgtgcaaagtaggaaacatgagagataaatgtaatttaagcatagaatgaaataaaaatgtgttacagaaaaaatgaattaatgtgtttattgatttttttcttgtagatcccagataatgtttacattttgaggttttttttggggggggagggcagtgggggaggttggggacagagtattgctctgtcgcccaggctagattgcagtgatgggacctcagctcgcggcaactgccacctcctgggttcaagcgattctcctgcctcagcctcccaagtagctgggatcacaggtacatgccaccacacgggactaatttttgtattttttagtagagacagggtttcaccatgttggccaggttggactcaaactcctgacctcaggtgatccactcgccttggcctcccaaagtgttgtgattataggcatgagccaccatgcctagcctacattttaagtttttaaaaattgtgtttttcactttcttttgggtgagtaaagttttaaaggtggtgtaattctcaccaccacattgcctgtgttttctctgatactattaagtgactttcaagagagtagatggttaccatgttgaggaactcaatatttgtcccaagtaaataaaatcaagaatattgaatattgcactaaagctggttgtgaaacatacatagataatgacactagtactcatgaaaatccatgttggagggaaacacaagacaactgttgttcgtactgttccctccactgctttgtgtactgcctgcctgtgccttggatacacgtgccctaaaactgtgtattgtgtggtgttattctaaaactgtgtattgtgtggtgttattctgaaaccgtgtattgtgcggtgttattctgaaaccctgtattgtgtggtgttattctaaaactgtgtattgtgtggtgttattctgaaactgtgtattgtgtggtgttattctgaaactgtgtattgtgtggtgttattctgaaactgtgtattgtgtggtgttattctgataccgtgtattgtgtggtgttattctgaaactgtgtattgtgtggtgttattctgataccgtgtattgtgtggtgttattctgaaactgtgtattgtgtggtgttattctgaaactgtgtattgtctggtgttattctgaaaccgtgtattgtgtgctgttattctgataccgtgtattgtgtggtgttattctgaaactgtgtattgtgtggtgttattctgaaaccgtgtattgtgtggtgttattctgaaaccgtgtattgtgtggtgttcttctgaaactgtgtattgtgtggtgttattctgaaactgtgtattgtgtggtgttattccgaaacagctcttctaaaaatgggatccaagaactcctggacttctctgatattcttttagcggtcaacaagcatctccctttccaatgactacactaccaaccatcaatatattttattttacatatctccaccaaaacaacaaactttgacaaagttaatgcagaaggtgctgagaatccagccaccctgtattaagccacacattaaggggctttgaaaaattttaaaatgatgacattcttcacattaatttttgctttgtttgaaaatgaatccttattgttcataaaaatgtgttacttatgtgagcatgtaattgatatgttattttaaattaatacgtaaaattgtatccgttttagtgtaaataaattaacaaatcaatattttaaaataataatagtttttaatgtatgatatagttataaaaaggtctttggggtccagtggtaggcagaattcgaaggtggtccctacgtgtcccacccctgagtcgagacatctcctcaaatcctctccccctgagtgagggcagaactctgaggatgttaggagtcagctgactttgagttaataaaaaatgagatgatttggatgggaacagcctggtgagggaagcccttatcaggaactaagtccttcctgaagtcagagagattggactcaggagagggcctggtggggtgggggacagagggccaggagcttagtatttccccatcagcagcagcaataacatcaggtcctcagccacacaccacaaggacatgaactctgcccaggagccaggtttgggaagctgatctgaacctcactggacctcgctggatcccactggagcccactgggcctcactggacctcactggacctcactcggcctcactgggcctgactggacctcactggacttcactgggcctcactgggcctgactggacctcagtggacttcactggacctcactgggcttgactgggcctcactggacctcactggacctcactcagcctcacggggcctgactggacctcactgacttcactggacctcaccggacctcactgggcttgactgggcctcactggacctcactggacctcaccgggcctccagccctgtcaacaccgtgaactctgccctgtgagaccgtgagcagaggatccagccaaaatgtgccaggtatctgagcccagaagctgggccgtagcgaatctgtgttatcatgaggcccttagcacgtggtgactagttatgcagcaatcaataactaacacaggtcctcaaattttaaaaataaaaattttatgaaaacccctgagaacagttgccttcaaagaggctgggctatcccttccatagagggtctgctgaatgaccttggtaaaggggtttctagacttctgtactctgatgtcatttccaaaacattgaggcaagagataaaaagaggagaaagcggccattaaggcttgtaaattttagccagcatcccaatttaaacaaaaagtcacacactacgacatctaagacggcaaacctatgctccaaaaagagaaaaaaagattgacaagccctgtattagtacaatttaaaaaatttttttaaatgtttaaaatatatatagtagatataagaataaattgacaatatcaacatcaggccttttggggggaaaaaaaagacaaagcagaaaatttcagtttggtcacaaaagtaacaatatactccatgtcagctttccccagcacactgcattccctggtgtggaattggttctctgataccattctccaccagacgataccagggctttttggagaacaatgtgtttgggtaagaaaaattccagataaccatacaacatcctgtttttatgagaaaacaaggaccatttcagagatgttagagggaccaaatgaaaaagctgtgtaaaagggactccccggccaaagtgtcacaacctgagctacagatattaataaaatcatttttttaaaagtcaacaatgatttcagctggaatccagtgactctggaaaatgccacgtgtacacgatgacattcaagggacaaatagcaaagtgtgatagaacagctcgtgcccagcccgcaagcagcaggcagctgacaatttagaaaacaaatttgtggcccgagacacctagacatgtgatgataaatgatgtgtgggggttgtgactggaccccgctccgtgtcagaaacaccagaatacagttgataaaaccagaggcaggaaaacagactttctagaatttcagaagctggaagcagaaacaccgttcaaggacagcagagctctacctttgctttctttcccaagatgaggtcaacgccttgctactaatgagtttagttcaggaatgaggtttttgttaacattcccttaaggagaaggctctccactgtacgtgaaaattcttcgggaacgctgagttgtgagcatggaagattgtcacgcagcaaataccatttggcacggccctgctctgggaagacagggacaccgtaggtgggcatccctgggaaatcagagagacaagaaaacgctgtactgcgctgtgccagccgcagaagccctgtgtaaaaccccacctggaagaaattaataagtgtctgtttttaagatcctatttctggtttgaaatcgacaagatgatgttggcgggaagagtctaaaataggcaaaaggttagagttcctgactccttctcctaatctctccttaccggtgctaatgctggaatctccaggtgacaaaatctgtgcacgactggcaagaatgtcgggaaggggggcatttcctaagctgcaaaggtgtgacaaagaggaacggctctgcaaactcagtgaccaggtcattacccatccaaaccaggacaccgttcagagtgacaagcaatcactaataaacacctggaaaacaggcttcaggcagggctatcttagagaaacggggaccatgttcattacgattatgaaagctttgagctccctgaggccagcaatccttcctgatttatctttgtgttcctggtgaagagcttgtggtacgtgtttcattaacatttgttctattaaaagttgaattaaaattattatcaaagacagttaaacattcatgcttttgtctttttcaatttttattctggcatattcttaccaagctgtgtattttataaattatacactattctacttgtttttatgcatgataattttctgtgaacaatcaagtaaagattgtatactagacacatctgattcagagtgctctgaacaatactagcattgttttatttttctatttcaccatatttaatgtgaaactcactgaaagctttaactgcttatcttgtacctaagagaataatcatctcccttgtgaaaacagtctttatttgagaacacaatatcttcagcattcatactatttcccaagatcccaattagaactcttgaatagtctgtctatggcgtaagagttatctttttacacataggtttgtatttgtctttgagctgatttgaaatacagttggagaaatacaattattaacaaggaaaagacaacatcaaatgcctaatcgagcagcaatgtggtttaagtatgtcacatgacaatacatattcacatcgcaatgaaaagacaggccatttgttcttttgatctataggactatggtagatgatagctccactagagaagctcaccactgacataagccatctagaataatctaggatgccgtgactttcaggggtgcctccctcatcacttacctcgacagcttggcctctcatctcctatgttccacgtcccattggcctggcaccgcaggagcctccagccttctaagtagtaaccaggactgcagctcagcaatacttgagcaccgtactcattcaaggatcctgaaaccagcctccagatgacatgttctgagagctgagcttcaatgctggggcaagcgaccgctggaagggaaacgtacatcacatcatcatttttcttttttggaaaacatcagaccgtgcttgctttggatggcaaggtcttgctatatgaaactgatcttgtttggcaaagttgatgccattacgtattatctcagtgtttctctaccacccacatagacatatgggaatgatcccatatgtaaaatgcattcaattgcctcactacagatgtcctgggaagtctgcagtcagactgaactgtaaagggggtaaatcacttccacaaaagtatatggctcattgaagttgatgaaaattttcatgagggtaatgagcatatgcaaataaaaatcttacatataatttccctcaatatccttggaggaacttggaatagtaattgtgtaattgcaaaccagctgggacactaattttcagaaactcagatgccctcatttcttcaaacctatgaaacacacatatataatatatctatatatcattgaatgtagaaacacacagaaatacataggcatactgcactaatactgtttccaaaaatgtttaacaagtcttaaaggagaccatctattcatgtccttagaaaagggcctagaatatagcagttacttaagaaagagtagtagcaattgtaatagtgacagcaacagtagtagcagtagtagtatactattaccagggtggacttcaaggactttctaaatatactgaaaatatatacagagtctgagttgtatgtgggtacatattctttgaaaagtgcaagatgatttaaaatacattacacaaaattagaaaccagaaccatttctctaattacgaagatttagtagctatcattcattaaaatcaaccaccaagaaaattgatcaaattgattaatttattgagctgggaagaattaactggagagactatagctattttcagaatcatagtgttatattttaaattctttttttgtgtgtgtgacaaagtctcgctctctgtctcccaggctgccaggctggagggcagtggcatgatcacggctcactgcaaactctacctcccgggttcaagcgattctcctgcctcagcctcccaagttgctgggactatggggatacagatgtccaccaccatgcccagctaatttttgtatttttagtagaaatggggtttcaccacgtgggccaggctgctcttgaactcctgacctcaagcgatccacccaccttggcctcccaaagtgctgggattacaggaatcagccactacaccaagcctatattcaaattctatacaagtttattagaattgagtcaggcataaccaaaattttacaaaaatcttgattagtcttttctcagtaatttccaagtactatataaaaatatacagaaaaatgtggctctttttgatatcatcacaacagtaacaatgaagtctaaaatgggaagaaaaattgctaatttaaaagtaatccttaggtttctttctctcaagtatttttttaggttgaaggaattattctaaatttataagaagattcaaatgtttaacctaatgataaaaataatatttttctccagccaaaatactcttacaatttctagcaaaactgtttctgaaaagcccttaaaggcttttagcctcataaatttataactcaacttgaatctgactgcatatttcaaataaaatgcatttaatttcaccaaaaacatgcaccgcatgttctcactcataggtgggaattgaacaacaagatcacatggacacaggaaggggaacatcacactctggggactgttgtggggtggggggagggtggagggctagcactaggagatatacctaatgctaaatgatgagttaatgggtgcagcacaccagcatggcacatgtatacatgtgtaacaaacctgcacgttgtgcacatgtaccctaaaacttaaagtctaacaataataaaaaaaaattatttttaataacttgaactatcttttacaaactttatttctgccaagaatgactcaactttgttctttctttctttctttgttgtttccttgttgttttatacagactaggtctagttatatggcccacgctggtcctgaagtcttgggtcaagtgatcctcatgctcagcctcccaaagtgctgggattacaggtatgagccgctgcacccagccaaaaattccaatttggttcacacaacggaatcagacaattttttgagctgataccatctacagtatcaatttccaagttcttcatgatgatctctttcttcatgaaaatggtatttggtttggtttgtaattatcttaggctagtttgattatttgctcacatctctcttttttttttttggctatgctataccctcatttattgtaaacactgtctttttacatttttttagtatagtgactgacaaattagacactatatgtgtgtatgtgtgtgtatatatatatatatacacataatataattatatgtgtgtatgctttgaaaaatagcctgccaagaaaatacattgccacaacaaaagaaagagaggaaagaaacgtgtatgagtggaaattaggagtaaaaagaaaagtgaggactgcaataaatattaatattaaagtccatcttgtcctttgttaactgaaggatgagagtggaagagtggagatttccagaaatttgtgcaaattatcattttatttaatattttttaagaatgataggtagagaacatacaaaaaaaactgagtttgaatactctgtgacgtaatttgggaggagaaatcccaaataatataaaccaagaggatgccagaccattttccctaaagagtggtagaaaaggtacagtctttgtcagttgtgtctccatgcacccctgcgttcatacaaaaacagtgccaacagcccccacggaatggtgggccctgatttgctgtggtcaataaggctgtcccaaagaatgtcctttatcttggtccaataaaataatgtggcaaaaatctgataacagaactgtgactctcgcgagagggtactgaattcaaataaaaacagaacattttacaacccccaaacacctaccccagtctactgattcacatgcctgtacgtggtttctagtcactgacatcagaagcctgaaaacagtgtcttcctgcagtccctgtcacatacactctcacaaaggtgtctacactcaacccccccaactccctatgttttctcctcttctgtgcatcctcaacctctaccttacttcagagtcaaatgcttagttttggcgcaaaatttcacttgcacacccttaaaagaatatttttaaaaaacactgatctctttatatacccttcattaaaaatttaaaattttcctcataagtttaagtcattgacattaccagtatatgaaatgcaaattatggtaaaagtgccattaaataaaataccacttttactcaagtccaagagaataataccacggcaacttgacacttctgaatattcatttaaaagaaattcaacaaatttatttcattccttgttctcttccaactattaattctaggctacagtttctataaaaaaaatttaaagatattttattttgaaagttctttatgaataatctataacacttaactgtaccaaacttcgatttttaaatttcctgtgaccacacattttcacagtgaaaacattctctttgatttagatgcaaatttcctattaatataccattgattgaataaacaatatgataaaattgttgataatctacattcaacacaaaagtaatgttttattggtaagacaccaattgatgctacagataaagcattgttgttcatgcactactgattgttagaaagagacaagctgtagtatcaattgtattgctattgtggacttcagacctcaagacaagtagtgttaaaataaatttggctcactgagaatgacggttaacacgggaacagaaaaccaaacaccgcgtgttctcatttataagtgggagttgaacaacgagaacacatggacacagggaggggaacatcacacaccagggcctgtcgggaggtaagggacaagaggagggagagcattaggacaaatacttaaaccacgcgggatttaaaacctagatgacaggttgacgggtgcagcaaaccaccatggcacatgtatacctatgtaacaaacctgtatgttctgcacatgattcccagaacttaaagtaaaataaaaataaaataaacttaaagtaaaataaaaataaataaacaaatttggcttcgagttacctttacaccttgaattcctacacagtgaactgcaacctcactcagtacacagcaaactgcaactcaactcaagaggatgtggttgtaacaaggagttgagtctcagctcatcacagcagccttgcttcagcccatcgcgggccccagactagtcagaccaccccctagtcgggcaggtgcccagacgtggctcctccagctgcctccccatgtgccttcctttttctatcagtgctgctgcccacattgctgggtggagctctctggaccttgcctggatttgaaggctgcctgattgatacacctatttactcaaataaactctgctaaatttcatgtgtcaaaagttttctcttaacaggtagaagaaaaatagttggaatgaagaaaaagatttgatgtggtttctggctgatgaaatcgcccatgcttttttgtccttttttaactgttttccatagtttccaggttttctatatattactaatggtcagagaaaaagccaaccaagagatcaaagggacttaggagtagtggcctgataggcacagacatcattttacagttaggctgaaaaactgaaagctgagaggactttatttgtttacaagaaaaactggaaatagttcaactaagtcccagtgaaaaaatcttctgtcttgaggtacaaatatatatgtatacaaacacacattacatatataaacacataaaaacacataaatatatgtacatatgtaatttatatgtatgtataaattttaatatatacctactacacataaatgcaaaaggttataaaaatcaatgcataatagtttaacaagggattatttaggaagactaggatgcttctgttatgttcttactttgttatttcttcccacaatatcatacttagagaggaaaaagtgaaaagagagtaaaaatatagtctatagggacattttcatttcatgacattaaacattatagactagggaataagataaaactgagaaatatagaggatggtagaatacatgaagctgaagttaagaactggagcaaaaatatgactcgaacatcacagaaggcaaagcgtgagccagcggcactgtggagaaagggaaggagggcctcggaaacggctttctactgagctctcatttctgcccagggatggccctaacactcaaaggcagttgcagtaaacatgcacgcctcccctaagacttaagacaaagtggagttacagtcaggaggcaacacgaaacagcctgagtacctctgtgctgacatttttaaagaaaacacttggttctttctaacaaaaatatcttagctagatctctcctaagatacagggctgttccctgtacctgccagcactccccagtcccccaccatcataggcagatactgcagagcgcggctgctcccagagacgcgcatctgtttaaaaagctcttttcacattgtgtatgtaattgtatatgtaattctactgtaagcggatcctcactcacaacgacactgagacagaaaaggagggtatcactattatttgtatttatttgcaagttacagaggagcaaggaagcccaggctcaccccaaccaagccagaatttccatctgtgggtctcacatcatgttgtgtttctgacttgtcactttccctgaacactagaaacaatacgggaaaatttgatttattctacaaatgactaaaatgagtaactccaagcatagtttcaggaattgaatcgacaagagctccaaacatactagcatacagatatcaaatgaataacaaactccttgaatgttttaaaattttggtcaacctgggaaaatgtagcaaaagaaagtgttttgctaatataaactttataaatcaatatttttaacaattataagtgaataaattgccaggtcaagttttgtaaaattaaatgttttcaaaaacataagggtttagctggcatgacagacattgttcaacttgccagtttaccttatatttcttcttttttatttttaaggaaatacaggctaccttctattaccttaaagaaaacaactataaaggaataattttcttcaattttcacaaattcaggagaacatttactggagatcatttcaaaatatttgacatggttaataccattgactatgttgatatggttgacacatttttgttctaaaaaccttaaattatgcttcccaaatccagatcagttgaaagtataaacaatatatagtcctgtgcataaaagacacattgccctgacttgtgagtgtttcagcaacaacacaaaatactttgcattttacttaagaaatatcagcctttaatttggccgtgagtaattctgatttattatagactcattcagccagtgacaggatagaagaataaacattgctttaagatatttagacaagggaagtgagattaccataaataaagccctttgcccttctctctcaaaaatttcagaaacttatcataaatcttctgtgatattctaatcagcccctagattctggatgcaattgttttgttttgctttgttttgtttcttaacagagaagtctcccctatcgtactcaatgtgggtaagtgcttcttataaccaactttaattgaagcacatttaatgagatttataaaattatgattagatgtcattggagtaaactgatttaatcagcctcataactgttcctcatacacacaactaaagcaaagtgtgcagtctagcactaaaaacctgtgcttactggacacgcgagagaaaaactggtgttagttctagtaccttagaagcctaaataacaagacaactttggtttgggtaaaaaataaatataaagtttttggggaaaactaggatactaagaccttttaaatgtgtttcataccatcgaatttcaacaatcctctcttaaaaaacccgtccaccaagacaaaatcaagaacatgggattcttttctttttggcttttagaaaattatttcaatagctttttggggtacaagcgtttttggttacatggataagttatctaggggtgatttctgggatttcagtgcacctgtcatccaagcagtgtgcactgtatccaatatgtagtcttttatccctcacccatcttcctatctatcatccccttgagtccccagagtccactgtatcattcttatgcatttgcatccctatagatgggctcccacttaaaagtgagaacataacgatatttggtcttccattcctgagttacttcacttagaataatggcctccagctccatccaagtccctgcacaagacattatttcattcctttttatggctgagcagtatttcatagtgcatatataccacactttcttttttttgtttttttgagacggagtctcgctctgtggcccaggctggagtgcagtggcgggatctcggctcactgcaagctccgcctcctgggttcacgccattctcctgcctcagcctcccgagtagctgggactacaggcgcccgccaccaagcccagctaatttttttttgtatttttagtagagatggggtttcaccgtgttagccagggtggtctggatcttctgacctcgtgatccgcccgcctcggcctccctataccgcactttctttatccactcattggttgatgggcactgtgtggatttcatatctttgctattgcaaactgtgctgctataaacatgggtgtgcatgtgtcttttccacagagtgacttctcttcttttgggtagatgccccgtagtagggctgctggagcggacggtaagaggatatgggattcttaaggacaaaagttgtttttggatttttgctttacccttacagcttaacgaaatgattcctaaatgagttatctagaataagagtagatgaccaattaatagagttttaaagttaacttctaggaagtaatttatgggctcacctgagagtgactagctttttagaaacattagacaaaaaggtctcaaggcattaagttctagcttcttcttccccaagatttccaactgaatctagaccttcataacactgtcatattcttagggtttcgaatcaccagacttttccttattcctgccactactgttttttccatttgtgaagcttctaaaaccttcagaaaatcgggcatctatatttctctggcccggctttcttattttttatactatggttattttaaaatacatatatttgagcagacttagatcctggaatatttaaataactaactatagccatgttaaataaatagtgttccaacgctatcggtagcctaaaggcaaaccagccatggaatctgatctcagcgagacaagaccaacactaaattcacctcatccagttagtgataccagcaaataggcctttgaagttttgcaactttattacctgagttcaatatcaaagctactttttaaatttcatgaaatgcctgatattttaattacataaaatgagtctaatccaacccctgggaaggattttgaaaaatagtatgactgatccaagcatagatttaaagtcaaaaatcttagtgttccattctttgacttgttgggcttaattgtaaaagcaatacacagcatttatattactggtggctctctttgaaaagattgtttccttatttacttctaaaacgttccttaaaatttttcttgtggttatttgttttgtttttatttacatgttataaggtttcacatgttgcctgcttttcgaggtcatggttttaccatgcactgcatataacgctgaactgggtattagacaattcctcaaattaagaatatccttagagctctttgctgaaaaaaaaattcgcttaagtattctttcctaattgccctaattataaaattttttcttacaatattttaaataagaatatatccacatactcaagcgtaatttgttgattatgatgaagacgaccttaaaccttaatgctattacggatttggcacagttagtgccatgagaacccagccagagccacatagaggcttaaacttcatcatggagacaagccataaaaaccagcagttggcatctgagctggtgactatatagattaggtaaactgataagaaattctacaagaatagatggcgacaagcagactaggtcaactcttgagtactttggatcttcgcagaagagatctagacagaaagtaacccaggcagcagagtgggagcaaagggtacttagagaaagtgggtggttggccattgctgtaaacaccgtgtgagtgaggcagacacaggaagctgaattacaagaaggtatattcctagattcctgcagagtgaagggtcctgaattttcaacttctagccttctcagcccgcaaaatctgactcccgtgcctgaaaccatttcttgacccttccttccttcttttccttacttccttcctctctccctcccttccttcttttcctttctttcttcctttccgccttccttccttcctcctttactttcctttcttccttccttccttcccccttcccttccttccttctctccctccctcccttccttcctccctcctttcttcctttcctccttccttcccattccttcctttcctccttccttctttcaattcttccttctttcccttcctccctccttcgttccttccttctttccttccttcctttcctccttattttcttcctcatacattatgacaataaacttccaccacttgtactaacctgaggaggcattttgcacttcttgagattataagccctaaatgacctcgtctgcattttacaacctttaagaaatgtgggttcagaaaggcatttcacaggcctaaggtctttcaaaatattttcctgtctatagcaacttgagttacagcacggccttaaaacccagagattagacttaatttaaggagattgcgtttaaaaattaagctcgtttagcactgatacatgctttgccaaatatcagcattcatattagatttgccgtccccaatatcaaaccaaacgtgttcctcttctaaaaattaatctggctttaataaacatagtcatagcacggaattctcttaaaagaagggtagtttccaagcaggtttcactgagaatccagaaagtgactccaacctcagagatgtccttagaccactgaggggtgaaaaggagtctcctatggattggtccagaaggctctcctctctctcacctctacttttcctcctccaatttcagagtgagaagtcaggctctagaatttggagaagatggaaagattgaaagaaggaacgaacatccaaactttatgttctgtttatttcctcatttctaatatcaccaccaaaatgttaatgcagccaaacactcccatcaaaaatattaacttcacctggctactattaagtaatatatagcttggagaagctttagtttctcaaatggattttaactcttattgagtgaaagggaaaatcaaggtgtagatagcatatacacattgaaatatatatatatatatatatatatataacagaaatatatatatgtatatacaaaatgattacaaattgaaatctatctatctatatatataaacatataaacatatatatgtatatacaaaatgataacaaattgggccgggcacggtggctcatgcctgtaatcccagcactttgggaggacgaggcaggtggatcacgaggtcaggagttcaggaccagcctggccaacatgatgaaaccccgtctctactaaaaatacaaaaattagccgggcatggcggcgtgtgcctgtaatcccagccactcgggaggctgaggcaaaagaatcgcttgaacccgagagacagaggttagagcgagttgagatcgtgccactgcactccagcctgggtggcagagtgagactccagctcaaaataataataataagattataaattaatagatgatttgaatgttttgtcgaaaataatctgttagaatatttctgagtaatattttcatataaaacatttaatggaaattgtttgcagcatcatgaacattttaaaacgtgttgaatgtttctacagaagttccagtgtcatatttctgtttccttttctctgcctaatattgcaaagcatttttcttcatatcggtaaataaattatcaatatttctgtacaagaaataataattttcttaaccaacatgaaaatggctgagcagaacttaaaaatattagagagctcctgacaattttgaattacatgaaattgatgtcattcaacatttttggacttaataaaaaggaaattttacagggttaaagcaaataatttagaaaattctcaaatattattttaacagttaaatagatatgtactacagagcaaaaatatatcccgtaaaatgcattttttcttgttttctttacagcattatattaatatagaacaagcaaattcttctattttatatgtattacttgttctctgatcccaaacataaagaatcccaggtaatatcataaatatgcttgaaaaggcgctaacatgaaaatacacaccttgaaaacctttttctagcaacatttaaattttttctaggcgtaatattatccatagcatcaggttatttctttttcttttgaaatgtcaatgtaagtgttggctgtgtagaaatatttttggttgttacatgcttgtagcatttcaaagaaaacagcaccacatctatctgtagaaatgtgaattttaaaaactcatacatagatagaaatgtgtgctaatattcccatctttactcaagtatacatttagaactgttaaatgaaagatgaggatgccaatccactgctattttataaaccgataaacttcatagttcaacacagcacagcgtttttgccagcctgtcacagcttctttctggcagccatcaaatggcggtaaaccccatgtagccgacagtctgtgggtgtaaagtgctttaaagcagtacagtacaatcacgcaaacgttatgctcatttctaaaatgtcttttgacatcacggtcctcttggtttcagaatatgttagtgattattggccacccttcatctctgggaaacatcagctctggaaggcacagaagccttaacaactttgtgcgggctcccatgccactgggaacccaagcctccctcatcatcacacaatggtttccagcacctgccaactctgttcccaagccacccaggcaggagggtgatggggacaattctccaggggtctctcatgcatctggttagctgagataccaaactgactttttggcctgaactatttcttccaagcatgtagcaaacagccttggaagagagaggtggatggatatgcaccctcctatctagcacagagactcgtgcatctccttagctaaggtaccaaactgaccttttggcctgaattatttcttccaagcaggtagcaaacagcctcagaagagagaggtggatatgtacctcctatctagcacagagacatttccttttatcaccttaataggtattttctaaatgtatttatcatctgcacatgatgatgatgcatttagatgaggtggggatgggacctttgtttgactttgtaaacctgcttacgggaatcccgtcgaagcacagctgaaagcgggacgggcactttacgctagttccacatgggtaaccctgtggatgagcataaaaggaccatcttcagtgctgactccatcatggagcaaccgagcaaccttgggaaaggtactcaagctcccatgtatactctgggcatgatagcagtacttcataggtttgttataagagctcagagatttaactcgtgtaaaatgattaaaacagtgcctggtgctcatagacataaccttagtttttctacattgagttatttatatttataggtcgtataaacctagtgctagatatgacctagtactgcaggattatacgtacacagagtactatagtgaatatagtatatggaaacctacagtacaaggtcactatggtgatatatatatagtatatatagtgatatacatatagtgatatatacagattatatagtaccataggtcactatagcgataggtttctatgacctataaatactagatatgacctagtactgtgggattatatgtatatatagtactataatgcatatagtacatgtaaacctacagtactaggtcactatggtgatatatatatagtacatatatatagtgatatacatatagcgatatatacagattatatagtaccataggtcactatagcgataggtttctatgacctataaatactagatatgacctagtactgtaggattatatgtacatatagtactatagcgaatatagtacatgtaaacctacagtactaggtcactatggtgatatatatagtatataaagtgatatacatataacgatatatacagattatatagtaccataggtcactatagcgataggtttctatgacctataaatactagatatgactagatggaactggtgatataaacctatcactagatatgagtatcaagctagtattgctctggtttgctttcccttttttatgatgtatataaattgcatttaatcatgtaaagtcctcatggtgcccagcatagagtaggtccacataaataaattgttaatgactgctttgcttcactgactagtagtagttttagctaaagaaacaatacccacatattgtgattagaacttaggggtttttttcatgcaaaaatcacacatttattaaacatattattaactgaaaaacaacataccagtttattttcaagtgctcttcatccaacaccttggacaaaaccgtcagctcaaagtgaattcaaaaaacacattataaggcaaacagtgacaagaggtatggacaggcactaccaaaaaaatgcaatttgttctctaattaaataatgtcattctcaagtgatatagagctgtcatcttgacagaattccttttttgtataaatattcataaataaaaatgtctccacatattggaaagagctgcaaacactctacaacagcagcttaatgtctacttcaggggaaaaaaaagcactaaaatcctcttccattgcaagctgtttatttctctggtgtaccacagctaaagatgagttatgatagcagcttgatgttgattatgttatattcttttaatcaaaaaggaaacacttataatattctaagtatctttagcccaaataccatgtcatagtgagcatttgtaaataaccagactgtactgtccttcatatgtgaagctgacactactgatgtgtcaatcaatgccaaatgttgggtaaagcatttaatttttatttatttattttcttgttgcatgaaaaggtgattgcattctaacttttgtgacctaccacatttaagatgtgtatacgttgttctttactttgtcccagaaaagacattttaatcctgtagtgactttgctcacttacaccagagaaataaacaatttagtttttcactggaaggctagcttaatggttttgttttctcctaaatacacagtatatgatacacatctttcatcattttgtcagactgttaaacccagtccgttaataccaatagccctcacttctttcatcatgtcattagcatgaatcgtgtcttcgatgatccaaatccagtctcagtaaataactgaaatgaaaaaaaaaagggacctcaaacatctgcctcggagatctgcaccactgcaagaaggcggcaaatggaagcataattccttattataaccttcattttactaaaaacctgagggtgaaacgaactaattgtatttaccatttgcatttactatttatcaaagctgaagtatttatctcttgagattcagtgtactgatctacatattactgcaattgctaaagaaacttaaaaactgtttcataccatcatatcatacaaaggaatgagccctggggaaatacatacttggacatttaatggtaaccaaatttttctggctaagaggtaaagttttatgcttactctgccagattttttccatttaaattaagtgaacaaaaacaatcccccgaataaaaattaaatcggttttccagcccttgaataccaaggaattttaacaaaacagccacatctcttttttacaaactttaaagaacgacgggaggaaatgcttacttgaaagtttcagatgatgcttagaaaatgttaacatggatttccattttattataaacgttacatttatttcctcatgttactgaacatatcatagttggtatcaaaagagtactcacgatgcaaattgactttttgctgtttaacaaccatttaatggaacctgcaataacttctttacaatgagaagcaattttgttaattgttgtcattgtaacttctttaaagcaattgtacatctagatatgtattttaaaacaaaaaaaaataggtataagtgaagctaccttaagccctgtcatatgttttacataggcacaaaaccgttctattgattgatacatttacctgtgaactgcaagagaccccttattcctgatttttccagaagattttagagaaaattaggccttgtccttaaagccactggtctattacctatggtgaccccatcacctacttaatacttctcagaataaaccacatgcaatgttaaagtggcacctgtttcctgcttgtgttctcagttttataatgcatcagatttaaaaatcatgagagctagtaagttcctagaagcaatatatcctagaaattaggaagacagattctcttctccgattttctggactttgctacttactgtatccatgaccttcaccaaattactcaactcatgccttcttttggttttcctctatacaatatggtgataatgaaattacatacctcataataattaagtaaattaacttgtgtaaagctattggaagcaagagtggaagacagtagggggtatagggttagttttaagctagtaattaccaatatggtgtgtagccctacttatgcacacagggactcacacacgatgtgggtggggctccaagtcggcctctttatcatacctgacttttacttttggagaaaggagctcaaaataaagagaagtttgtgaattttcttctaccgccatggaactctcaggagtttttctgcagaggagtgtcctcttttgattgctatgctcacaaagtcagtctggctgttgtttggagacacaagggaagcggaggtgaggcagcgggggtttcaggcgctcaggtggtgacctgggtggtgcagaagtgaagccacgtggacgcatgtgtttcagaggcagggcttggtgagggaatgagtgtgagagcaagaaaggagctaagggttacaggagatacctgtacgcctcctccggttccttccaccctacagtgtgtagctgggaatgtcctaaggctccaaaccaggcttctgcccaccttcttcacctctgcttctttttattcccttccgtggacatttcagagctaacagtgcgctcaaatcatgtctcctgatcctcgcccccacggatcatgaaaccaggtgaatactgaactatctctatgtacaggctgctggaatggacagagccttgaattctccctccaccacggtacagtgtacccccaggcaggccttggcagcgttacacaattgctgccttttcctgatgcccaaagcaccggtgtctaatcaaatcatttccaggcagccttccccgcagcagctgaagacttccaacacttccctagaggtttctgtgatgcccagccacatctgtgtgctcacatatggcaaattctttgatacctcaagttattttctttgtattaaaccactaagataaggaacataatatcttcttcctaggattgctattctaattgaatcacgtagcttagataaatgtctagagtgactcttcaaagagccgctctgggccaggcgcagtggctgatgccggcactttgggaggccgaggcgggtgaatcatgaagtcaggagtttgagaccagcctggccaacatggtgaaaccctgtctcttctaaaaatacaaaaattagctgggtgtggtggcgggtgcctgtaatcccagctagtcaggagactgaggcaggagaatcacttgaacccaggagggggaggttgcagtggaccaagatccagatcacaccactgcacttcagcccaggcaacagtataagactccctctcaaaaaaaaaaaaaaaaaaaaaaaaagagttgctctgattttcctcctattttgccaggccaagttctcgccccagccatctcttctgtagaaattggtcccagacgattcccgtgttccttcatctacatccgttattcttttccgctgctgtttgcatccggccttctgtttcatgtcctgtgcatatcttcaggctctaagggcaggagatatcacttaccagtctcacaccagtagttacaagcctgatgccccattcagagcacacgctccaggacgctcagtgaggggttgcgagtacacagctcctgcctgtaccaataatgtctctgcctcgctgtgcccatggaactcaccatctcacatgctgtcctgatggaatccagggcactttgtttgctcccgtcttttcgaaactctctgcttctcccttcctttacccccaaccaacgacttaaaacctacattgtgtttcttttcctcataattttcacatagttggctctttatttcagggttatgtaatgccaatcccttttttggcagatataaactacttgcatggacattctagagaccagcttgcaatgcagaggaaaacacttgagtgtgtctaattcctcaacccagctatgtgtggcctttacacagaaatatggctcatagggacataaaaagtagtttctgtttatgccgtgaaggcattctgttctggatgtattcacaaacacctcaacttgacggtgatagactgaaggttcttgttcattttgtcaatctgtgaagtaacaggcacatgtgcgagaaatccttaaagaaatctaagggtaacacatcattgcttacaataaaatttcactgagatgatgtatctgtgatacccaaagagctgaattattttcaggtaaaacaatttctatttagctttaaatgtaatgaaagtacccatgtcagtcaggacactgacctaaaatcaaataggtcagtataaatattcgcgaccaacaagaccgatcttgtaggaaactgggagatgttattttaattaattttacaaattaccaaattatattaaatacattttgaaaaaaagtgtccgatacatcatattctgtcgtagccaaataaaacggaggtaagaagacattatgttactggcaaaaaagtagacaaatgtgtcaatggaacagaatacagagcccagaaataaacccacataaatctagtcaatgaacttcgagcagaagagcaaacacaacccaagagagtaaagataatcttttcaataaatggtgctggaaaaactggatatctacattctaaaaaataatccagacacagaccttttgcccttcagaaaaattaatccattatgtatcacacacccacatataaagttcaaaaatataaactcctagaagataacataggagaaaattgtggtgcccttgggtttggtaatgactttgtagatacaaaaacagaggcaggatgcattttaaaaagaacagatatgttgaacttcattaaaattaaagtcctcagctctgcagaagacactattaagaaaatgaaaagaccagccacagactaggaaaaaagggtttgcaaaagacatatgggataaagaactggtatctaaactatataaagaactcttaaaaaaaaaaaaaggaagttaacaacctggctaaaaatgggcaaaaggcctgaacagacacctcatgaaaaaagacaaacagatggcaactgagcatatgaaaagatgctgcacatcatgcatcatcagagtattgctaattaaagcaataataagatactactgcacatctatgagaatggccaaaatccagacactgatagcaccagatgctcgcgacaacgtggggcaacaggaactctcactcattgctggtgggaatgcaaaatcctgcagtcttctttgaagatagtctgatggtttcttaaaaaactaaaaatactcttaccattcactctatcaatctcaaccttcggtatttactcaaatatgttaaaaacttatgtctgtataaaaaccttgcacacagatgtttatagcagctttattcacaattgtaaaacttggaagcaacccagatgttgtctgtacgtaaacgggtaaataagccatggtccatacagacaatggaatattgttcagtactaaaaagaaatgagagctagagccatgcaaaatcatggaggaaacttaaacgcttattactaagtgaaagaagccaatctgaaaggctaggtgccagatgattcccaatatatgacattctagtaaaggtaaaactatggagatgaaagatcaaggtcagtgtttgtcaggggttggatgcaggaaggcgtgaatgggtggagcacaggagactttaagggccacaaaagtcactttaggcgtgaatgggtgggcaaaggagactttaagtgtgatactatcatggtggatccctgtcattacacatttgtccaagcccacagatggtgcaacaccaaaaatgagctctcatgtgaacgctgggctctgggtgatgatggtatgtcaatgtaggtgcatccattgtaacatgcaccccactctggtgtgaggtgttgatagtggggaggtatgcacatgttgcggacggtgtgttttatgggaaatctctgtgtcttccattcaattttgctgtgaacctaaaactactctcgagaacaacgtctgtcaaacaaagaaacgaaagctctgaaaataaaaattacattttataaagtgaccttgtcatttagcaagtctttctcagatagtatacaaatttaaagtgggttttcctttaaaacatggcatatacttgacattttatgcataacacctagagaacttaaaaaaaaaaaaaaaactgatgattggtctccacctaagaccagttgcctcagaatccctaagggtcaaaactggacattaacatttactttaaatctctctagagtatttcagtgcatacccagtagagaaccactggcattataaaaggggtataggatttagaacaagagggagtagaattccaacttcaaatctgcaaattagtagttttcacctcatttgtgtcccagtttttcagggtttttatgagttttgtagataagctatttgaaatatttggcaggaaatacagactttaaaaatggaggcatcattatgaatgacctccaggctgtgtgcaaaagaaacattgtccataaatgtctgggacattgttcttattaaaatcaaccccaaacatatacatattgccatctgttaagttcctattttgagagaatagttctgtttaggactgaactcaaaaaacataccaatgtatcttgctatcctagcctcccatactattacttaattgcaataaaatagtaccgtcttaaatagaaaataaccaagaaatactaatgttgattcaatattgtctgactctcaggaaatgcaataaaaatgatgaaataaagaaaaataaaagcttttgggaagaactcaaccgccttccataattgtttgtctatttatatctaagtatatggatataagttagtttaaaatttttaacatgaccaaaatactgtagacaaaaagaagccaatgatctgactttattattgaagactatgtgaatccttctgctagtatcactggcgcaaaaatatcattgtaaataagtaaaaaaatagcagatactggtgaggcagtggagaaaagggaacacttgcatgctgctggtgggagtgtaaattagttcagccattgtggaaagcagtgtggtgatttctcaaagaacttaaaatagaatgctcattcaacccagcaatcccattactgggtatatacccaaaggaatataaattgttctaccataaagacacatgcacatgtatgttcactgcagcgctattcacaatagcaaagatatggaatcaacccaaatgcccatcagtggtagactgcatacagcaaatgtgatgcatacacatcatggaatactatgcagccataaaaacagtgagatcatgtcctttacaacatggatggagctggaggtcattattccaagtgaactaatgcaggaacagaaaaccaaatagcacattttctctcctgtaagtgggagctaaacattgagtccacacagacataaagaaggcagcaacagacactggggcctatgggagggtggagggtgggaggaaggtaaggattcaaagactgtctcttgggtactatggttattacctggctgaggaaactatctccacaccaaacccctgtgacacgtagttcacctatataacaaacttgcacatgtatccctgaacctaaaataaagtttttttttaaaggagatcattctatatgtactgacatgtaaagacatacatgatatattaaatgaaaaagattatagaaccataaaaattcattgtctatacagaaatgttatatagtttttaacttagaaaaattgggaagttacattatttccaatttgagtctagttttaatatacctgcaatgaaaatcttgctgtagaaatttagtgtgtatgtgagtggaactattcttctggtgggttttgcataacagactattattccataagactagagtttcagaaagtactccaatttgttactcttttaagattattactatagactgtaaatagctttctcgaaaacttaccccacttcacaaatcaaattaatgctttatttactgagcatcgatgtgttatgcagagcaggtgatacacaaataaatgaggcactgcttttgacttcaaagaacttaaaattatatggaagataaataggaaagattgtgttacattatgttttaacatcttgagtacagtcttattgcagggcttaatgtctcaatttcctctagatttcatccctccagattgaaaatggcagcacagaataggatgtgatgtgcaaattacatcgtgtctatactgtctatatttaggattcacctaacattcaagagtgcatagctcattctaaatggctgaaaatattttatatgaaatacattggttttaatattgctatgatgaaagacaccaaatcctcacaaggtgtgggagaggacctctgaacgtgggaacccggacttctcccgaaagcattcagttcccacctaaacccacaaagatgggcagatgcccctgaacacttacgcttacacgtgggcggcttccccttgttactccacaacccatcttcttgacacacggctgttgcttgctggctggattcaagcttgaagccctcatgacattcatagaccactttactgtccaaagtgaactcgttcccggtaaatgaaccgtttcctggggattctgggattccacaggacacagctgaaaagaaatgaaacaaatgtaggcttattcttacagaaattattttccagctattaaaaccattgattgattaatcattattattgactccatttttcattaaaattgtgaattatatttctttttttttctttcttttttttttctggagacaagagttttgtgctgtctcccaggctggagtgcaatgactcgatctcagctcactgcagcctccacctcttgggttcaagtgatcaagtgattctcatgcctcagcttcccaagcagctgagattacaggtgcacaccaccatgctggctaattctctatttttagtacagactatttatgttggccaggctggttgccaactcccaaactcaggtgatccgtccaccttagcctcccaaagtgctgggattacaggcgtgagccaccatgcccagcatgaattctatttctagggtatgggataagtatacacattttcaaaatcttaagtatattaaaggttaaatgaggaacaatggaaaatgggtcagaataaaagctcttcataattatttttctggaagataagactgaccactctcatgcagcttagccgcagtctgacatattttatcagagggtgtggccacgggagcacaatgtcacacactcaacttcatctcatattggaaagaaagaagaagggatgaagcagcatctttatcatcacaatgcttattgcagtgtagactctttggtgtcgaaattcctaagaatcagccgcctcagctctgaaaagtcttccctttttattgttcctctccccttccccaattcattttccctaaagccccaggaagttctgttacaagaaaacacgacataaggaattgatagaggaggcactcggggaagattcccagggcagaaggcagcatctagtggggatgtggaccgctttcacgggaaagaccatgcaagaaagaggtatgcatgcagatgaggttttataaaaaacaagatttggggagaattctgtgtaaaccctttcttcttaaatttgctatgtctgatccagatgtatctactatgggacaagaaaaaaattctcaaacgattacatgtgacagtcatgaagccaacaagcaggcagagggtgacatttcaataatcacgtacccacttcagctgcactcataaaagaaaagttctatggtaactaaataaagagccttcttttactcaatcagtattaaagatattgttcacaccatggatttaaattcagatagttcaaatttttcccatgtagattctaatgagaatatctgtgtaacaagatagagcgggaagggctggatgaagaaatgtatataaacacataattctacatataaagaaaatgactaacctaaggtgacacaatgacttagtaacctctggccagagagcaaatcttatgactcccaaacgagactattctctcttctgcaaaagcacaggttatctccggtattgttggagttccttggtttgctgtattggttctttcttctttaccaaaatattaaataaatacaatgggaaattgccagagaagtaaaagaaaatgtattccccaataaaatccaaactcctggaaatttcaagctctaaaatgtctcatgtttaaatggatgatcaggtactgcaaccatcaaaaatacatgtgggccgggcacagtggctcatgcctgtaatcccagcactttgggaggctgaggcgggaggattgcttgagtccaggagttctacattagcctgggcaacatggtgaaaccctgtctctaccaaaaatacaaaaattaggcagatgtggtggcacacacctgttgtcccagctactcaggaggctgaggtggatggactgcttaagcccaggagacagaggttgcagtgagctgaaattatgccagtgcactccagactgggtgatagagcaaggccctgtctcaaaaacaaacaaaaaacacatgcgtgtgtgtgtgtgcacatgcatatttacatgtgtgtacatgtgtccatgtgcgcacgtgtgtacgtgtgtgtacatgtgtgtagtacatgtgtgtatggcatactacaataatccatttgcagtagaaggaaaacgaaaaaccacagacataaaggcatcatttggggcaaagcatttcaaataataaataatcatctttggctctgtggaagcaacagatctgtgggaagactgttggcatgtggaaaatattcatcttaatttcctgaatgcagtaaatgccagagacccatcctttcttttctgtatctcacaatgttccaatatctagcttcctcatcattttctctcagatttcactctgaaaatcacgtgttcatgatcgcaagccttaatttttctcccactcgctggctggaatgtgcgcagtgttcagcttccttaaaattctcatttgggcagagcagggaaagaaatgacatttttctatcggacgaaatgggaaagatgacattctacaaacacagatgaagccccatcacaaaacaattcatactcgggagaccaaagcagaagatctttatagccccttctgttacatctggatgcttatttgagaagtgaacccctgcttgcccaggtcttaagacaacccattttatgttgcctgatcaacaaccgggaatctttttatggttttgaaccacagtgtttagccccttaagcgtcttaacaaaaggctatttggtagatttaaaataacggttggcaatgggtcaaaagtagaattataacacttctgatttaatggagacacagcataatccttatggactaaaatcaggctcatgggatgaagacagtttcctgctcaagtttagtattcattcatctctcatttattcccaaaattttgcatgattgctataggataggcatccatagatcactatttttttaaaaatgcgaattagcattggcaatgtaagaaactttcacagtttggagaatttccttacatttggtatatccaaagagagtaaaattcctcagttgttttttctttagttgtactaaggtattattatatgtcccagcagcttaggcgaataatcatttattgatcctgtaaagttaaattttgtttgggagcacaggcctcaaactcagacttctgagtcagttcttgctgtacctctcaataacagtgtggcttcagctaacttacttaatgaacgttgtcttcttacgctcaggttattaagacctatgtcaaaaggtaatcaggagggttcaatgaaatcatccttacaaaatgcgagccctctgtccacacgacataggcattcaatcaatgacaaattattatacgcagaaaatctaataattatgttataggcagaatatgttttgtattacacatacacacataaaatttttacttatttatttgcaaataaaaatattagttgcaaggattaactctctgttatctacttattaaagagagcaaagagtaagttggtaggtagtaagatggcttacttcacttacatatctcatgagaggtgtaacagtttgatttcaaaaaagtaagtagaagagacgtccagtgttgtctgaacctttaataccacaaaccccacatgggatttcttctttggatatctaagatccttcaaatagtggttaactttgtttccgcaggcttaaaacgtttctctgtttttttctttttttctttttgagacaaggtctcgctgtcactcaggctgcagtgcagtggcacagtccaggttcactgcagcctcaatctcctgaactcaacccatcctctcacctcagcatccccagtagctggggactacaggcccaggccaccacgcctggctattttttgtatttttttggagagactgagtcccactatgttacccagaatggtcttgaactcctgggctcaagccatcctcctgcctcagcctcccaaagtgctgggattacaagcatgagccactgtgcctggccagcctgaggatttctgaggatttttaagtatttccaatgtaagaattttttattaaagatacgtatttatatgaatatgtatatataactttaaatatgtatacacatatgaatgttaggattttcaagtatttccaaagtatttaagaattttttattaaaattatatatgtatatagaagtataaatatatgtacacatataaatgctaatcaaaattgtaatataagaatattctagattactatctacataggttgtactatacaatattagtgcctgccatttgtttttgagtttatgttcatgttgggccaagaaataacagttaattttttgcagcctaaagagaaaaatattagagacagataatggagaaatcatgggtttgcttcaagagaagaataagtgactatacagaaacttccacaaatataagccatataatgcttatatggtaagaaatgttgaaaagatggactcattttacacgcaaacacacacacacgtggtaaatacctatgagtatcatatataatttttcaagtaataattgaatttcataaaaacatcatcatcttaatggttattttcctcaatttgaattgtgtaagttaaatatgcatttaacttgcaaatacaaatatgcacgcaaaacattatgtttgtatatatttagtaagattataatcaaataattaaattcaaaatcagggtcattaaaacaccttaggaaacactaacttaagggaatcatcaactatatgtgtatttgcaggtatgtgtgtgtgtttgtgtatatatatatgtatacacacttatagctatatgtctgagaaaacatatataagtacatatgtgtaattatgtcttattttatacatgattttatagttatagtgttttcacatcatgcttttttacttaattttcactacaagcctattagatacaaacgttattcgactttcttacagataaagttacagatgctaacattttttatatcattttccccaagtctaatagtcattaaaaggctgaggcctcaaaacggttctgctgaattcaggtagactttctcatcccattactaaagatgcccggactattgtgattatgtattttcaattttaaatctatcagattagtcttcactgaagttttcataatttcattttcagtttaaaaatttatagtggttccttatttcccgcgacactgaacaaaaactacattttttgtcttcaaacctcaccaaaaccttcccctactctccgtaactttccaccgcctggccagcagaccctcgccaagtatccacgccgcccagtcggcttattctcactttcttgccttagttttctctgggttcttccgttctaccccaaatattcttcttattctgcacctatttaagcctactctagagcagaaaattggcttcaaccagcgagtcctattctcatctgattggtagtgctattgtgtgcaactgtttgtaatttagcaaatatttatttaaataaaaatattgcttcacaaagttatatataactgcactttctatagttgtctgtattaaattaccgtgtgcattgtcttcttaaaattactagtactttaaaaataaatatcaatgctgcttcaacagatctgtgcattctgaggcccatgaaaccagaatattagacccgtatttgtgggtagacagtaaatatatacaaatattttgcaatcattacaatttgcattaccaactttcttgatacacgaaaacaatcactagttaatttttcaataaacatgatcctttttggtgctaattgctgacaaatggtttaatcgcaacatataaggtgctaagacaggaaaaaatacacagttgtcgatttaccatgcaataaataccaggcctctagaaagaatgtttgtgccacaacttctcaaacattaatgtgctccttatccccaggccatgctgatggcactaatatcctgatgaagtacatctgggggagggggagatttgagactctacttttctaacaggctgcgtggtctcggaggagcaaggatttagactatcctaaatgccctagggaggctgctaagcctttgcccacacacggtttacaaacacctgctatataattcccctgctgagtgtcctagcaggatccacacaaatgcctcaagtaccctgcagggacctcccacctcctcctccattctgaagggtttactaccccttgctgcttctctgaatgcactttgctcaacaaccagccctctctttaaaaggaaggtgtgatgttggatgttgacatgtttggggaaaggaggatgtgttggtgatttttttttccgctaaccctgcgctaaagtgagaatcctgttccccgcatgtgtctcctcactattggatgagaccataggagacgctgcaagtgcaaatgaaggtctccccatcccatcaaagcgtattttagcacgactattaataataatggcttgttaagaactaaaaaaaaataaggaaaaatattaaaagtaacataagaagcaggcaccccagacatcaaaaaaaaaaaaaaagtgcccttaaaaaaccaggataaacgtttaccaaaaacacgagggcttctgtctttataaggtgatccttgcactcccttccctgcacaactttttctctgcttttctctgcaacaactcatgctttttaagcaacatcctcaggacagcctctcagttaacagttttcgagaaatgattgtcatgtgggctgtttgtgagccgctgtgaagcgaaaatgctgtgggataagctggagaggagaggaggggacacacgactcagggcccaggtgacaggcatgtagcttataggaggcacgtcaggacacccttcagagtttgaagatgggcagtgacaccaactcatttgtgacctgataaaaccctctggttgccatcaggagatgaacggagagagggtcctgagtggggcagacgtaggaagcccagtagggcagcccatgagagagaggagagtggactgggggaggggaaagatgtggatggacttggacccactgagtagctgggaccaacagggtgtgggagtcacaggaaagactttatgtgcaagcaagagagagaagtgattcaagcagttggatagactgagatgctaatttctcaaacgggattcacttcagggcaagtagattcaggggagaaaggagttttatcttagcagtgggatcgtgaggcacagtgggtactgcaattaggcagtgggtattaggtctggaactgagaaggaagggcaggcagcaagtgaagaccatgaagtatttctaacatttaccgcaaactggaataaagtactttccggctctttctatgccttattcaaattgtgagattacatagctaagactatacattgagcctgtcctaaaaattactaacaacttttttttttttttttctgagtctcactctgtcgcccaggctggagtgcagtggtgtgatctcagctcactctaacctccacctcccgagttcaagcgattctcctgtctcagcctcctgagtagctgggattacaggcgtgcaccactgtgcctagctaatttttgtatttttagtacagacagggtttcaccatgttggccagactgatcttgaactcctgaactccttgaactccttgaactcctgaactccttgaactcctgaactcaagtgatccacccaccttcgtctcacaaagtgctgggattatgggcatgagccactgtctattaacaacttttaaataataaaaaattactattagaacagaccacttacttggctaggaagttagacttgctcacaggcatgattgttgtaagttggtttacaagcacttgaaatttgatttcagagacttaaattcatgtttcactttctccatcaacttgtgctatggaaacaatcaggtatttcaaatctgatacaggtgatagcccccatcatgctttgaatgcatctcctccaaaattcagttttcaatatgatagtattaagaggtggggcatttaaaaggtgatcaggtcatgagagctctttctttgtgaatgggattaggtgtccctataaaagggctttatggagcagagtcatgccattttgtcctcctgcctcctgccatgtgatgacacggcattcctctctccggaggagagatgctgtgggtatgctgtgaagtgtctgtcaatttcagcttcatgtttgttacctcaaagtgaacaatggtgtgaaaccatgatcaaatatgcacatatatgtgtaggaactaaagatttgtatagttattttatactaatgtttataatatgttatagaaacagaataggatgcttgaaagaacatagatttagacatagcaaagtctgagtttggtatttgtctgtttgtttatgactcggacaatgtatataaagtatccaaacctttgcttcctcacctgcaaaacacaaatcacccatacctcctcagcaggggttctttgacagatgtacagtttacaaagcaaaacatctggaccctactaggccagcagcaaatagtcacatttattattttgtcatgagaaataataattttccttcagatttaatgtaaaagaaagcatttttctggtttttaaatgaaggtcagctaaaacctaaataaatatgaaagaatatttttacttttcatcagaatgttcgggacatttaccatcaaatgttttctctgcaccgtggatatccccttatgccactgtcaatggaatttaggatgcactcgagcaaacactgggagacgtgaagcttaatccacagttggccaggggttgacagtgtctcctcaatcatatgacatcttgagcttacacgaaccagcaccgatccatatacaataaagcactgaccccatgactcagaaagtcatatacacaggtggtagaaatgacaaagttatagcgaaatctctatgtttcaacattactgcctttatcagtataatatctgacatcattgatcaaatacaaattccctgccattgtgaaaagtttttctaattgcattacttcatttaatcttggtaacaccctacaagatagactctattttttttattacttgtaagaaaagtgggcattagaacattatgcaaatcacccacattcttatgactagtaaacggctctgtgaggggtcagatatcagagtagctgatgacgaagcctgcctttcagttactctcctgtgctgtctctgggctacacctgacttatttcaccatatgtatatttactgttattttcaatgtccacctatcaacattcaatcaatcacttagaaatacattttcaaatatgattctgaaaatacaaaggccacattgaatttgagcattaatgggaatatttctgggtcctttcttttttttctattttcctcccttatctttgatttccaaaatattttcttggaataattaggcaccaagaaacatcttatttgacatgtagccatcatccaatataccattaataccatgctgaaggctgagatagaaaataacagcaagagaggaggtgcagtacggagccacctctccacccacggggatagaactggtcacactgcttttctttactatgtgtaggtggtgcgatgtcgggtgtttccaaggagtaaacaccagcaacagaaatattcttccgtttgtttgaaaggataaagaaaagtgtgtctgaaaatgaatgtccatagagggaactaatgacttggcttttgcagacactaaagcaaacttaaaaacaacaacaaaacaaaacacattaaaaaaaaaaaagcccagcagctatgaaatgcaaaattgaggataataggattgagcgagaagtatctttagatgttctaatcctcttgaaaatatctagcacttcataacccaaggaagaaaaaaaagcatttatgaatttgaaacagacaaaaaagctatgaaaaagaaggcagcagaatagggttggcaaataaacagctaattattacagtgaaaggctctggcttggcaaataaagcctctagaatgtttactcaggggtaaattggctgctcagccaaagctgtgcaagtaactgacttttacccatctacttttagagtgttgttcaaaagagacaggtacaaacatttttaaactgtctttttttcggaatataaaacaaagatttattcaataaaaagaaaattcctagagaaaaaaagctggaggaacgtaaagtgacactgctgtgtgtcataaaaaactctgattcggatgccaaccaccaatgtcctatggaacccaagagtcccaggctcactaagcatttaatcaatctcgtatcataaaaacttacagaaggattttatgcacgctctttgtggccgatttcaaagggaatctgcattttggagcctatcctcatcctccctgataagtgggcttgttgggcatactctggtaaactagtcaagcccagaagcacatgttgtctctgataatgaacaagtgacttaacctatttcagcttcagttttaccttctgcaaaataagaataaaaacgatagcaaaaactaggaaataatgagtgctgacaaagatgtgataaaattgaaacccttgtgtactgtcaataggactgttaaacaatacagccactgttgatgacctatggtggttcctcaaaaaattaaaaatagaattaccatatgatgcagaaattgcacttctggctaaatacccaaaaggattaaaaacttgtacagttatgtccctagtagcattattcacaatagctaaaatatgaaagcaatcgaagtgtctgccaagagatgaatggctaaaccaaatgtagcctctacacacagtgggttattactcagtcttaaaaaggaagggaattctgacacaccacatgctacaacatgatgatcttgaagacactatgcgaagtgaagccataaaaagacaaatactatgtgattctacttatgtgaggtgcctagagtagttgaattcagagagacaaagtaaaatgatggcttgtaggggctggaggaggaggaatgggaacttgtttaatatgtgcagagtttcagttttgcaagttagaatagtccaccagagatggacagtggtgatgattatacaaccttgttaatgtacttaacaccactgaactgtacacttaaaaatgaaaaataataactatatgccacagatgcacggtcattaggataaagttagatagggaacattaagtcttgctgcacaatagccaatcagtacttttcaattttcattctctttcatttacaggtgaagaaatgaagcagcaagcacagctcaagctgcctcttagaggacacaggttactgaatacgttttcaacaaaatgaactttcaaggcctgataaattctcaaaacattgatctgaagtttggctacatattaaagatatgatttggatttgtgtacctgcccaaatctcatgttgaattggcggggcctggtgggaggtgactggatcatgaaggcagctgttctcatgatggtgagtgagttctcaggagatctgatggtttgaaagcctgtggcatttcgcccctagctctctccctcctgctgccatgtgaagaagggacttgcttccccttcgctttctgccatgattgtaagtttcctgaggcctcccagccacgtttcctgtacagcctacagaactgtgagtcaattaggcctcttttcttcataaattacccagtctcaggtagttatttctagtagtgtgagaatggattaatacaattaataagaatagtaaacacagaaaataaagaagaaataaacatatgatccaaacgtggaaggttgataagaatgttgactacagtaagcaaaccagctgctgagaataaaaacatccccgcattttctcaaagttggccattacaaatccttacatggttttgcaagaaatgctttatgggttctttccgaaaatgtgattctgattatttagaaataaccagcatgaggttaagcaaattccaacttaaaatctcaataaagtaggcattaaagacaagttaggggcttagtttcagaatcaaggaccaaaaatctttttttttccttttattcccagggtataagcaatgtggaagggagaaaattagagaacaaaactttgaaaacgagtctattccatgtgcactgggaaacatggctggaggagtttgcccatgcttccttctccagtgggtcaggctaactttttacttaatggaaaaagtaaacaaacagatgtacctggactagaatcttcacaggcacatctaaagaagaaataaacctggaaatcctcatttcataaataagcaaataatgtgtctatcattaaatttcaaaaagaaaaatatataaaaagaaagatatatagtgatagataaatgacagatgatagagtagatagaaagataggaacatacacagagaggaagactggaatatgatacatagatagatagatagataggtagatagatagatagacagacagacaacagatagaaagatagatacatagataagtggatagataaataggtcaaaagaaagatagaaaggtagatggatagattgctaaatcagtagagagatgataggaagatagatacatacagagagatatagatagaaaaatgatagacaataggaagatagatatatataaagagataggaagatgataggaagatggatacacagatggatagttatatagaaaggaaaatgatagatgatagatacatagatacacagatcgataggaagatagaaagataggaagatgataggaagatagattgatagataaaaaatgacagattgattgatcaatcgctaggttgattggcaggaagacagagaaagaaagatgatagataggagatagcctacaaagcatctgataagtattttctcaaaatataaaaggaaaattaggcataaactaaaatgcatggataaatcaaaagtattaacaaagctgagaaactagattccctagtgataaaaggcaagtagcagaaaccataaaatctggctcattataaatgaaaatgagtgaagagcgtagtttctacagctttgaggttatcacccactaagccagccagagtctttctccgagcactaaataaactataagcacaatggcaaatgactgttcagtcatttaaatgaaaaattcataataatgggccaactttccaaccatatttccaaaggttacagaaaaattgtctattggcaattagagaaattgccaaaggacaattcaaaggagtgcgggcctattgaggtctgtccctgcttccaagggctgctggttctagcatcgtgtacaattctcttggcacttaaactccgcttcattaacttttctactacaacagctaatgaaatgaagcatttcaatatccaaactccagtaattatttaaaacagatttagattcattcaaataaatgactccatgaaaatctcatagttttagctctatttgaagctcaacatggtcagagaataagtcacacatatgaagatacagagaatcagtgacagaactcaaatgagaactcccttcttgctgacttttccattacgcatttgaacagaccctgcagccaacaagaattcattacgcatgcaggtaaaatgaactgacgacatgtattttgaagtggactctgggggtcctttaattcttgagtaatcatggcttccttgtgatattttgtcttaatttctgaggaatttcaaatacagacagacaagagagtaatagctttagtaaaacaataatcacctgttttaaaaacacaggacacaatcgtatttgtcaaatggctctgtagattccaaacagactgaaggctggtcataagggagattaccaattctgataattgcatggtaatggaaactccacggagaacagaaaactgagctacacagaaaattggaaactcttatttaagctcatttctccacaattcctctggcctcaaaaatgcatggaatgaagtgtcagagttattaacagttaatatgaaattattacttgtagtgtctttgatcaggctaagtaggagcttctagttaagagaagttgatgggtgtaattaaattgctaataaagaggtacagactgacgaaaatccacaaaggctttcagaggttaactgatttaccacccctccttcaacctcatctctttcgctcagcctgtgccaggtgctaagcctggggcctggcacagaacaagaggtcaatacaatcagtctacggaatgaatggaccccacgtatgcacctctcgacctgtctgagagtgtcagccaacaaggtgcgtggcaatgttattcccaggccccatgcgtgagacaggagataccatgatactctgtctcttatcgtgacgtttttccaccatttccaccatgtacaaatcattaccagacgctctcacttcctttgtgcctcaaatgcccatcttttgacctcgatgcctccccgcactccaagcatagccatctcatcatagtccactgtagcttccttgcaggctcatgcttctttcaagttggaggagattatattggtttactgaagcaagtcccatttcagaagcagaaacattgaatgattttctccaggtccacacagacatttaacagtaaactgagaatcagaatttaaaccccagtactcctgatctaaagtgagctcaactctaatgtcaccatccttctcaccatattaatgtataatatatagtatataatatataaatatataataacattgatcaacattcttcaattaacatataataaaaatttatattcactaactagattgtatatgaaatatacaataaacgagtggttttaacaattatagtttatatcaaatattaatgtttaataataataattttacaactttatggtttctatccttggttccatgtgctgtaattacctaatttatcttactgaattctcatactaacaatatgagtcaatattattaccctccattttcaggggtcactgttgtccagaaatattagatgatttatccagagttcatctagtaaggggtaaagccagactctaatccaaatgtccagctctgaagtgtgtgttccttcccaataacagaatggctttttgttgtaataaataaaataaaaaatattttatggtttgccttttcccttatatttctatccaaaagggaaatctcactgcatgtgtcactaatgcctcaattatttcagatttttcaaaatggcttgaacagaggttcaaacactgtctcaggtagttttcaccatttctctctgtggtaattttcttcttgtcatttctaaaaaatgtgaaaactttcttcatagatttgctcatgttcttttttcttttttctttttgcagtatgttgaatcccacaggcttcaaagaatatgtcactttttcacctaacataatttaccactcactttgtgtagaaaaccatgacttttttagactctccaagactcaggacttctaacaaaaaatccccacacttcacatcatggaaactaaggaaaagtctgttgcattctaaattccattaatgacataatattaataaataaatacatatgcacatgtgtattaggccattctcgcattgctataaagaaatacctgagactgggtaatttataaagacatttagttggctcatgtttctgcaggctgtacgggaaacaaggtgctggcatctgcttggcttctggggaggccttaggaatctttcaaacatggcagaaggccaagggggagcaggcttctcacacggccagaagaggagcaagacagagttgagggggaagtgccacacacttttaactgaacagatctcgtgagaactcactatcatgaagacagcaataagtcgtgagggatccacccccatgatccaaacatctcccaccagacattacctccagcattggggattacaattcaacacgagatttgggcagggacaaatatccaaactatattatttctcccctgacccctcccaattctcatatccttctcatattgcaaaataaaatcatgtcttcccaacagaagccaaaagttcataactcattccagtattaagcctcatctgagacaaggagagacaaggcaaatcccttccatttatgaacttggaaaatcaaaaataagtttgtagcttccaagatacaatggagatataggtattgggcaaactttcccattccaatagggagaaattggccaagagaaaggggctgggccgggcgcagtgactcacacctgtaatctcagcactttggtaggctgaggcaggtggatcacgagatcaggagcttgagaccagcctggccaacatggtgaacaccctgtcgctactaaaaatacaaaaattagctgggtgtggtggcaggcatctgtaatcccagctactcgggaggctaaggcaggagactcacttgaaactggaaggtggaggttgcagtgagccaagatcacaccactgcacaccagcatgggtgacagagtgagactctgtctgaaaaaaaaaaaagaaaaagaaaaagaaagggattacatgccccattcaagtttgacacccagcagggcagtcagtaaatcttaaacctcccaaataacttcctttgactctgtcttacatccagggcacaccactacaaggggtggtttcgcaaggccttgggcagctttgcttctgtggttttgcagggagcagcccccaaggctgatctcagcagctggagttgagtgcctgtggctttttcatgctgagggggcaaactgcttgtagatctaccattctcagggtctggagggcagtgatcccttctcacagctccactaagcagtgccccattggagactctgcatggggtttcaaccccacatttcccttggcactgccctagtagaggttctctgtgagggctctgcacctgcaacaggcttctgcctggatacccagggtttttcatacatactccaaaatctaggtagaggctatcaggtactcttcattcttgcattctgcgcacctacaggcttaacgccacacggaagctgtcaaggtgtatggcttgcacccttcggaacggggtctgagctgcacctgggcacttgtgattcaaagatggagccagaacagccagtatgcggaaagcagcatcctgaggattcacagggccgtagggccctgggcctggcccacaaaatcatcttctcctcccaggattctaggtctctgatgggagggtctgccataaaggtctctgaaataccttcaaggccttttccccattgttttggaatattagcacttagctcccttttagtcatgtaaatttctctaacaagtagctgctccacagccttcttgaactcctcttctgaaaaagcttttttcttcctctgccacacggccagcctgcaaattttttaaacttttatgcattgcttcctgcttaaatgtaaatttcaactttaagtcatttatttgctcctgtatttgaacataggctgtataaagcagccaggccacatcttgaatgttttgctgctttgaaatttctttaaccagatacccaactcattattctgaagttcaaagttccacagatccctagggaaggggaaagatgcagccaagctcttcactaaggcataacacacatgacctttgctccaattcccaagaagtttctcatttccatctgagaccccatcagcctggtcttcattgtttatatcaccattagcatttttgtcacaactatttacccagtctctaagaatttacaaactttcctttatctccctttcttattctgaggtttccaaaccttcccaacctctgcctgttacccagttccaaagctgcttcaacatttccaggtatctttatagcaatgtcccactccttggtaccaattttctgtattaggcaattcttacattgctataaagcaatacctgagactgggtaatttataagaaaaagaggtttgattggctcatggttctgtgggctttataggaagcatggtgctggcatctgttcagctcctggggagacctgagggagattttaatcatggcagaaggccaagggggaataaccatgtcacactgtcacagggccagaacaggagcaagaggtgggtggggatgccacacacccaggtctcaaaaacacttattatcatgaagatagcaccaagccatgaaggatccacccgcttgatccaaacacctctttccaggcccacctccagcattgggcattacaattcaacatgagatttggccagggacaaatatccaaaatatattagtatgtatataatttcatgctgaaaggatcattaaaatgtaagtgggagatgaacaatgagaacacatggacacagggaagggaacatcacacaccggggcccatcacggggtggggagcaagaggagggagagcattaggacaaatacctaatgaatgcagggcttaaaaccaagatggtgagttgacagatgcagcaaaccaccatggcacatgtatgcctatgtaacaaacctgcacattctgcacatgtatcccagaacttaaaataaaaaataaaatgataaaatgtatgtctaacatacatttttaaaaatagaaactcaagccatatgccccaaagtaattttcaacctcaagtggattatttctcacatgattttcaaatttaaaaataaatgcaatattcattccatttgaatgcataaggctttttggaaaatgtgagcaaaaaaactaccattcatcaacaccattacagccactaattcacctgacatcaaaacagcctaaatgcagacagtccatctgaactctactccatggattcattgcaaatacgtcatttcatatatttataatttggtcaccaaacctgtccagttatgaaggcagcatctatcacagaacactgcaccatgtgcacataattgaaactcctgtgcccctcagttgatctctactgttttactcctcatgacacctggaagcaacccttccagtaaaagaaatgcgcatgtataatccactggtctattaacagaaaacaagcatggtaaatgattttctggataatgcattccatacaatgctcgtctaagttattttttagaagaaaatcaatagtacctcagaaaggttcaagagtaagagtgaatggcagaaagtctcgagtctcagggcatctgagatcaattcttccggagtctatgtctgcacagattcaaactattacaattagaggtcgaaagttttgtttacaaacttttacatggaagagtccaattaatgattttctctattaagctgaccaaactaggagtatggaaccgaagaatatatcaaaccaatccacaaaacaaatgctctgaattagaatcaacaatgaagattttaacaattaattatcaccctctaaaaaagcatagctaagaacaagcttcagaatttttttaaaccagtcatagaataaatcaatatgccaaggaggtattattttaaagaatattatgttaatatgaaccagaaaatgttccaccaagcttgtcatgtcatggtcaaaatacttggaagagcacagttcttggcgtaggtgtttatgtgcatgtgtgcctgggtttccagcccaaattaaagagctgttggaacaccctcagatgtttcatttgtgggcctccttttaatagtatcccaattttaattagcactagggaagcagatgtggcagagaaacgatgccaagaatctgaacttttcatctccacttggagtgaaggcatgaggttcttccatttcagtgcatagcatcgtattggttagcacagcttgccgaatatctgaatactggtcgatgtatatatataggtgtgtgtgtggtgcccacttttcagtattaatgggaacataaatatcatgttaattcagagtaatgcaaaacccagtatttgccttcaagtgtcagataatattaagaatagacaaaattggcttggaaaaatctccccagtcaactcttctcctaatgaaaaataaaatcataaaattaattttttccactcttttttgtaaaaatgaaatgcaaccctcccaaattcccagtgctatttcttaaagttagttaaaatgatgctaaagttcttaaataaatacaaaagtcctattgtctctgatgaaaactttgcaaatagagtgaggaaaatgacttgaatgcatttgatatgaaaacatattattgttatttcaattaaagcactatggacttggcataggaaatcatgcatgtaaacagaaagaacagcatgtccagaaatagatacccacctaccagatgatttaacatagaaagtagttggaattttaaatcagcaaaaaaaaattagtggagaaaataatgaaaataattacccagcaaagtatttaataaatgacactcagaaaactgggtagccatctgagagggtgacatcttaaaacaggatcacactgagatcaacacagattcactctagaataggaagcaaatacttacatgtataaatgaagcaaagctacagattagaaaattagtagctctatgtataaatgaaatcattcaaactttagaaaaataaatcaattttaacagaaaatagagaggacttttctaggccacagttcataaagattaagatgtttcaattcatagactataaaagacatttgaaatacatatgactgacaagtggctaataaattattgtacaaagaactttcaataaaattgaataaaaccaaagaaaaatgagaacatgaactttaaaaaaatataaaatataatggtcaaaaaattaccaaaaaaaaaaagtattctctactgagtaatgatcaaatgaatgaaaatggaaacaatgagtgattttttttgtttcattttgactgttagatgtgcaagaattaagaagattggcaattataatgatttctttttattgcaacataaattattccacacatagaggcccaaaacagcacacatttattccaacacgatttctgcagttcaggtacgggcgtggcctcaccctgagggtggcagcgggctgctttctcacctggaggcgcgggaagaatccacttggaagatcactcaagtggtggcagaaatacgtttcttgcatttgcgcagctgaatgtttcctgactggctgtgggctctcagcgtccagaggccctgtgttccatgttctgtgtctttcttcatcttccaagacagctacaaaggctctccctcacatccagtctttctcaggccttcaatctctgaccagtaagaactctgcccctagaagagcccgtctggtgaggtcctacaatctgagcacattctcccttcctgaagtgtgtctgtgccaacaacataacgcaatcacgggaggagggtccaccgcacccccaggtccatagggagctgtctacccagggcgtcggtcaccccacctcctcttaggattctaccttcaccaggctcctcaaacatagaagcttccagaagcaagccgtcacacctgtagtggagcagcctatttggattacccgaagatcagtttgacaagataacccaatatgtcatctgttcattgcctgtatttcactttcaagaaattgtatcctgtggcaatgagtggaagaaagtgcaaagatgtttctgaatgagtatgcatgtctgcattttatctaatagttagaaacgacataactggtcattgaaattgcaataaatatacaaacatatattttagaatagaatttttggcattttattataatttttggatataaaataatgtgtatgccatatcatggaaagtgtgatatcattcaattgatataaagacatagattatagatataatagatatgtttactgatgtggtttgtatctatgtccccactcaaatctcatgtttaattgtaattctcagtgttggaggtggggcctggagggaggtgattggatgatggggccggatttctcatgaatggcttagcaccttccttttggtgctgtcctcatgatagtgagtgagttcttgcaagatccagctgtttaaaagcatgtaacacctcccctctcactctctcttgctcctacttttgctaggcgatgtgcctgatcccccttcaccttctgccatgattagaagtttcctgaggcctccccagaagcagatgctgccatacttcctgtccagccggagaaactgtgagctaattaaacctcttttctttataaattacccagcctcaggtatttctttttcttttcttttctttctttctttttttttttttttagatggagtttcgccctgtcatccaggctgcagtggagtgcaacggtgtgatctcggctcaccacaacctccacctcctggattcaagtgattttcctgcctcagcctcccaagtagctgggattacaggcatgcaccaccatgcctggctaattttgtatttttagtagagacagggtttttccacgttggtcaggctggtctcgaactcccaacctcagctgttctgtccacctaggcctcccaaagtgctgggatgacaggcatggaccaccatgccaggctagcctcatgtatttctttacagtaagaacagcctaatacatttatagaggtatgacaaaaacctaatagctttatatcagttttgtgggttgcagcttatttttttgtcccttccttttatatttctggactatgtaaatgtatttttatctgcagacacattaagtaagaaatacattggctgggcgcggtggctcatgcctgtaatctcagcactttgggaggccaaggcgggtggatcacaaggtcaggagatcgagaccatcctgggtaacatggggaaacactgtctctactaaaaatacaaaaaaaaaaaaaaaattagccgggcgtggtggcgggcgcctgtagtcccagctcctagggacgctgaggcaggagaatggcatgaacctgggaggcgcagcttgcagtgagccgagatcgcgccactgcactctagcctgggcgacagagcgagactccgtctcaaaaaaaagaaaaaaaaaaaaagacgttgtcactgtttatttttaaaagtttgtgtctgtattcttttgccagggctgccataacaacacaccacagaacaacagaaatggattttctcacagtcctggaggccggaagtcccaccgcaggtgtcggcggggctggttctgcctgaccctatctcctttgtgtgtagacatcatcttcttgctgtgtccctgcatggtcgcccctctgtgcacctctgtctctgcaggctaacttcctctttgtatgaggacaccagccacattggattagggttcaccctaatgactaactccatcacctctgtaaagaaagaccctgtctccaaatacagtcccattctaaggtactggcagttaggactctaacgtactttttttgaggggactcaattcaacccatgacaccaagtagcaggcagaacctgcagactttctatctctggtgccactgcccagtcacaggactctgtggctctgctatgccggagatgctccgattgctggaagatattcccataactgctctcactatttttaaaagttgaagactgcaccaccgctggcctaatttcaagctgtttcctcccagcaacactgtttatgttagaaacctcatgaaagaaaggattggtgagatggttgagccaaattcatttctccataaattcatattgatgacaactgtggcccaggctttgcgcaaaatgctggggattcgaaggtacagcagaatctctgccttttctttaagaagtgtgttgtctcatatgggtatatgattttttagattgagggtacatgtgcattttgctacctggatatactacataatgaaggagactgggcttctggcatactcatcacctgagtagcgaacattgtatccaacaggcaaccctcacccctgctcaccgtccttccttcctccctgtttttggagtcctaagtgcacttctttccatcctatatccatgtgtgcccaggtatgtgtgttaaacccatgctcattaggtgcctgcacgtctggtatgtatttgaaagcagagactccggacttcctggagcctgccaaatcagaatcgtgcagggctgggagtcaggaatgcattttttaaactttgcaaggtgagaaccattggtcatggaggactaaacagctgcacaaataggaaatcaaagtaagaaatgccaagacatggacaaaaggccacagtgggtgcctaggtccccccaagacacagcagactgcctggggactgagccctgaaatgagaagatgagaagcaactccacacctcaacaacagtgcatcaaaggtgggaaaacaggcaaagcacacactgtctgcatcgatgtggtctacatggacataaacacctgccttccagcctcagagcaaagcactcattctccctgtgatggtctctgggcagaagcctcatcctggctggcaggtccagccacctccagaacgtagtagtcacttcctttgaattgtttgcttatttttcctgtctcagctatctctaccttaagaattttggaaagccaacttccccagtagcctgaggcttatgcctgcatgcccatcggggccttacccactgcagccccgaccccggcttgcctacacattttcccccagagctgctcttctttctgccagggactgacattttcaaactgtcactttcacaggtagaggctgccgctgtgcctcttcaatgaaagaccataacctatccttcagtgtcagctggtatcttaaactgcacacagggcatttcactgtctttactcctctttgccttttactgatttaggagctgtcattttcaaagttcctcctgctgaagtggaaagttctgggctgactttttcatctccacttccatttgcctccgtttcctttatcctcacacgatccctttgtttgctttgtgaaatattttgagtattccatgtcaggtttatttctcaacgcgaagcacattaaactccattatagcatttttaaaatgtgtgagatatatagttgatctctattagccactcttatgcataggacccttgattcttttataaaatattattactttgcatattttgtacagttccttgtgcagaaaggtcaaggtcttcatatcactactactattatacaaaattaccctttttgaacacttccactgactacaatactgcttttattattagccacatttcacacagttagaataggtgaagttttgggatgctcgatgtgtgctaagcatggacagaggaaatgcgttatttaatttaatgaataaacatgctggattttagcacatggtagagcaaaattacatgtcttcagtaaaatgcctgacatataatttgcaaactgcagaaagtaactgatattgacggcgttggactctgcgtttcagtctgatcttggaagattaatttgatcctgggttggcagactatggcctgtgggtcgaaaccagcctgcagcctgtttttatacacaagctaaaaatggcttttacatcgtttttaattgtgaaaaacttaaagacaaagaatatgccactgagactgcatatgatccccaaagactgaaggtctacgtggccctttacaggaaaagagagccagtgtctgatttcagctaccatgaacaagaagggaagtatgttaccagcttagttacctaaacactgctgccttgacattcaacaacattctgcttgacagccaaccaataggtttgcaccaaaaacactcctgggtgcagacatgtctgactgcatgcgagttccttttttgttgggctcctgttcttagctggcagtatgataaaggtttcatgccaacatttgcgtttagtccttcaaaacgggggggagcacctttatgcccatttgcagataaagaacttcagtgaagtcacttgccctgtccagggtcacagagccagcaaatgctggggatgggaggaatccatcactcaattgcgggagcctgactgcaactgcactgcacagtactgtacccaagcactcctttcaaatcccctaagattgtgtgaggtagatttaagcaagggcaactgggataaacctcattttacaatatacttgatgggagttggccagtttgagctatatggactgtgtggattcacattctgataatttacaatctggctgacataatgcctacaacctatataaaagtgtgtgtctatatataaagagagacacaagcatactcacacatacatatcatagcatgtgatttgacatttaaaatcccagaagttcctatttaaatgtaagtttctaatgaaatctaaatgtctggaaatattgtattaatatcacaaaacagaggagaagattgataatgaaatagaagcaaatagatatgcatataaaaaaatcaagataaaagtctcaaatacctatgctctttatgttcataagtgaaggattttaagatttacaaaatatctcagttaattcatttatgccaggtctcctaacatatcctcctaacatttgagaatgatgttgttttaaaaattttgtataaagtaaaaggacagtttcctctgaaagatgccctctctgtgggcaaacatcatgtttcgggggtgaatgcagggtataatggaaatggcttcgattttggaatctgaaagactggagcttaaatcccacctgagataatgaggcattttttttttctggtaacatcatctgtgagcaacagcatctatgacgattgaagagatacacacagacatatccacgtgcatcctctgtcccctccacccagctctttgcaccagttccgtccttggccatgctatgtagaagcagaatataggcagctatctctatctaaaaggcctgactttaaaaacagaagcttaatcatgtaatttgtgagaaagactgttttttgtactctttgttgcctgcaaaatgctagcaaatcataaataaacaatagacaaactccactccaagcaaaagccacagctgatagaaggctctgagaaccagaccttgaaagtaaatagctgcctgggagttgctctctctttgaccagggaacttgaaagcagtgcactctgatgtgccagtttaactggatctttgagataatacagagaatttcagttctaattcaggcttctcctcaagatgaataagattagtgtgctgataatggaaacagctgcttggcagagtttcttgctttaaggcaggaaatgaagcctgaggacagaagatctgcctggctttatcaaggtcgataagaaccaacagagattttcagagagaaataatttaaaaggtcaagcaaagtgagaaaaacaacctggagttccctgaaaccaataaaatacattttgccggctccatcttctcactcacagacaattggtagcgaaacttttatttgctgaatccagaagctaattgcgagccatcaaggggtcttgggaagatctctgtccgggttgtggcctggggcctgccactttgaaccccacaattcgggatgggtttggagtgggtgcctcccaaatccccttcaagacctaacaatcataattggcatgcatgtaatatctgacggcttatcctatattatttattgaatcctctcaataattctgggacgtagatatcaaaatctctattttacatggcagaaagtaggcttagggagatcagggctccctggccttttgggggctactttggagggggatggccctcacaatgtatcctccaatttcaaatccgagtaatttttctctaaaaatatgatgcgtctacaatgtcattggcaaaaaaaagtgaattaaaatagaagacaacaaaagccaattctaaataatctttaaaaggaaaaatattctcccatatttatcttagaaagtgatggattagtgattttataaatttaaaatgtttaccaaatggctacaaggggcagggtattttgcccgggtccgagggacacagtggcatccacatggtttataagattggtagctggagggcctaaaagagaatgagctcaacgtgccaggtttgatcttgctcatttactaaaaggtacctgttgcattttagtaactatttgaatatattcttctagatatttttgtaaaggagaagaacgaatgtcctttatgcattcaggaagtttataaattgtatttattttatgtaagaataaacggactgcttttcaaatcattgagaaaaaaatagaatgtcaactcaaggatgaatgtaatattaaaatagatcaatatagattttaagttcccaatgccacaaagagatatttgctattttttaaaattatttttctttttttacagttttcaaataaaaattttcaaataaaataattaaataactatgatgacctttaagttggacgtggaagtcttaaaatattttaacatttgcattagtaattacattcccaattatctcaatgaccttctctatgatttattgcaggatttataaccacttttgaccaaatgtgagatactgtcagagtctaaactgttatttattttgtggtagagctgcctagtttgaaatttattacagcagatagtctttctttaattacaattttattcatttcgattggtccttataaaagttacaaagtcaaatatgataaagcaaatgaagcatccagtatcttaaactaatttaaaatccactgcctcattactggtaatttttaaaactccatcttttcttagcctcagagtcactactggggacagcttgccccgtggacctgaagcacaaatgtcaaaatcaatttcatgaagcttcctttccctcacatggtccttatttcactgagtggcaccaaatactcccagcaatcatgtcccccaccaacatatgtcatcccagatttatctcttcctttttacctgctttcacgagagactgtggactctgtttcctaagtattttcaatacctgttttcatgcaaaacttgtttctcactgtatttctggaagtcttcatatccctcaaacacacattgctataacccactaagaattcgtgtcttccagacaggatgcgtgccaatcattcattatgccacggaaagatcaagctttctaaaacacagatgggattgtatctcttttgctctttaacggagtctcgtcaagcaaggacaaaagctgaaagccacgtaaacttgcagctgagatttcctatgggctgctcctgccagcttctccaacccatcgtcctccaccatgtccccttcacattccagctcagacatcccaatatcctggaccttctctgctactcccgccggatgactatccattcctgctgactatcatattgacttgtacttatcagtttttaagactctctccctccggactagcagagccataagagctgggaatattttttattcaccttggtacccgcctgcagtgcgtaactcagagctaagtctgaattgaaaagaaaacagccataacttccttaatacttgtatgaggcttcagacccacagcaacaaccttaatgtacaaaaacagacacatagttaacatcgctttgcctgtactcttgaatacaaaaagaaacatgtcaagaaattatacaaaagataccctctccataaacatagcccttgtatctacttttattttggacagtgtgcttgaagcctagaagcctcagaggtaaaacctgtaactctatccctacagatgtgctatgtggagattctcatgtcccagctttatatcgaatgtgaacatctgcgggaaaaataaaatcatgaaaacttctgtgctgatttgggtggcgaagacgtggtgatgtgttaatttagctggggtttttgaaaattgtttttcccacgtggagttctaaacattttaaagaaagagctcacctagtcttctgtttcatatttcatttttcttttcttttatttatttttatttcataattatgaattgtcagcaattcaggatcacataaacggtgacgattcttccttatatattaactctctttaaacaaaaatgctagtttttttaaaaagacagaacatgtcttcaattttcttagaactgaaaataaaattctctaagtgtcatatatctctgcttgtaaattaaaattactaattaagattccaagaaccaaatagaaaatagggttcccttaatattttatttttaacaccagaggaaaagagcaacacatcgttgataatcagagtgctttcttctttttaaagtatttcagcctcaaaataacttttcgaatctataattttttttaatttttctgattatatatatttttgaggcagtcatcaaagggtcctatttgcacatcagtaaggaagtcgcttaatctgttatacacagccaaatgtgcaactctatattccaggtcatgctctccatccacggtgacagttaccataatttttatatatatatatatatatatatatatatatatatatattttttttttttttttttttttttttttttttggtctcattctgtctcccaggctggagtgcagtgccgtgatctcggctcactgcagcctctgcctcctgcctgggctcaagtcatccctccatctcagcctcccaagcagctgggactacaggtgcacaccaccacatctggctaatgtttgtatttcctgtagagacagggtttcaccatgttgcccaggctggcctgaactcctgtgttcaagcaatccacccacccaccttggcctcccaaagatgcttggaatacaggtgtcagccactgcacccagcctacattctatttttcgttattacactgtgaatcccttggaaggaaacaaatctttttgttgttgttgttgtcatttctccttgggtcagtacacacaactgctcaacatatctgtgagtggatgggagaaggtttctagcataatccacaacacaccatatgcaatttgccaaagaaaagcagctgaaaacccacaaagtctctttctgtcatatgaggccaaagtgtttctacaacttagggaagtatatacagcgtgtaaaagatctacattctagagctgggcagggtggctcatgcctgtaatcccagcactttgggaggctgaggcaggaggatcacctgaggtcaggagtttgagaccagcccgagcaacatggtgaaactccatctctactaaatacaaaaaattagccggctatggtggtgggtgcctgtaatcccagttacttgggaggctgaggcaggagaattacttgaacctgggaggcagaagttgccgtgagccgagatcacatccattgtactctaccctgggcaacaaaagcaaaactccgtctcaaaaaaaaaaaaaaaaaaatctacattctaaaagtaacaaaaggaaagtgtgtaattaatactaaacaaataaaatctctctttgttgcacactacaaaaatcacacatttatattttatatttaatatagctaaatcacctttaacaattctttaagcataagcaaaaactgttggggcataaattgccaatatatgttgtacaaccttatgctatttaaaacttttataattccttcccaatggcctttatccagataatcatttttactcttcattttaaaggtttaattttgtctttaaaatgataaaaatgctgatttaattgtaccacacaactttaatgttcaaaaatcctactttttgctacattttgttttgttttaagcattataatctatatatataatgaaaataattttatattataattaaaatgctattttacacaaattgtaaatatctaaaaggtgactaaaagaagtcttgcacaggaaatgaatttaagtgcttaaaatatagattctttcagaattagtatttgcgagattctattttaagtataatttcttctggcaaggaaaattccactttaacaatggtcaggctcacagaaagactgaattctagatcaacatttttatgattatgaagtcccttaacttttatgtgtttcagtttcaaatacataaaaataagtagttcaactggattgtttttaagatccctccaagtttaaaggtcaaaatgcatgaagaaaaaaacaaaaccatattgactcccaggttaacagaaaggttaacaggaagtgtagaaagtcacagatctgttttagaaaaatgatacttcttaaatattttataatttgagaacaaagtcgtgtaagttatttattgccaagaataaatctgaaggaaggtagtctaactcttcttccaaaacatggtgtgcattctagcatcccatatacacaaagccattgcctctctgccatgttccacacaaagaagagataccctgatcatgttcccacagattccttggccacagctgtaaagatgtcagaagagcctcatttgcagtgtgcactatttgtatttctgaatcatttaacttagcattaaatagttctgctggggtgtggggaggccatgggagaagaaagaagtcaagacttatcccaaacctatatatgtgacatcctttaatccttctcaaccattcactgaaagggtaagccatgtctccacctcataatccgtttccagaactccttgcatatccatcagaaagatggactagcatgtgcctggcatcacccgaatccctttgggacatgaaggtccctctccggacccctttgtgcttaggcctggagagcacactctctttaggctctattttgactccacctctagaggacaggaaatgacttcaggagtttctgcccattccaccgaatccctttcctgtgtccaggctgccgtttgggctgtggttctgtcattagccagtgctagtggggcacagaccatggcgtgttctctgagctgaagttgggtctcttcagcaacagattctacgactctgttctataaacagagtcatagaacatttaaagcaaatgagaaatatatcttcttctaaaagaaaaagtattcttgtaaagaaaaaaaaattatcattctaatcattcctaatgaagtaagctgcttgagtctatctctatgtttattttacattaaatacgaatttttagaggtaaaacataaataatacagtagaggtaaaacataaataatacaggctgtctgatcaacttcttacagtcaaaggcacctacaataactgtgataagtatctattactgtctcacaaagcaataccagaaaatctaatatctaatgaaactgacaaaaaagagagcctatatgagctttcactcataaatcataattagctttcaaagactaatataattcattatgaatataaaccttgataagataaaactatgaaaatttcatgacttcaaagccttcaattaaaattaaaatgtgttatttgaaaacctgatttttatgcacatgatagataaaatgccaaaaaaaaggcatgaaatactgaaatcaactttaacaagctctagatttaaataacaaaacaaaatcaaatacagagcttagggctcaaagaatgagtttttaaactaaaataaagaaaatgagttttccagaaattaatgtttttaaattaatacaatggtaaagaaaaattattttgaatcttaaattggatgacatgttttttacttcaagaggaagtacaactgttagaataacttgacccaggatctagtgaatgtccaacccttctccaaattcaggctatacaactacatgtcaggaaagtttgcatggccactagaaggtttaattcgtactgttataagccaacattcaatttttccttaccttttattcttagttagtgcttcatttattttcagagagtgattaaaatgagagcaatacacaggaaacaaggctggggatgaaaacgcatttcttaccctggcagagtggcgtgagggagtcccactggtacatgccaagtgggtttcgtctacaggttgcattgctgtggccgaccattcggtatccaggcttgcaaaaataatgcactttgcttccaaccgctcctgcagtcctgtttagaatacccccattcttcagggggtgggtcaaactgcagtaaggtgctgtgggcagacagacacacacagaaataagtcaacaagcaaacaaatggccagtgccattgcctttgtgagagtctataaatgaatggcttctcatttccaaaaggtaggaaatgagcaccagtatgtaagtttgttctaaagagcattccaaaacttgagagtctaagaggcaagtctcttactctgaagttgagatgatctgcagctctgagtcaatgtgaagctaggatcctgaatacagtactgtgagaaacatcaagagtatccaatctttaggcttccctgggacacactggaagaagaattgtcttgggccacacataaaacacactaacactaatgatagctaaggagctataaaagaaactgcagaaaaatcttataatgttttaagaaagtttacaaatctgtgttgggcagcattcaaagtcatcctgcgctgtatgcagcccacaggctgcaggttgacttggtctagagggatcattttgaatgacctcactcacctctctaaagcagcttactgacttaaataagcacatctgtcaccaggataaaagtgatagggtactgcacaagacatcatatttgaaacaaaaatattctgcgtgttttttaagtgttgttaaaacagagaaagtagaaatatataacattttcttaatcaaggccattaatttctttccttttgactgttcagtgaaacttctggactgtacaatgatgtagatattaaccttcttttttagcatatgggatttgaatgaaatctttgaagaaaatgcattctcttgagtcaattacaatctcacaatagctttaatcatccctctttgtaaggagacattttaaaactagagatgggcatttgttaaaataataattttacccacacagaatgtcatatttatggctaaaagtctctgcatcttatttacacgtttagacaaagaaacttgcttcatctgcacaaggctaggtcactactgcataaggcgaggtcactactacacaaaatcctaggaactcacttcagatgaatttaaacaatacaacagagaaggtccttaagaactgggaattctcagtttctttttaaagaattttagatcttccacttccctctggggcttccatataaaagcacacacacgcaggtctgaatgcttaacattgctcctttccttggaaatacattcagaagaaaccttctgaaggttttctatcatagtggtgcccagaagcaacatctatgtgtctggcctcagttgtcaaccatgttcctacgagaagtgtcctcagaaaatattctcagctgggtgagcctctgaagtaccatttccttttttttaatgggctgatttttcttaactgaaaatccactaccataagaatctcttgattcacagctccattggccacaccatgttctacctccagttatttctagaccaaattcttctaagttttgaatgaaccaaaatacttagtttagacaaagtatgagtacaatcaggcaccctgaatatcaatggcttggaatcactgtgctagtaaaaaaaaaaaaaaaaaaaagttaataaaaaatagaaggaacaatcagactgtagattcctctccaaagtcatagataagttaaataaagtttgcaggaagtgagaccatgaggctctaactctacagattccaataaggctccgttttcttttactgtgtttcttctctcaccagcccctcaacatacctcttctttcctaactcacttaggataagacatgaagggccctacaggggaaaccatagcacagaatacaaagagagactggagcaggggccctgccagcccaactcctgctgcaggaagaggaattcagaggagcagggcctggtccttccactctgctggtgcagcctcggaaaagctgggatatagaatgaaaagtctaatgggtacccaggtgagagaagactgggacaggtggatattctggaatttcggtgtgaatgccaaaccagtctgtactttcaacccgcccaatacagaagctttcatttgcttctcatagtatgaaaaggacattgttaattcagcctgcgcttagcacagtttacggaattgtccagaaccactgttcgcaggcatttctttgtcgtttttaactcggatttccaattatgatgattcattatattgcttttatgcctgaatgatcaagagtttacgtgcatagggcaaatacatgttggggatgcaacgtgtggtcatgtgacaatatcatgggctagagttcccttggccacatgttaatattttagggacactttcatttaatcaatgctcaaaaattactgatgctgacctagcagagatcactgagtcatcaattctaagtaaaaagctgtgagatagataaagaattttttatattcacatatgacacgtgtctatctatctgcctctctttctctctctctctccacttaaacaacataaaattgtgtattcttcttctcccaatacagtttaacaatgaggctctccttgtggtatgacaacaaataaaataccttttgaaagacgtagaaatcattgttctcacaattgaggatataatcatatcaccaggctactaagaatttctctgcaggtaaaacaagataaattatgttcatcatgattttctctgagctgaccatgtttccacattggaaaaattcaaacacctttaagagtctgactatcggccgggcgcggtggcttaacgcctgtaatcccagcactttgggaggccgaggcggccggatcacaaggtcaggagatcgtgaccatcctggctaacacggtgaaaccccgactctactaaaaaaatacaaaaaaattagccgggcgcggtggcgggcgcctgtagtcccagctactcgggaggctgaggcaggagaatggcctgaacccgggaggcggagcttgcagtgagccgagatcgcaccactgcactccagcctgggcaacagagccagactgtatttcaaaaaaaaaaaaaaaaaaaaaaaaagagtctgactatctattttttggaacaaggagtttgctgaatgcaaatcccatcattgcatcgatgtctttgcagcaaaggtctgagtatattttattaaaccttccagaggaagaatatctgaatttcttgcctgttatcctcacatcaagggcctttcaaaatcttgatgctttttaccattttatatgtctaccaaccagagtgagctaaaaccttattcttacaactgctgttttaacactgtttcctggttttccctttggacgctcgtagtccctaaagacgtaaaacaccaacacagtaataaacaatcctccgtcagcacatattgttcacttcccatacacaatgagcatctttcacgggaaaacataacttgaaagctgtcaagggcattgctgagtgagattttgagaaaagtttagattttctgcttagtaattgaaatgtgctcaggaattaagagtctgcctactgcttctgtaggaaagtttaaagaatagtgtggtcagatcctactgatgattgtatacaggatttaatgtctaataaatatattgactgatttgatcaatttgttactaattgatttagttaatataaatcactgctggcagagaatgattacagtatataaagggcaaaataatttacattttgatgaggaatatatattaaacatatatttattatgtatatggttatttgtacaaatatatatatacacatatatgtagtgtgaaacatacataaagagacctgcagatagatacaaaaacataactattaatagtaagagattatcatcacttatgcaattaatagaaatacaattatctttttctatttgtttgcttaccatttaaacatattttaaaattaattttgattatattagtttatcttttggaaaatgtctttgctttctataatatgaatttcagcagtttataattttaacaataaaattctaaatattaagcaacaaatttcctaatgtagtttagaggaatcattcagaataattacccatcatatatttctactgtagttaattattaatctttaagaattaggattatactataaatttctatttaaattgttttattcaatgaaaatcacctgttttaaaatactttcatataaaatctaaacctcatttacttacctgcatagcgaatcttgaatcctttcttactggtggcatggtcagtggaccagcggagatataactgattactcctgcttgtaaaatttgattgttcagtatgattcccacttaagactactagcagaggactttgcccagaagaacctaagtgaaacagaaaaacaaaaacattcagagatgagtgagcacctaccaaatgcatactaggtttagcttttgattacactggagtctacgtgtgcaatacacagatataattattacaaaagtggacaacaaattccaaatggctatagtgacagatatattttctgataaaaataagacaataatgtacaaaaagaatttcaggtgcatatgctattaatggtgtcatatttaaataagccttgtctataaaacagcagtacccgaaaaaaatgaaagtaatatgtattgttgttagtatttacaatattgtacttacacaggaaaatagaaactttcatgtaatactagtggaagcgtaaagtagtagaatcactttggagggctgtttggtaatatccagtaaaattgaaggtttaattatatttctatgaaccctagcacatgtacgcaagtattatttatatagtgaacatgtgtattctaacactatttctcatggcaaattttagatcaaactagtaatttggagttttaaaaaaagaattgaagattccatgaaaaagaattagattcatacagcattaaaattaacaaactagatatacacatatccacataggtaattcttaacataacagattattactaaaaatatatatttagagataaatataataggataacaattatacaaaaaataaaaaatgcaacatataacatgtgtatctgtggacgatagatacacaaataattataaaacatgcataaccatgacccatgcaactccaacttcagaatactaacttcctctaggagaggcacaagtggaattggatatgggtgaagcttctaaatttacctgtacacattgcttctttataagatgagggcctaaagtaaatttgacaaagccctgaaattcatatctagttttttcatttttcacctgtctatggtatttgaaattgttttaaaaacgttgagacaacaaagttaacattgaaagtataggtaagaaaagaaagcacagtggagagtcacccggcattgccctcatcaccataacccaaaaccatttttcaggagaaattgcttcatggcactggggcttgccaacaacgctactctgtaatgagctcagcattatctcatactcgtaaaagcgttcatggcattttgcatttcacagttcactcctagggaacacattatggactgggagaatgcagctctcattgttgttcataatacaaatgctatgaagtaaagtgacagctgtctttgttgttatacctaaaattttatttgtgcaaagatactgagaaaccatactccactcaccgtgtaactcccaatcagagcagttctcatgatttttttcaagtaagactgttatagactagactgggtccccctcaaatttacacattgaagtcctatgaagtcctaaccctctgggcttggaaatgtgactttaaagagagagagggagggtccctaaagacataactaaggttaaacgaggtagtatgggtgggtcctgatctaatataactgatgtctttctaagaaaaggagattaagacacaggcacgccctgagtgggggccacatctgcaagcctgggagggaggcttggaggagagtcccgcccttctgaccccttccgcttaaaggttcagcatccagaattgtgagaacataaatttctgttgaggctaggcatggtggctcacacctgtaatcccagcgctttgggaggtagaggcgagtggatcgcctgaggtcagaagtttgagaccagcctggccaatatggtaaaaccccatcattactaaaaatacaaaaaattagctgggcgtggcggcaggcacctgtaatcccagctactcaggaggctgaggcaggaaaattgcttgaacccaggaggtggaagttgcagtgagctgaggttgtgccattgcactccagcctgggcaacaagagcaaaattctgtctcaaaaaaaaaaaaattctgttgaagccactcaatttatggcactttgtcatggcagtcctaggaaagaaatgtgaaacaaacaaacgaacaaaaaaccacaaaccaaaactagcatattaaataatcgggcaatgctgactttggtcagagagaaggaggatgagaagaaatgatattaatagatctcactatgaaaaatgtcatggctaaatttcctgggagatgccctgcaaaagagtggctggtatttcataatcaaagacaaagcgtgtttggtatgttggtttgctttttggcgtttaaaaggataatgtatattctgagataaaatgccactggtaaattaattaacctgaatttatgatattttgaaatgtcatttttaatgacagaactcaagagtagagttttagggttttttttattttattttattttttatttttttattttttgagacagagttttgctctgccttccaggctggagtgcaatggtacaatctcggctctctgcaacctttgcctcctgggctcaaatgattctcttgcctcaggctcctgagtagctgggattacaggcgcctgccaccgcgcccagctaacttttgtattttttagcagagacggtttcaccacgctggccaggctggtctcaaactcctgacctcaggtgatccattcacctcggtctcctaaagtgctgggattacaggcgtgagccactaagcctggccagttttaggtattcttaatccagcatctgaaccctcataatgttctatctgttctctttgtctaaaatgtaactaactttctagaaggaatagtctttaaaagcacatattcaaactggcatgtgcagaaaaccagcacggcagtaaaggaaggtatccatttctgttaccaaaatggaaactaagtattccaccagtgtacactgtaattttaattttgacagtcttctcaactgagtttcataatgattaaaatactgtgttttaaaaagcattatgggatatccactacttaagccatagagagtaatatactcttgagataataaagtataaaatcaatatattcaacatgttttttggtccacctatgaactataaaagagcccgtcttacaaaaaaaaaaaaaaaaaaaagagagagagaaagagacagaaagatatgaacatgacatttactgcaacaaaaatgtcatcgcttaaaaacatattcacataaaactctgacctttcactttgtagaaaaaactttaagaccagacaatcctagtcactgatttctgataattttgacagcaagtattatgctattgtctctaacgtattttacctgttgtttataatggctatgatctgtccaaatttgcaggagatcaaattgcaagccatgagtgcataaattattgataaataatttgctcctgaaagtaagagacttaaaagcatggccagtatatttcaattcaactactgtgaaacaaaagaacatgcataagttcaaaataattaaatatacttttatgtcctttgtagggatatatatgtctatatatacacaaacacaaacacagacatacagcctgtgaggttggatgctctacattttaatttttgcataatacctaataggcctcaaatagagtttacctctcttcttcctcaacaagagaaaccccatttttatacttgcgtaatgagttacttctctctactctacagactaaagaaaaagttgtaaataatgtatgtttgttttaatatacacatttaaaaagccatgctctgaaaatgaaaatattgctctccagtcctctgcttctatatacaaaaatgtgagtttaatttccaatttattaattcatttttgaaaatacattaattgattcagtgatgtctatccatacaagcaatttgactcatcaactcagtaaagtgaatacaaacacacatcaaatccattagaataatttatttttttcactgaattgattgtaatttatctgaactcaatgacaaatctttcaaaatatgtgaaaaccctgttattatgtacagccataattgtaactggtctaattttctgggctatgacggtttcacacaaagagaaatattaacattccttccatttcaaattgacgattcaaccacatattacttttaatcatatcactgttaaaattttcattgaaattgcaaaaaaatcataagactattgttgaaaacagtattgcacgtgttcagttaaccatatttcactatttcaaagaatcacacttgaaaaactcctgtagcatttatcatctagaaatctctgtgagccatgatttttacatatttccagtaaaataattatttagatgacaaaaatacctctaggcctaagtttcctaaaatatcttgtgaattgatattacatataggagagagagaaagagttattgagatcatcttctctaaatcactgtgttaaaaaaatcaaataatggttaaagaaaatttggtacactttcagggtgtattcctaagcattctaactgtttgaaaagtgacaatgttaacaatcctatggtttggctgtgtcccctcccaaatctcttcttgaattgtaaatcccacaattcccacctatcgtgggacaaatctggtgggaggtaattgaatcatgtgggtgggtctttcccatgctgttctcctgatagtaagtcccacaagatctgatggttttaaaaatgggatttttccctgcacaagttctctctcatgtgcgtgcacccactctttctctctctctgtctctcatgcctgccgtcatccatgtaaaatgtgacttgctcctccttgccttcctccatgattgtgaggtctccccagccatctggaactgtaaatccattaaatctctttttcttcctagtcttgggtctgtctttatcagcagcatgaaaatggactaatacagtacaacaatcatatggtaatgttttacagactgcttgatctcttgagaatgcataaccccaaactagtttattttttgtttgctttgggaaaacataagttaactcaagaatatattccagtctttatgttactaaaacattgtaatagtgtttttatcaatgatgccgaggtcactgctctacaaagattaaagaaacttaccatcaaacacttccagtgcatcaaactgcttttcactttgaaatgtgtccacaaagatggtaatgttgtagtttggttccactttaatactccaagagcaagtctgggagttaaaataattacccggataccctggactgagaatgactcccgatgatccagtccggacttcatttgctgggcattgtgctggagagaaaagtaccagcaaaagtttgctttaataaaatgattccaactgcaataggatagtttctatccctgtataaacaagtcaatgaaaggaaaaagcaatcttattgagctctggccaaatttaataccgaatgcaaacacagagggagggcaacattgaataatcatgagaattgtgcatctttctctttgcagttctctacactcagcctgcacactcctttggcccctgcatctcccacacaccttaatttggggcagatgcatcctggatttcatcatacaatgcaagatttcctaactctactacaaagaagaacctcaccatttcaaaagagtattacagaaatacagtgaaatgttatgcaataagaaaagaaaactcatatttattttggctttaaatatacagtaggcccccttacccctggggatacattccaagagccctagtgatgcctgatgctgcagatggtccagaatcctacgtcgtttctggtgcaatcacatcatacagggcaatggatatactggacaaagctgggattcatgtcctgggtgagacatagcccggggatgatgacagatttcatcaggctattcagaacagtgcaaaattttaaatgtgttgttatttctggaatttttcatttaatattttcagactgtgcttgatcacaggtaactgaaattgcagaatggaaaacctcggatcgggggtggggggaactactgtacttagcatagtaatatttaaacgttcgatgtgattgctcgggaccctgggaagaggaagaattagagacctggtctcaatcccacatgggacatctcagcaggagccctgattcctaagggatgaattaattgtaaatgtatcatgaagatactatggatacatcgtatcttttctcctcttgctttttgaaaaattattattcaactacttccagtttaatcaacataaaaacaatctgcagagatctggacatgcaaagcaaaacactagagtctcctaattagtaatttctctcatcactgaattatcttccagaaacagtttgtgtataaaactattaagggaaatttttttctattactggtaatggttcaaaaataaaaaatgtatatcaaaattacttgtagagtgttaagagttctatagttaatcaccttttccttaatgaaaaagagcttttgttaaatttatttattgagttatcgccttttaattagttaaatgtgtgctatttatacatacatttcaagatagaagcttttcaaacagatgagcgaagcttatgatatgtgtttttattcaagtaactgccttttgaaaagtaatttatttcctattttcttccatttatcttagcattctaattaacatatattttaaaatttagaaaatgtttagacataagaccaccaatcataaaacatttcatagaactctttaaataacatatattttaggtgagattttaaaaatacttacaatgataaattaatggcaataatataaactaaaataatcctaatcagaacacacagattgaaacaactgagttaaaggtctaattttcttctgtgatggtgacctcatcgctttgtaaaatacacgatgcccattcaaagttaatgtgatattttaagaaagaaaaaataatgaaattagggtccgtgcctgtgtatatctgtgcaggctaggacctcaagttttagaagctccacagacccgccttgactttgcaataacaaccagggctttccttggctctgacgtgtaagtacagagtaataatagctccccctcagggttttaattagagccaatatacacaatttttttttttttaaatctaaagcactatgtgggcagaaactgttgtaaggactagggatgattacaccacatgcctaccttttcataactgttagggaccaaccgccccaaaaagcttctcggtactgccgacactccccccaaacccctctgtactgcccacctctccccttaatgccctgcaactcttctccgtgccgttcacccttcccccaagcctctttacatttctaagccttatccaagcgctgcagtgaagccagcagacttcactcatcagaccttactacaataagcaaaccgcaattacaaaccatccagaccacacagagggaggtcgtgggaagcataaataaactttacctacaccctcctgtaagttccttcatctagctactgccataaacgtcacaagataatatatggcaaagttaaccaacaaacaaccccagggtccctctcccccatataaacccctcattttgtaagctcagggctgcctcttctgtctgtggtggagcagatggcaggttcaataaacttattcacctgactttgggtctattcatccttctctaggctgaccttatactaacaaaaaaatgctaccagagggcgtttcattttgtgggattacacttgaaaaacagttagccaatctctctaccctgcatttttatgaggactgagattttataactgcagctatagttatcagttgacattggaacttcaggccatctggaagtaagaaacctttactgagttgctaaaatccacctgaaaacctattcgcacatcctggggtttgacagcagtgcaatgatctaacccagaagcagcattttaagcatagccattcttattcctttcatatttgaaatgctgattttgtttcttaggaaagacaaaatgaaaatataaacaacttgttatataattcccactagtttacagaggactctcagtttctacaattctctccaaccaaagaggtagcagataatttgtagagaatttgtaccatttttcatttgtatcatttatcatttgtatcatttttcttaaaatacttagcaatacttttttcagtcatacatattgttttcaaaattcatgtggggttttttggtgttttgaggtttggttttgttttttaacttgtttgtttgtttgagatagggtctcactctgtcacccaagccaggctggagggcagtggcaggatcacggctcactgcagccttgacctcccaggctcaaacaatcctcccacctcagctgcccgagtagctgggactacaggcgcacaccacccctcctggctaatttttgtatttttattttagaaatgttgttttgccattttgcccaggctggtctccaactcctgggctcaagcaatccttccacctcaacctccaccatgctcggcctaagaagcatttggaggtgtttacccatgagcgaaagtgatttgttttcttgtgtttcttctgctctttcatatggaaccactccttctcctcagtgttataaactgttgcttagagcaatactcagttggagtgggagagctgaaagggaccgcagtgcggtcctatagctgagatgtttatttcttagcagcaatcacacattagaaaacaactgtgtctccacttgggaatctgggaaacctctcaccataggggagcacctgtcaaaaacacacgtgaaagcttgcctctctcagacatcacctgcgcctcgagttatgatccttctgcacaatgttagtgccccagattgtttttaaagaaaaataaaatgtgaggcttaaaacccaaagcatcttattcaacgcatctcataggccttcagcaaaactaatagcagatgaggattagtactctaggattaatagcataaattgggatttatgagtaactaagattattcttaaaagcacctataggtatgacagaattggagaaggtgagccctctgtgaactagggaaaaggctgccccagagcccttgtgatgcctgctattatccagcacatatagaaggaagctggagctgggcagcggcggtttttatgtcgcctccatctgctgctttcgaatgatcattatcagaaggtcactgaatctccttaatgttcactgaatacgtatggtgttttttttttttttttctaaagaaatgaatattctaaaaactattgaaggatcccccaaggtccacaggatgaagaaacctgacgttgaagacctttaaagtcaggtcctagtctagctttccagcctgatttaatttaccacctcttcccccaaaacaccctgagagcaagcagtaggaagccatctcctcctttttcctcaacgccacaccctcctttgtgtttccaaacctttgttattaattctcttcactttttgaaatgcctctctttccttaacaggagaaaagccacttctgtgatgtctcttactcaggtttttctacattaagatgagtgtctagcacagtaatatctccatataaggctgactactttttttttgagacggagtctcgctctgacgcccaggctggagtgcaatgacacgatctcagctcactgcaagctccacctccggggttcacaccattctcctgcctcagcctccggagtagctgggactacaggggcccacaaccatgcctggctaatttttttttgtatttttagtagagataggttttcaccatgttacccaggatggtctcgatctcctgaccttgtgatccgctcccctcagcctcccaaagtaataggattataggcatgagccaccgcatccgaccaatcctgactttcaaagaacaatgcactctccttgtttccctaaaattggtgataattttgtttctttctttttctttttttttttttttttttttagacagagtcttgctctgtcgctcaggctggagtgcagtgacgtgatctcagctcactgcaacctccacatgcggggttcaagcaattctccagcctcagcctccagagcagctgggattacagatgtctgccaccacatctggctaatttttgtatttttagtagagacagcgtttcaccatgttggccaggctggtgtcgaactcctgacctcaggtgatcctcccacctcggcctccaaaagtgctgggatggtgataagtttcaaagcacaacttctaaaagtgtggttatgacatttgaagaagacagactaatagctaacgtaatttttctgaagaatttattgggagatgggcccccacttgagcacaatcgaatcaatcaaatagtagaaaagtacttaaagaaagatgataattaagtgattcagtgattaaggatttggtaaaagacatctagggtcttatttcctgtttgttttcaaatgatgagttgtttagagaatgacagctaagatcactctccggttgttttaaacaaattgactcgtgacttgaaagagaagagaactaggttatcctgttcgcctcctgaggtgtggagtggggcttgggaaacttcagcgtgagtaaaagtcggcaaattttgtctgcagaatgctccctgtaactgtctgtgacaaatgaggaaatttagagaataacgctcatgttgtgttgatttagacatgtgccacttaaagatggggacaggctgggagaaatgcatctttaggggatcatgtcatcatgcaaagataacagcatgcacttctgagggaggccactctcaccaatgcaggcctccataacaactgtttccatactaacggagtgtttcagttacatattaaaagctgaaagagccagcgcctttatacaaagcctggaacggagtgtttccgttaaatattaaaagctgtaagagccagcgcctttatacaaagcctggaaggtaacaaagagttttccctaggcttctcctgggccttgaagcatgacaagataacaaaagaattcttaacaggaggacccttttagaattcaacgagttttattagcggtctgaagaaactccccaggcctccacaaacaagtttattggggtctaaaggagctccccaaacctttgtgatttagcgggagacaaaacaagactaatcaccccagcacctggacccatttagattcagtaaacttactgaggctccagaggaaggtcttcagcactcagaccttagctgtagattttaaaaagttaatcacttatgtctttaaataaatacacacttacacatagacatatagctaaggaggtacataagctctaaaaaactttgtaattttgagttggtctggcgataatttccaggccttctccctgtaaccagttatagaaataaaaactctcttcctcctcagtttatctgcatctcgttattgggacatgaaaaatagcagccccaccttcagtttggtccaggaacacttaaacacacccagatggtacagcctgctacacaattaagccatatggtgtagcctattgctcccaaaccacacacctgcacagtatgagactgtactgaagactgtaggcaactggaacacaagggtaagcattctcacatctgaactcatctcaacattgaaaaggtaatgcgtggccccgtagtactgcaactgctagacgtcactcggtggtaggaattttcagcttcattataatcttacaggaccacatttatctacacggtctgtcacggttcaaaacgtcatgcagtgcgtgattattctctgctcttggcttgtcatgaattaaacgtcatttaaataagaacttggttcatctggagaggacaccctaatcaaattccttttttttttaaaaaaaaaaaatgatgtagttttgctcttgttgcccaggctggagtgcaatggcacaatcttggctcactgcaacctctgcctcccaggttccagtgattctcctgcctcagcctcccaagtagctgggattacaggcacgtgccaccacacgcagctaattttgtattttcagtagacacggggtttcttcatgttggtcacggtggtcttgaactcctaacctcaggtgatctgcccacctcggcctcccaaagttctgggattacaggcatgagccactgtccctgaccaaaattccctgtttttagagcagcacatttgatacatacgtatgcctttcttctcttctcagctaagatcacctttagttaaagtcttctattctgagaaacttgaggctttgtttgttgggattaaaatgtaccttaaaaatgtgaaggtttgcctgggttcatttccatatagaatggcagaagatgaacactttttatatccccccaccttgaggaaagaatccataaatagaccattgttgctcctggaagatggcacagacgttggctttcttctaagaagacagtgacttggatctcctgactttgcacccaatgcaatccccacttctaagtaaggcaacctagaggcacagattttgatgacttccacagcctacggtctgcttagcgtttaaacagacgagcaggccaagggtctggccctctgctcaggtagcggtttcctgtaatcaatagttctcatgtagatacaacttcaatgttaatattttttcaaaaaaaaaatctaagttattatggatatctgataataattcattccaaaatgtatgccaatttttcttcagatgtagaagactgtttctctctttcagggtgcctggaatcctgcctcattccagaatgagaatgcacaaagttatcagacttttttttttcttttctttttttttttttttgagacagagttttgctgtgtctcccaggctggagagcaatggcaagatctcggctcactgcaacctccacctcctgggttcaagcaattctcctgactcagccacctgagtagctggcattacaggcatgcgccaccacgcccagttaattttgtattttcagtagagacaggtttctccctgttggtcaggctggtctcgacctcccagcctcaggtgatccacccacctcggcctcacagaatgctgggattacaggcgtgcgccaccgcgcccggccagttatcagacctttgaagaggatccatgcacaggtgtgagcatctgcaaaaccactgcgaagtcgatacttttgcaaagaaaacttccatttacagggaaggcagttaacattataaaacactcaaaaagataaattcatttaatactcggtgagtctttacaacaatctcaaaaataaagcggataaatcatcctctgtgtgcacagtgcagggaagagtgacttgctcaaagctgcctgatggggtgactctggctccgggtcctgtcttcctaaatcgtgggcccttatagctgtgtcactcaccctaaggaatgacaatagttggattccttgaaagagccacaatgctcaaaagcactacatctgcacttcactatgattttgaagtcataaaaactattctaattaggaaagcttttggataggtgaactaatgatgtttcgacttacttgagcatttgagcttatgtaaagtttttcaagcctttttcattcaatgatacttgaaagtggtgtctattaatattttaaaagtaatctacttgtcttctaatagattaaatcaacagattcagcctcagtatcttgttctattattgtatattgtctatactcttgcacatggtctacatatgttaaacatatgtgagaaaaacttgagatgtgcatgtttcattttttataaatttacatcaaaatattaaacaccagctaattatatgcatgctgaggtatttatagcaaaacgaaatgatattcaaaatttgccttgaaatgcatcaaaaatatagcgtagcttaataaatggctagaaagataacagataggcatgtgataaaggaaatactttgtaagttttcatagcggaagctaggtggtatatattcaggtgttacattattcaggtattaaaattatttcaactttgccatgtttgaacatttacatgataaattgctgtgagaaacatgatttcttatttgatatggccttggtttattttctaggactagataaaagaaaaagcatcattagatatttctgttagcatgttagtttcattgcaatgggatcagagcacagattaagtgcaggctgggtacagtggctcatgcctgcaatcctagcaatctgggaagctgaggcaggtagatagctcgagtccagaagttcaagaccagcctgggtaacatgttgaaaacccatttctacaaaaaaaaaaaaaaaaatccaaaaattagccaggcatggtggtgcatgcatgtagtcccagttactcaggaggctgaggcaggaggatcacctgagaccagggaggttgaggctgtggtgagccatgattgcaccactgtactcccacctgggtgacagagtaagaccctatctccaagataaataaataaataataaacaaataaataagttcacatctatacaaagaaatgcagaccaatacaaacaatacaattttccatgttgaataagtttatgtagttttagtatcgaacagtgcataccttcacatgttgggagagaaccctcaaactgcaactgggaactgagcttgcaagtcagaatgtcggtccccaccaaggtgtacccggggtggcactggtacttcacaaaatctcctagaagagtcaatgcaacaaaccaggaaattgtgtgtgaccttctgagtgtgtgaaggtgtgacacatgtaggactacttaaatgaattaaatcaacttgcaaatctttttagaaactatgtctgtatttatttttagtcttttaaaaataataccgttttaagttcttaatttataaaaatgctctattaagcttagccgatattagtactgaaatgatgtggcagcttttcttccttgactgaggcatccgtgttggtttcccttccccagtgattgctgacgaaaagaaaaaaaaagtaaagtagaagctatggtttaagcaagactgtaaaatcaaatggctttacagcatccacagagactcatctctgaccttggtacttagcacaatgttccaattaactaagccagggtgaggacagcagaaattgggtcacgtagtttgaccagtggtctgaaacacagggcagagttttataactggggctgaaaaatcctgggttgcaataactataccataaacatatgccatcactgctttctcagtatgaccagaagagtattgaataaattagatcattaatgtaaaaagatacagcagaaatcctaaatatcatcactaaatattttctcttattatatcccagtttcaatgaaatgtcactgttatgtaatcatcctttcagccgcaaatgattcagatttttctcaagtgcatgaatgtgtccccctaactgaaagcaaatatctgcccaagtctgtctctgaatactttattaaaaactatgaactaccaaatgttgtagaggaaaaaaatgttcaaactgacatcaaaattcaaatggcaaaacaaaaaaaaatcatggtaatgaagagggacagacattttctatttgatacatgacctccgtataagttctcagcaatactttaaggatagtttgttctttgtttctgtttttgtttctctgacaaattactcattaacttgtctgagtaatgattacaatgagaagtgggtgtaaaaaaatgtcgtgctgaattcatggtattgtaatgaagaaagtattacctatttcgaaatcatcatcctcagtaagcatttctgcctgtggaaccgctgggggaggttgacatttcttgagctgaaatgctaaatgattaatggaaagaataataataattgcaattacacttgctgaataaacacaactattacaaaacattcatcttgcagttgttataatgcttaagtacacggactgaaatgtctctattcctgaatcatagctttataaaattcccaagcttcaaatgttcatattattatttagtgccaaaaaacagttaaagcccaaggaaaaaagtgtacaattattttttaaagtataccatttaaataaacacactttacagatgtttggaattctgcaagaatgactcaacagtcacaacctggctccctgtccatgtgcagatttgataacgtctgccctgtcccgtgtcctgaggaattctgtaggtggcagtgttcgtgagagataagcgattgattgacagatgttctacatatcgtttagagtgcattcccaggattattggaggtttgctttcacaccatttatagttacatgacatttgctataacaccttatcttgagacagggatgagtaaatctataaaaggtaccaaatctctttcaatggtcttcatcttagagtttcacttaggatacatgtatcttggaataaatccaagctggatacgatgtgaaataataaagacatcattaaacaaaaaaaggaccacaggaaacgctggcctccagtgcaaaagaatcatacacgccctcggctgaatcaagaaacttcagctggaaacaaggcgtgggacaacactgcaggaaacaccacatggaattctcagtcttaactaacggagtgaaaatcaactgaccgtggaaattgaggacaaagaagcctccatttgaaaagtcgctgtggaacttgagcaggacttggttggtggagctatacgccgtttcgagggctgtgttgccactgaaaactcccagctggggtgagttctgatcgggaccgtccctaggaaagacagaaagaggtggctggctaaggatatttacttctgagtgagatttatggaaactttggctaatgaattaatttttttaataaaagcaataaaacatatgcattctcaggatactgtgtttgtaaacatcaagatgttgaatgtccacaaagttgaggaaccctccagtctctgtctttcattaatgttccacaggcactcggcacttgtcaaatgtcaacactcaccggtgctggtggctcatgcctgtcatcccagcactttgggaggccaaggcaggcagatcacctgaggtcaggagtttgagaccagcctggccaacatggtgaaaccctgtctctactaaaattacaaaaattagctgggcctggtggcacgcacttgtagtcccagctactcggcaggctaaggcaggagaattgcttgaacccaggaggcgctggttccagtgagccaagatcgcgccactgcactccagctgtgcgacagggcaagactctgtctcaaaaagaaataaattaaaaaaataaaataaaaatgtcaacacctgtgagattttccattctaaatatggagcttaatctatggggcatggccaaccacagaatgctgttttgttttggttttaaaacggcagtttcattgtggtcaacctaatatttcaaattctgtttctcctcactctcacatccactgactctggtcgttgtcatcttagatgtctgatttacttccacaacctcaaagccagtctcctttcttgccctctgctactttatttcccacaaaatgagcccgtcattctgcagcccatatctggccttggagctctgcctgtcagagcccaggtgcatcctcactgccccaagaacaaagcccaaggccttcacatgcatttccaggtcctgccttacttgccctggctgctggcttctgctcctgctccccctgtgggctccaacaagagtgcagccacaccacacacaacacgcacacacacacacaacatacacaacacacacacagacaccacacacacaaacacacacgtaagccacacagacatacacaagccacacacaccacacagacacacccacagagacacacatcacacacccatacccaacccaacccacacccacaaacacacatccaatacatacacacacagatgcagacacacagacataattctgcctatttctaccatgtagcaaaacccacatgtactatgtgaaattgattccctatatctctggatttcgttggtgaatttcttctctagtatctaagaagtttattctaaatatgtgccttgtatataagtggcatatgtatgctaagtcagaattgttgatcacaattacagatattttgacttgagaggttctcataccaaacagcaatgtaatcgttgacagcttccgtctgtaacagggtgaagttgatgtaaactccgtgccctggaggcaccgtgatgagccaaatgcagtccttcaggatcggatactcatcaggaaagccaggggagtagatggtgccgttctgagaagttacgttgtacccacaaggggctgcaaaggaaaccaagaaaaaacaagcgccatacagctgattttagagagtagaaagctaaatatttgactccaaagtaccttagccaacatttttcctgatgggaaataggtgtgaaatatttctgaatcaccattttgtcaaaattactgccctaaaatctgaagaccttagaagaattatacgtctaagctaaattatctcagttttatttaatatattctccatatcttcaaaatccctttaggataaatttattcttctatgcctcaaataaaatccttagttaacacttgtgacctgctgataacccatctgagtgtccagcacaatgaattatggggaaagtattcataaatatgtaactgctttttctaactcacactgctagaccctatttataagccatctgaaagagtgtcatctaagtctacttgccttaaaacaaagacattatcaattctttacagatctatacctgaagaagtaagataatgcaatgtaagattatgtaagtggtgttttgcggaagcatttccagtttttactagtgttcaatgacttgaagaactaaaacaatacccaatttattttcatttttgttaagaaatttatatttattattttaatggcaattattttatttatggaaaatgacatgtccaaacactaatggaataacctgaaatatagtctttaatttaaatattcatatagtgcatcaaagtcataaaactttgaactctgaaatcaaaccaacagctaagaggtgtgagatgagtgttcacaactctcttgaacctcgaagggctgtcaaagatttgccacaaatggtatagaattcaggtagaggaaaaaggcccaaatacacaaacagataaacaaaaagaaaagtttagtaacaaatgagaatataccatgaggcgggatatgatacactgttgaactgcacagatgtgtattgatttgaaaagaacattggattgaacctggctggagatttggatcttttcatcagaagaagggactgtatgtagagactactttagaagttttactgcgtaattattactaagtgaggtttggagtcagacaaacctggatttgtaagctggagaagcaaattatccctgggagcctccacttctataaattctatgaggtcagggtctgcgatactcctgaagcttgtcatctctaaaatgggaccataggctgggcacggtggctcacttctgtaatcccagcactttgggagactgaggtgggtggatcacctgaggtcaggagtttgagaccagcctgaccaacatggggaaaccctaactctactaaaaatacaaaaatcagccaggcgtggtggtgcacgcctgtaatcccaagtacttggggggttgaggcaggagaattgcttcaatctgggaggcagagggtgtagtaagccgagattgtgccattgcactccagcatgggtgacagagtctctgtctctaaaaataataataataataatgggaccataaaccatgctgtccccataacaagctacttttgtctcctgttggcagtgcacttttcctcccctccagacgtcgagggagtgttcacatgcttttcttctatttttctgccaaggcaaacttgtctcttcctttaaaactcaactccttgtcaccgcttccttaaggtctttcctgcttgctccggctctagaggtccaggctctgctcacagagcacacggctcccacgagactgtcagcctctagcagacagggtctgcatctcctcccaccccagctgctacctcctttcaagagtccctactgtctagctcaggtcatgataaacaaattgataaattggtgaattagagaataaccagagagcactttaagagtgaactcatgaaaccaattaggctgaaaccctttacaggtgactccgtgctagtaatttagtgtggacttacaatgctaaggtttcccttttgcatttctgcttttctagttgaatcttgtagttacataaccacattatatatagtagcacccttcctgttgggaaaacaaaacaaaaagccatcgttcccacctcttaaagggcaaaagaaatgaggtggtgattttcttggtagaacacattcctgattccagtattatttatgccactgaatacctctataacattgagcaagtcagtgattcttgccatgatttatctatcaaattcaaataacaaatcttttcactcactcactcaacaagtatctactgagagtgggttatgtaccagtaagggtgcctgggatggagatgccatagtgaaccgtagagaccctgttgctgcctttgtaaaaagcttattgaatagtgatgaagagagatattaagcaaacactacagaagtttaaaattcaacgggtgcaagtgctgtgaaggaaaataacagacgctcatcatcacataagataacaatattctatccataagcacacaaaattctctcaaagcaaaatcctgttgccctcccactgggtagtccagagatagaaaaaaagaggaccctaagaatctggagtcaaaatttcctctctcatttcccctggcctgatctttatctacttccagaccgtctttatcctcgctgcagtggcatcaaaggcacgtttgcatttccccaagtggtggcgtctcactgagctccgcagagacgggggcctgtgatctgccactgcaggaagtgtgcgtgtctcggcaggaagcgtatcccccctgccttcctttccctgaaggcggggttcaaagtggagtctggactgagatcaaagaggaagctctgcgtggagcacagcaggtacctcccagctcctcacctgtctgcctgggagacactggtccaagccggaccaggaagacagacagctgaccatggcatcagcaactgaaagggatagagaggctacactccctccactctcaggagccatggagtaaagagacgcgcaggcatttccgtgctcatgaatacccggatgttcacgtgggagagagcgttgctgggcaagacagtgaaggagggaattgctcaagctatttgctcatgtatttttccaagaataagcacataaagataagaaagctacatattttgatccgattctagagctagcagtcgctgtgttgaaagtgatggcggtgatgtctaacttgaatgtcacgcccaatgggaaacatgcccaggtaccctggcgccactggcttcccccacaacgccactctctatcattgcctcaaataccacggaggcttcccttcgttcattgacatccctgagaagtgggaagggggtacttttggtgattcacacacacaaaagttatgggtatatgtgactgactcctgctcaggtgtgaagccacagctcgaagataccagaaaatcaactggggggttggcacaccttggcacaggagggcggaggtacaaggaaacatctctttattgtgctaccttttcctctctttatgcaatgtgactttctgtgaagagagatggataggcatattaagtgatattacatcaaattaaaattaaaacaggctggctgttatggctcatagctgtaattccagcactttggtaggcttagggaggaggatcatttgaccccaggagttcgagactagtctgggcaatacagggagatcccatctattaaaacaaacaaacaaacaaacaaacaaacaaaaaacattaattatccatgcatgcgagcacatgcctgtggtcctagccacttgggaggctgaagtaggaggattgcttgagcctggcaggtcaaggctacagtgagcagtgattgcaccactgcactccagcctgggcaacagcctgagactccatctcaaataaataaataaagtgaaaacaaaataatttaaattttaaaaccttgaacgtttgctaagagacttatcatttatagatggttttctctagtattatgttaagttttttgcctaaacaagaatatgaaagaaattccatattaaaaagctaataaatacacttggcataaatatgaatataaaaatataataaatatgttataatatatatattaatataaaaatatcttgactctcaatatatcgaagatactgaaagtttaatctcccctagtgtgtagagaaccagagttattcctgccatcatttttcttccttctgttactctggtttccttagaagcattttcagagaagaatccagagcgcactctgtcttggaaattgccggttggtaatggagattttaaagactgtatttgtgaatgcaggtaagaaaaataaggagacagagttgcattctttatagttatttttattctctattattgggaaagattattttctgtatttaccaatcagcttggtaaaccttaaatttaaaaaatatgtatgtaataatacattgtttagctgcttgcatttctcatgtcaattttgcaataaaattgttttctgcttacaaaatctgtcaaattcaaagaagctgttaacatacctatcacaacatattatttacactaataattatctctgtctgtgcaattccccactctacacatactaatgcatttaagtcaagtttattatgatagtgtttaagatttatttaatgcctaaaattatatttttatgcataaacatttcagtgttaaatgattaattaggtcagcaaaatattttaaattgttgaactatatttgtaagtgtgaatgcatatttaattagaaaattacatttaataagttaataaaccaaattctacttaatcatattttaacaattacaatccccccccccccttttttttttttgagatggagttttgctcttgtcacccaggctggagtgcaatggcgctatcttggctcactgcaacctccgccttctgcgttcaagtgattctcctgcctcagcctcccaggtagctgggattacaggtgcctgccaccacgcctggctaagttttgtatttttagtagagttggggttttgccatgttggccaggcttgtctcaaactcctgacctcaggtgatccacccacctcggtctcccaaagtgttgggattacaggcgtgagccactgtgcccggcctaaaacccccacctttttttaattttttaactgagacttctgtgtaattatgttactgacagaaaaataatgtcttcaatttctcagataactttcagagacatattctttcatttgtttactttcatagatatcataatttcagatcacagtttttcagataaatttatactatattaatttcataaagtagattcttatgcagcttaacatgtattttcagtatataaatacaaattgatttcatatatacttgtgaagactgatgccttgggatttagaattattttattaattatctaaactggccaatttttaataaagacatcgagaagttgtttaaagtatctgtgttttttctgaagttcttttcaagtctacagggctggacctttgaagatggtttttcagtacacttgacctatatagcaatcactgacctgaaatgataaaccactgtcaattaataaaatacatgttacatgaagatactgggttgtcagcagtgtttaccgctgtctctgggaaagactgaagtgccatataactgtaactaataggcgtttgaacagcctccgcattcttatgaagcaacgacttttttaagaaatataaactttcacaagtaaagcaccttttgcgttaaataacaccttttttaatatgaaaaggatattaaacacacattggatggttcttagaaaatcctttatataggtcctctaattgttttcaatatttatgataaacttttacatgaatcgtgcgtttcggtttctttattaggtttacgagtactggtaaaaatagaaatataatagtaaaaatgtttgtttagtaaagaacttggcatggatcagagagatatgtggcatcctcctggactctgccacatgtgtcttttccctggaatatattgacatatcccctccctgttaaaaccataatgacaagcatgatagttttagagatgtctctgagttcttctaatggagaatgaagcctcaggctggttttgggagtctgaaggggtttaggctttaaattcatgcagagtttagctaattctagatggtgttatataccatgttagaattaggaaaggtggcaggcatcactttaaattctatcaaaaaaggtagattttgttattttcacactgacaaaataattcgaagccagagcagttatttccatattgaaaaacaaagcttgagaaagcaataaaatcaaattaaatatttaattgtagttttttttaaatatcaagccagagtctaccatttacatatgaattcaaagtcttcacaccaaacttgcaaataagaagaggtttcaatcctgataatttcaaaagaatttatacatatatatgagtttctagaacggaaagtagacttaaagatttaaaaaatgttttaatgaaaaacagcccagataggttactgctatccttattttataaaattaattttaagtgctattttatatgtaattaaataaatattagattaagataaaatacttttaaaatgtggctaaagaattgtttgtagttattttttattttatttatttatttattttgagacagagtctcactctctcgcccaggctggagggcagtggcacgatctcagggcactgcaacctcagcctcctgggttcccgccattctcccacctcagcctctggagtagctgggactacaggtgcccaccaccacgcccagctaatttttttgtatttttagtagagacggtgtttcaccgtgttagccaggatggtcttgatctcctgatcttgtgatccgcccacctcagcctcccaaagtgtgtttgtagttatttttataataatacagaataggtaaatacagataaaaactgtgattttaaaagcctactgatatgcttcttttacttcttcagtagaaattaaagcacagccagatgtcttccccttttccccacaggatacaagtgcttagcatttcaaaggtccacggagttggtaatttcattattttttcattcaaaggtcctgtatgtatagtgtgagaatatcgggtttacagtaaattttctattgcatatgcattcttcctacacatagtatggatctatttattttaattagatattgaaaaaatgtcaaagtcatcataaaaatgaggcagtcacacagaagcattaaagtaaggattcctgctcagaaaaaggacgtctaaagagaccaggtcctctgttgcaccatcaaacgagaacttgcctccagcctctccgtagagcccctcttgcactattaaaccactctactattttctcctatggctacctgtacactgcgctctttcttacactgtttcttctacctggagtgttccacctccgagtagcaaaatgctatgtacctttcaaggcccactacaaaaatgagctcatttttctgaaatgcaaaatcaatatgaaattattataaaagctaaacaaaaagaaacaccaaggatcaaattaataagtaccctttttccctctggtcctacaatctgatataaccactgtaaagctgaacgctgctgacttcgcggagatttccctgatggcttcccaagcctgtgccatctccttccctgcagctcagtataccattcctcttgtgtttactattttgccatccttataatttccttggcaacaaggattgtttctttacttctaacttaacagcatgcgacatattccttaaatactaagtggagtgagtaaaacataatagattctcaacgaatatttattgaatacattaataaattactggatatgttcatttaatatttaatgtgctattatgcccatgaaacattaaatcgcccccatgcaaagtgatgaacttaccatcacatcttggaaaagggtagttccagtttctgttgatcccatgctgacaagtgaggacaggatggcctattagaatgtacccaggataacactcgaaagatactgattgccccacgctgtaatccgagttgatcatgtacccattctgaaatgggggtggatctggacagttctgtaattcataggctgaaagaaacaaacagacaaaataaagcttatatttgtgaggttaaattacttcggaatttgcaggagtgtcatcacatgtgactgcttgagatgaagttgttggataagtttaataaggtatattttctaagtagtcagttgccatccagaccaatataattattattagtagtagtagaatcataaccatatgcatttaataaatagtgtgtactttaaaaggaaagtagcacataccaaaagtaaattttataatgcttaccttggaaaaaaggcatatgatgtaaattatttaagaaagtaatacaggctgggagcggtggctcacgcctgtaatcccagcactctgggaggccgaggcgggaggatcacgaggtcaggagatcaagaccatcctggctaacacagtaaaatcctgtctctactaaaaatacaaaaagttagcctggcgtggtggcgggcgcctgtagtcccagctactcaggaggctgaggcgggagaatggcgtgaacctgggaggtgaagtttgcagtgagccgagatcttgccactgcgctccagcccgggcgacagagcaagactctgtcccccgccccaaaaaaaaggaaatgcaagtaataataaaaggagcctacaaaaaatgttgggtgaacatatacctaataattcccttttattttaaataggaaatatactaccagtctgagtactcctaactggaaaatatgtcgttatttggtttaactatacaaatataacaggaaaatccattgcagtttttttagtctttttctaaaaaaaaaaaaaaaaaaaaaaaaaaaacactgtataatccctaagctgacaactactatcagtacaattttttataacatgatttattgtgctttatcattcagtctttatgttccctagaataaactccaggtaagacaagagataataaatgtttgcagtctgtgtggtttaaacatttactcattaatgagtaagaattaactaatccataaatcaggtatcatctgatactgtaattttaaagctaaatgagcctctcgcccactctgggaagagggcgtgagtactcaatgcagtagaagccctctctagcatctttgaatatttaggcacacctttgtccataaaggcagttcccatgagactgggaacctgctcctaatgcagcagcaaagccacaccatgcagcaccagttctgggggaacctccgccctgccatgtaattctgctgaaaccaaccctcagcgccaggcaacacaatgagtttcaaaatagcatgaggtcaccggtcactgtcctcacaatcaactgaaaatcaagtcataaaataaagtctccgagcttctgcagaggggccttttctgtggagaatgaagtgaaatggaaatttcaattttatgtgtaaattccttaaccattgacaatattggagtgagcctgtagtttggaaacttgtaaacaaatgctggaaaaggaaacagtatattattatgacaggtgtttcccagaattctagacttttttgtttctgtgttcaggacctgagaaaaagagaggtgggccagaaagaagataggacagggcagaggggccagcagacaggggatgggaacacaaagagcttgatgcgggattactcagggattagatttaagaggcagctaaggctcagaatatgaatcagtctgtgttttatattaaagcaattggacatcaacataaagataatgtgagaacatatggaagacagcaaccaggcaacgcaatatgtgggcctacagcgtggccttggcgttcacaagattaatgtaagtgctgtttggagtttgtcttcattaacatttgccaaatgttaagcattccatagagccatgaggtttcgttattatccatagctttctcctatttaataaactaatgaaatggcattgttgcctctttaaaatgacaatgtgcaggctgggctcggtggctcatgcttgtaatcccagcattttgggaggccgaagcgggtggatcacaaggtcaagagattgagaccagcctgaacaacatggtgaaaccctgtctctactaaaaatacaaaaattagccagggggggtgaccggcacctgtaatcccagctacttgggaggctgaggcagaagaatcgcttaaacccaggagcagaaggttgcagtgagccgagatcacgccactgcactccagcctggcgacacagtgagactccatcacaaataaataaataacaatatgcaatgctagtgagtcatttcagtaactcaatgatggcaacattatttgccacaactgtttgggaaagtcattagaatagggccataaaaaatcagttgtaatattaaacctagtaatacatttacagaaatctctattatgagcataatttctaagcagaaaaaggtgaatgtttaaagatgttcattgcagcattatttacactacagaaatccaaacaacaacaaaaaaaaaatagggagagactcataaatgccagtgatgaaatgtcatatctttcaatagtcacagattgtatagatttctgtgtatttatttatattttcagtattgtaagcatactatgcagttgacaacagcttcctgtggttaagccctgactatagtcagcaggttaaaaaaaatcctttatttaacctttcagcatcccttggttttaattattttcatttatgcaatgatatgtctctgaacaagagtcagagacgcagcagaaaaatgattgagaacaagaaaaatcgagatcagaggacacatagtggcaaaagcatcttgagataattcctggcattggctcccccagggacgagaagtgggaagaacactatgtgagacaaattcctcccagagcgggagaggaggaaacttcacctggagggaagcgctgggcagcctctgaaacccagaaacccactggattatgtcgctcattactaacagagctttgggggctccctaagagctccagacatcacctcttttacctactatctaaagatgtaaaaggctgggagcagtgactcatgcctgtggtcccagttactagggaggctggggcaggaggactgcttaaggccaggagtcgaatgctgcagtgagctatgatcataccactgcactccagcctgggtgacagagcaggatcctgtctcataaaaagcaagcagacaaacaaacaaaaaacagatacaaaggagtattgcctaattaacaagatcagtgtgaatatcaagtaatttatatgataaaacttaataaactgtcataagttcaaataaagttattacattttatttataatgcacctaaatattatagagaattagctgtattttaggttggtgaaaatgtaattgcggtttttgccattactttcaatggcaaaaacctcaattgcctttacaccaacctaatgtatatcgataatatgaaattagaaacagtgtttgaaaatgagtattctgattaactcagtgctatcttttgagatgtaatctttataactcaatatttacaagctttatatacagaaaatccaagataaattactagttatagaatgaatgcttttaccccataaatgtatacaattataatttgccaattaaaaatgttattactttaaaaatatgtaattacaaataaaaaaatgaatgaatgttccagtgctgctttctggtaaagctacattataccatggaactactgcgttgattagagacactctacaaagatttactatagatcaataaaccttataagcacaattgctattaataaagtttgcaaaataaaaaatatttttaactcacaattttgtgaaaatggaatttgcagttgacgtggtatggctgtgtccccacccaaatctcaacttgaattgtatctcccagaattcccaaatgttgtgaatgtgggagggacccaggggaggtaattgcatcagagggtccaatcaatctcatactattctcgtgatagtgaatgagtctcacgagagctgatgcttttatcaggggtttccacttttgcttctttctcattttctcttgctgccgccatgtaagaagtgcctttcacctcccaccatgattctcagctcccccgaccccagccatgtggaactgtaagtccatttcaacctctttttcttcccagtcttgggtaggtctttatcagcagcgtgaaaatggactaatataacagtccaccatacagtagctacattatatacaatagtgtttctcagttgtttttgtgtctgataagtagaatattggactgttggaatcttttacatcatacttggcttcaaggaaaaacttctccaggtgttcgaaggaagaatattcaaacccctatgaaacaattatgtcttaaaggacgtagctcaaaggctacagtggcgtgtccctcatgattgattgtttttgttgttatcacctatttgaaaaactagatgcttagaaatctaagctgataaatgtagggacagggaacattaaaacagaaagccaggccaaatcagcatctctctctttctctgacacacacacccctcatctgcattcccccatcgtgtggctccctgggccaacctgtcaaatgcatagcaaggccaccgctgcctctgccagggaccactccaggctgaagtccacaaaaacagccttttcttgaaagccactgccaaatggcctagaaaacatccacagtgcctggaatgcctcctcccaatactgctatttggacctaaaattgctttagagacccatgctcacaaaaaagaatgaataattccacactgagtttcaactatcaacacatttccttctttattattctcttttagaatgaaatcagcaattcatttctcattcttgttttgctttaaacgtaataaactctcttggaaaaatgagtcctactgtacagcaaatatgaacgctaataaaacgttaagaaaaaaaaacatggaaagctgattgctggtttctagaggaggagaagcaaataaaactagattcaatagaacctcatcttcattagaagatttcatccacgaattagcagtgccttggaagtatacaagcctcaattaccagaatacaatattaacaagttaatggttcataggtactcctggtgaaccttcacttaaaacagcgtttaacagagacacacacacatttacaacacaggagtgttaatagtatgtaaggcattgcattgccttagtttggctgtgtagtctttcgggtgacttaagaagtacaattaagttcttttttgggataggtaaaactagtgttgaaggctctagcgcccttctgctcatgaaaataacctctatgaaaaacaccgaaataggacatttgaagttgtaattaaagattctaagcccaatggctgcgggctactctaatcactgaaaaaaattgttgttgtttttttttcttttctcaatggcaacaaaacaattatcctgtgtgcgtgtggggaggggggagcagattagcccatatgggcagtacagtggttttcattattcatttattgagtgaaataaagattatttattgactctactctgttataaatgctagttataaatggaaactagaaatgcgtcttactctggtgaatttaggcaaattaaagcatagatgattgtataaaagaattgtaagttgcataaattattattaaaaaataaaaagtggattgaagtaaagaaaatataaaacctggttaaggttatgcagtagtggtcaaaattgttttgttgaagaaatgacgtttaaattaagatctaagtaggaaaatggtgcagatcaggaaaagaccaagaaaggcaggcttttcagccaaaggaaatagtatgtgttctaaacatagaaagagttcagtgtctgggataaggggagagtttcagaagagagatgacctctgcagccccttctcctaaagtgtgtgccccttttcacactctcctaaagtgtgtgccccttttcacactctcgccacctcctaagtggagacgaagtagtcgtcaaattgttcagaccacaggacgttcattagaacacattttataagtggacacagacatattataaaaacccaggacccattttttcacctgataaatcccatctgccagtcaacatcataatgatgacaatgatgattcaaaacccatggctcatttcagaattatctcaagaatttaaaatgccaattagtttctttttctattgtaaactatacactaagtaagagtatcactaagtaagagcatcagttacactattttttggtctttgttccaaatgtcttgttaaactgagtacttaactacttaaatattaataccgatattccctcaaacttttgatgtataaagtcatattctctcttttctcaaatgtcttttccaaacttggattcactgtcacacttcacacaataaggtataaaggactatattaggagtctgaatggaaataactaaaaataagtcatgaagataattcctgagtatgctgaagaattttggaaggatcctgttgcatcctgtttagtgtgagtgtgatgggtttcatagtgcctgtgctggcttcttgcaggtgcctctgaaggacttgcaatgcatcacagtgccaggccacacaggtgtgagagggcgaaggaggcgtcaatctgctgtcagaaccctcatcacgcatggccttcttgctctgtacccatcataaaagcattcaccctcataaatgggttgtaaacatataaaaagttttaatttaagaaagaaagtcatcaagtgagagaaaaagaaaaaaagatcacttcagtggaatttgataaagaagttaccttctagggtaaagggtggtaaaagccacgattatcaaacaaattctgattcagctgaaggtcacaacttctgcatccccatactgggcaattcctaaagacttctgaaggcattctctctattagttctataagagttgttgtattatctgtcattaaaaagttgaattaaggccaggtgccgtggctcatgcctgtaatcccagcactttgggaggccgaggtgggcagattacctgagatcaggagtttgaaaccagcctggccaacatggtgaaatcctatctctactaaaattccaaaaattagctgggcgtggtagcagatgcctgtaaccccagctactcgggaggctgaggcaggagaatcacctcaacccaggaggcagaggttgcagtgagctgagatcgtgccactgcactccagcatgggtgacagagttagactccacctcaaaaaaagaaaaaagttgaattagagaatcatcaacacatgaagaaatctacctcggcagtacatacatgagccttgaagtagttttgcaaaataggtgaggcaccctggtgtgacctgagttcagcctggttgtgccaatacggggacttgaacattccacttaatcccaggaggctcatttcttcattcatgaaaggagactaaatatacccatctatacaagggccacagaattaaatgggatgctaaaagaaatgaatcagtgttggcatatattagttcagtaaagcttagtcttgatggaaagaattgtctagtttctttgataaaatatttctcattaatcaaggcaaagccctcgagcaactgctctgatggagacagacccaggaggaggctactgcttctggtggtgggaattagggtgaatcactctaagaaaagggcattgctacagagaatagggctgcagtttacatcaaggtgtacactgaagactttgaagccccgcttgagtcctcagcttccctatcaatgaaaagatccatctggggtctcagtagcatgtcagccatgaatggtagtccacagaatttcccaagtgcacacatacagaagctcaccaatttcccatatctatcggctattctaaacttctgggatagcatatcactctttctttataaccaaggatatcaccctggttctcaactctaagacatattttctgcctaattatgctccatttgttctcttagctcctagtcccagcacctgcttatgaagccaaccaaactgttgcaaaagttgtcagagttttgggcctcgctgagactacaggcttatacatcaatgcttcgggaggaccagcctgcacatgaaacgtgctccctgcattgcaagagaggcttgcagcaagtggaatgtggaaatctgaaggtgccttcacctaggagacgggtctactgatgcacgctgagaacgtcagcttttggttcagaggaatggatcatttaaaggagaaggtgagagtgttgcttttgctttcagaaaacccatacaagaaggagtagatgcctgtgatctgcagggagaacatccgtcaacaatgaagattcaggtcctagtttctaagagtcttgtccacaaactaaggggaatcttagccttttctgtctcgtacatggttgccctagcggggatggggattgctacaactctttggggtcactgttggaagcactttcatgcaaaagaggcatctttgtaaagccttaggttgaaagctcaattcactcatgcagacgggtaaaaacagagactgagtaagcacccttgccctgttcccctaattactcaaagtcgctcagaatcccccgttgaaaggaaaaggaatgatgcagttttagaagcatatcaactttatgtacaaattatggtttgtatacaagcaacagtttgcatgctcacataattcagaatgaattgttcagatgttcattgtgcctggaggtggcttaattgcttgttcttctaaaggggaaaaattggtataacaaactatagcctattttctaagaaaatcatttcacataaaattcagcagttttatgattgtgatgaagaataaacagatttaacacattcgattatctttaaaaatggtgtttggcacacatagcaaaaggaagaagaaaaacagtggaactttgaaaataaaagacatttttacttgctatgcctaaagcattaaaattatctttgagattttggcattgaataagttttctttcccaaaaaagtttatgcattagaatgcagcaatatgctttataacacagaaaagaaagagaggaagatactaaagaacaaaggaaggaaaggagggagggaaggaatgagagggagggagggaggaatgaaggaaggaaggaaggaaggaaggaaggaaggaagggaaggaaagaaggaaggaaggaaagagggagggagggaaggaaagaagggagggagggagggacttaacttctccaaattgcaaaacctaaaagaaaaggaagtcactaaaatctttaacatggcaaaatttttatgagtattatgaaaatctaagtatcaataagcccaaggcaataccaacaaaagtaaaataacacagagaattttatcttttataaaggaatcctttgtttagatctgaaaaaaataactattattcacatcaagtttttaaatcataagtgcaacgagaccatgcagtaatccccctaatgtctattttcccgctaatatctagttagttgataaatatcttcatgctattatcaatttttcaattcttgacttagaaatagagtgcatggcttgattttaccaaagttcttaataagtcatttaacttcaagacagctacgtctatagtaacatctctgacctttacatggtcataaataaatgacaaactttaagaataaggtgtacagcacagacatcattgaaaatgacaagaattctctgtatgatttatgcatcttcttaggagttattaattataagcttagcttctaaatctcaagtagaacctaggaatgtttatttgacttacatatcagagttaagtgtcatcttatcaatttatcaattttataaaatggcaaacactgacaaactatctaattaagtgtcacctctgtcagatatgataccctacaagaaaataaaatagctcaaattcatgttctcatttatttgtattatttatttttatatctcagtgataggaaattaatggcgtacaataaaaaacatgttgtttcgagtttttgttttttttttaattgaaagtcctttcttctccttgacatctggcttggaatggggtgtcaagacatgggaaagcaggaccaatgtttccagatcctcctattgcaagagacaaagggaaagcagatctaagggtatctcacaaatcctttaaaagctgcgtgacaaacaatactagcatggagttaagtgtgaagcaaataaaacacttgcttagccaaccagatgcttgacctaggagaggacttatgctttctaacgctcaaaggccacggagtcaacatcaatgagcaagacagtaagaaactagaggaggccctgaagtcaggcccactttgccagggttctctcctacgtgggaatgcaggacaaatatttccagactctgctattgcaggagaaaaagggaaaggggatttatgggtatctcataaattacataacatggaattctaaatactgataattgatttttgtaaatattaaatattttgtgagtcaaccaaagcaattgtctgacctgtgctctagatgattcctacatgggctttttgcaggtttgcttgtttgtttatttatagaccattattacagattgaaataattggtagcttttggaactacatagacatggccttaataaccttacctgtaaaatatcaagagtaaaacacaaaaaactatggagctgggccgggttcagtggctcatgcctgtaatcccagcactttgggaggccgaggtgggtggatcacttgaggtcaggagttcaagaccagcctgcccaacatggtgaaaccttctctatactaaaagtacaaaaattagccaggcatggtgacacacacctgtaatcccagctactcagcaacaaaaccattttttaaaaaaaaactgtggagctgggccgggcggggtggctcatgtttgtaatcccagcactttgggaggctgaggcaggcaggtcacttgaggtcaggaattcaagaccagcctgcccaagatggtgaaaccctgtctctactaaaaatacaaaatttagccgggcatgttgacacacacctgtaatcccagctattcagcatgggagaatcacctgagcccggggggcggaggttgcagtgagccgagatcgcgccactgcactccagcctaaataacagagtgagactctgtcccaaaaaaaaaagaaaagaaaagttaaatgttgaatatggtattaagaatattcaaaatgtgggagacttgcaagtgcttggtgtcaactgagatacaccaattaattgacagttaatggtttatggcatataattatgttctatttttcttattggctcagatattaagatcatgctcattaaaaatggaaattaccatgtaatgagcaagtttaacatgatgatcacggaggaagtgtttgtattttaacaggatgtagttcactaggaatggggcaagggaggggacagttgagcaggaagatgggagagaagcacaacattcatcattcacattattcaaattgtacgtcgtgcatacagccagacgaggcgatgcaggtgtgttggagctgaaagcctcccgcccccaattcctggaagcctcttcactgcttcccctgctctactcttccctcgcttcccccaacccccatccacatacaattcattctctgcatgtaagcaacttctcatttgcttgagcttcttcagtgacatcacattgcacctagaaaacaacctgaatgcgtcacagccaaatccccaggccccctgacccggggaagccctctgaccttccgctcccagtgcaccagccttgttcctttctcttctctcaactcatcgggcttctctccacccagaactcttcctagcacgtgcagccatgtctccttccagtccttcaaatctcaatgccaccccagagagtggcagaccccaggcccccgctcacaacctaaacatcaccccaatcatttcctccacagcaggcaccactaacacagcttcagcctgggcacggctgcagcctctatggctgcaacttcaaatcaatgccctaaacatatgtttttgcctccagtctcactctatttgcaacaagtgtttctgtaacagtccatatctacattgtaccagattaggctcttaaaatgtgtctaaggtcattgtcattctcactttaaaatccgcgatagtttcttacggtcctccagcgttcataactgttttaatctgaactactttggcattctgggaagtctaataagtttctcaaactaatgtcttactgtataaaataaaatacataagattacaaaggaaaccagccattttaaaatattcctacaaaagtgcgataaagcaaaatttgtggcttaacattatgtatgttatttcactaaacaacacatggccaagtctaataactgaggcaacttcaaaccatggtgtagtaacattttgaaatatctgcacatgtatacatatgtaactaacctacacaatgtgcacatgtaccctaaaacttaaagtataataataaaagaaaaaaaagaaaaaataaataaataaaataaaataaaaaaagaaatatctgcactaaatgaaacaaagcaatggattatctatgatttggtgacaaagtcacaggttatgctaatactaattttttttttttttttttgacatggagtctcactctattgctcaggctaaagtgcagtggcgtgatctcttctcactgcaacatccatctcctgggttcaagcaattctcctgcctcagtctcttgagtagctgggattaaagttgcctgccaccatgcccagctactttttgtattttaagtagagacggggttttgccatgttggtcaggctggtcttgaactcctgacctcaggtgatccacccgcctcggcctcccaaaatgttgggattacaagcatgagccactgtgcccagcctgctaatactattttaatattattgcctgcctttaaaatgtaaggaaatgctaaatattaattaaagcttaaggggaaaaatacataatattgttatgtatatatttaccatctgagtaatagattccttgaattctatcctcaaggccccagaactattggtgtagagaactaaattcatggtcttaacaggggatgcaaattccttcacaatccaataccatcactccactggctcatgtccaaactcatccttcacctttggtagccataatgccacctctagtgtaagccagggttcacacgtggcctccaggttctgctcacgtggaactttctcagggaaagcctgctcagtgtgcctgctctgcgaggccacccagtgggttttaccctcagacctcagcagatatctcagtcacagagaggatcatgttggattttaattttgtaattgaaaatctagttttctattaaattatgacattattttacaaaacacccatgtatcttttttttttttaattcctagctcttggcacagaaattacattctcatgctagcctaatacatagacggccttcaaaaaaatttgacttaaaatacaacttaatgggtttagattacagagaccttcacaagttataaaatactacaataatgttttattcaaaaatggaaataattaaacactgatctatgaaagtaagctgtttgtcttcaaagtgtcactttgatgagttcagtctcatcagttctagatagtgttggggctcaggacaccaccccaaaatatgactctagaagaccagaatatgccaccccaaaacacacttctttggtatatttccaccagattattctgagaaactgcagatacaaaagtagttctgaatagctgcatcaagagggcagttgctttattacctgagcaattgtaatctgcataacaagacaactattcaccatatcattccttccctcactctctcctaatttgactccactactctggagaagcccaagctcttatttctttctggagctcaggagctacacaagctccaacttcttgccctttaatcctaggaaacaggaaacaggaaggttaggaacccactcccagccttctgtgctccaggaaatatctaagtgggaagaccctccttcgcccaggtctacaagaaggctgagggtgccgctccgttcacctgggaggaacctctcccacttggcctcatatgaggttagctgacttgcctgtcctatggatacactggaataaaaggcgtattagcccagctctgcgtgagcctgcatccttccccaggcccctggatgtcacccactgcagcgtgggccggcacacagcttctcctcagcgacctgggggaggccgacctggggccccttcttggctgctgctgtcctcctgggccttcttggctgctgctgtcccaatggggccccttcttggctgctgctgtcttcctgggtcccccgcctgctctttctatctcactgctctctcaacaggaggctactttccactaccctccggggatgccggctgacctgaggatccctcagagcctcccctttacaatcgtcctcagtctctcctgaaagagcttgggtctgtcttgtgttggatgccacttatagcagctgggggtgccttggcctcaggggaagagaggcgcccctgggagcagaaggcaatcctgttactgttacactggaaggctcacgtggacaccggcagacgagagtgaagcccctaacccaccaggaatgaaggggttctgaggagaaacctatggctgggctttagggctgcagtcaggaggggcgggcatagagcttagctctgggaaggggaggggtgagtgtgatcagaggtaggcgaagagacaggaggctgctggcaggagtgcccagcacctctcgctggctcaggacctacaggttggactcattccccctccatgaactgaccactgctcatgacactcactgccaggctgcgctgcagctgcctcacaagtcaaactgagaaagggtggcatggccttaaaggccggtcgaattcttgcaaagtcctagaaagtgctctgtcaggccgggcgcggtggctcacgcctgtaatctcagcactctgggaggccgaggcaggcagatcggatcatgaggtcaggagatggagaccagcctggccaatgtggtgaaaccctgtctccactaaaactacaaaaattagccaagcatggtggcaggcacctgcagtcccagctactcaggaggcaggagaatcacttgaaccagggagttagaggttgcagtgagccgagagtgtatcactgcactccagcctctcgacagagtgagactccatctcaaaaaaacaagaaaaaaaagagaaaaagaaaaacaaaagaaagaaaagaaagaaagagctctgccagtgtttgctgcacaaatcaagggcaagggttctgatgtccggaggccgtgatgttaggcagttcctgaaccatgaccctggatctgcaagaggcaatgcagccacagcggacatctggattccacggtcacaggcagcacctgcatccaaccacgaaggcatgcgctgcaagtccttgtggagaacgtttgactctcagggttttggcgaggctattttcacagccgtaaaacttgagaggagcaggcagatctgtcaggtgtcaggtccaaaacgaaaaactgtgatcggagttttcccacagtggccgttctgcagcttagggatggtcgagtggttttgcaacttgtgggagaaaattgttctttttaaactgacttcattaggtttaaacattctttcccctgttagtgcactgactaaatcgttggatttagaatccaaagacttcatttcccttccttctgctgaaatacaatagcttggctgacactactactttggtgtctagcagacttgattccaaatcatacttccacaggcagctgtgcacattttcacaatttgccaacctctctgagcctcatttttcttatctgtgaaatgtgcataacccttggaatttatgtggaaatcaggaagcatagagtgtggcgcagagtgagcacaccatacgtaacagttattattgtcattattattactgagacagggtctcactttgatgcccaggctggagtgcagtgatgtgatggcagctcattgcagccttgaactcccaagctcaggcagtcctcccacctcagcctcccaagtagccaggaccacgggtgtccaacaccacgcccagctaattttttgtagagacagggtctcaccatgttacccaggctggtcttgaactcctggccttgagcaatcttcccgccttggcttcccaaagtgctgcaatttatttttaatatagtaaaacaggggcaattagctcttccaaaccaactaataatacttctgcagaagcacatgaggacataagaaaacactaataaaaatctcttgcatacaaatacttcatttacatagagttttaatccaattatatcactgttccatggcatatgtattatgttgtttttccaggtaccttcttaaaggaactggcttcttcccctttaaaacatgctcttgagtgaagtctgctgatcacatttctgactctgtgaaccggcttcttcccctttaaaacatgctcttgagtgaagtctgctgatcacatttctgactctgtgaaccggcttcttcccctttaaaacacgctcttgagtgaagtctgctgatcacatttctgactctgtgaaccggcttcttcccctttaaaacacgctcttgagtgaagtctgctgatcacatttctgactctgtgaaccggcttcttcccctttaaaacatgctcttgagtgaagtctgctgatcacatttctgactctgtgacccaagttgacctaacacatagtctctgtccacctggcctcagtggctggacttagacacaagctggcccaccaagaaagtgttcccaaaatgtttagcaattgcagtaggagaagcagggtcctgtccttgctgagcagggtatggttagattggggacatatcatccatgtgtattagggcagaaaaagctatgaaaatcacaacaggggcaaaaagaattcaggtgtcactgaggcccaggctccagacatgccccagcccacacagctgtcaccttgcacttctttcctaaactagtttcattcagatttctatcatttacaatcaaagagggcagactcatggggaacatcctggatctttgtccccccctcatgcattacatctagccactaattgatggctcatctatggagtccgggttagtcctagaatatgatcaaggctctattttcacaattatatgtaacagtgatacacgtgtctatgtgttgcagagaggacaaccaagccttttttttttctttttttttttttgccccccgagatagagtttcgctctgtcacccagactggagtgcaatggcatgatctcggctcactacaaaccccggtctctggtctcccaggttcaagcgattctcctgcctcagcctcctgagaagttgggatcacaggcgctccccaccatgcccagctagtatttgtatttttagtagaaacggggtttcaccatgttggccaggctgatctccgactcctgacttcagctgatctacccacctcggcctcccaaagtgctgggattacagacatgagccaccgtgaccggctcatccctttcggatttctggtagcgacggaagagatgcagtgaatagaagagaagaacaccactgccattgataatatttttatatcagtggttatacccagggtacactcagagctgtttgcacacatgggtaggaccaccagtgcctgaggtaatccttggggtcatgtttcctgaaagtaactgtgaatcccaccatccctgggtaactgatacttctctggctgaaagcacaatcccttaaagaagccttctacaaaatccaacattaccaagactggacacatggtatttgtgccagtatctgcagtgacatgaattggctaaatttttttaaaaatttttttctatgtaatactgttttgaatttaaaaacatattttttttaaattttattattttaattgagagataataattgcacatattcatggggtacatagtgatgtttcaatacatataatctaagtgatcagatctgggtaattactacatctgtatgttcatcatctccagcctttatcatttctttgtggggggaatgttcaatatcctcctggctctgtgaaatgatgggacatattattgttgactacagtcaccctaaagggctagagaacactagaccttattcctcctatctagctacaattttttatcctttaaaagagttttgctagcaatatccgcaatgcgtagggactaaaaattgatttaatttaatgaggaagccggagcacagacctcaaacaaataaaggcaagccctgcacaggtgcttccgaaaatgtatatgcagcacggcagaaagtcccttagcatcagggggaataaacacctcaagtatggagctcacaggtgtgcactggggagcaattacaggtaaggcactgcgcttcctgctgagcgcggagcgaggtaaaacagaaatgaccgtcaccttcatgcagtgtattgttttcagtaaggcatcctttaaacatagaaatacagttgtcccttggcttttgcaggtgggttacaggaggaatataaaataatggtgcattttcataaaatctaagcacactctcttgtatacttgaagccatctctaaatttcttataatactgaacacaaagcaaatgccgtgtaaatagttgttattctgtatcgctcagggaacgatgataagaaaaagagtctgtgcatgttcagtggaaacacaaccatgtgttgtgtatttcagaatattctgatctctagtgcttgaatccacacatgcagaactcatggatgcagagggctgactgtatacaataaattcctgattttaaaaagtcccagggtatgcctgtcagtctaggttcatttatatggcattaacaacaatatcccggctgggcgcagtggctcatgcctgtaatcccagcactttgggaggatgaggagggcaaatgacctgaggtcaggagttcgagaccaacctggccaacatgggtgaaaccctgtctctactaaaaataaaaaaattagccaggcatggtggcgggtgcctgtaatcccagctacttgggaggctgaggcaggagaattgcttgaacctgggaggcagagggtgcagtgagctgagattgtgccactgcactccagcctggacaacagagtgggattccctctcgaaaacaaaaaaccatatcccatatctcagtgacttaaaataaggcagcttccttctggttccaggttgggatggcagggaactctactcctgtagatactcagggatccagatgactgagtggccattagagcaaactaaattttggctcttcagggttccatcccaagtgacattcactccaatttcatcactgaaagcaagtcacaccaccacacttcattttgaaggcacctctatcctgagtccagaagtagagagaatgggagagatttggtgggaatgctcgtgaccagcacacaagaagaagcacatcagaattcaagcttctgaatgaggagacctcccctggtcggagtactcagacattgcctcctgcagggtattacatagaaacagttccgaatgactaaccaaagagtgggagtggagatggaaagcattgcaggctgagattgctacacgtgcaagagctctgaggtagaaaggactgtggctgctggagatatttcagaggggcaagtgagaatcgagacagagaaagaaccacagcctgggagacagaaataagagcttagccagagagacagcagatccttatagatgttgaacgatttcctgaaaatctaagaaagcatggtaaacgctttcatcacaaaaggaataagtccggtctgccttttggaaagaagagagaagttggaagagtaaatctggaaagacatttaggagtttggccattttctaggagaaaggtctgagagcagttacggctactggtggtgacacagggaggcagccgcagattccaggaacactgcacctcacacttagtgagatgggggcactggaggataagctgggaagcaaaactgcgagctcagcttcgggcacatgtttcagtgcctgcgtcattcccagaggaggtggaaaacaaacattgtgtcctggcgcttgcagaagacttgagctggaggcacaggcacaagagttatcagctgtgaatggccatcatgggctttgaatccaggagtttgaatcacggaaagcataggatggaaatataggaggattccaacctcctatatagctaaagtcagttagaagtggtcaaggaagcaaagaaaataacaacttagccagagagatagcagaataacccagagattttctggcccctgaagccaagggaaaagggcgtcaagagaaatggtagccatgctggatgtcaccaggagacatgagaaaggaagtgtgcctccagggctagtgacattaacatctcctgcaatagaagatcttgtcgatagaagaccccatcatgttagacaccaggtaaatagataggagaagtgaaaaacaggtgtagaaattgagaatgtttacataagttttctggaactatgttttagaaattagaagctggaggaagacaagaggtccaaggtacattaaaattataaatagatatgtacgtgtgtatgtgtgtgtgtcgatgtgtgagagacagatctgagttatattcaagatgctattggggaaaatttcatggatagtagctgaaaatgcagaaatagaaaatattctctaaataatgtctctgaaatagtaggaagagaggtacctagagcataggatagattaccgttttttttctttcttttttcttttctttctttcttttttttttttttttagatggagtctccctctgtcacccagactggagtgcaatggtgtgatcttggctcactgcaacctccgcctcccgagttcaagtgattctcctgtctcagcctcctgagtagctgggattacaggcgcctgccatcatgtgccggctaattttggtatttttagtagagatgtggtttcaccatatcggccaggttggtctcaaactcctgacctcaggtgatcagcccgcctctgcatcccaaactgctgggattacaggcgtgaggccaccacacccagccccgattacccttaagtaggaggtacattctcttccattgaaaaagagagagagcagagaatagatgcacaggcaagcagatctgtatccattttgttgtgggaagttgcttcctctctgatgttctctctctctctctctctctgtctctctctctctgtttttctctctcgtgcttcaagtagggaatgattagtgagtgatactgtttgctaagtagtaagaaaataaagaaggggaacacagaaagagtgtttcatagaaaaatgctggcaatgtctagagacatattgctcactggtttagtctccagtttcctctcttttttgctcctacctagatttccagtttaacagacctcaatcctggaagtctgtgtctatattttatattttaggtgagactacacataataatgccaaagagttcatcataaaatactagcctctttcagtaataaatatcaaagccctgtttctaagcattctgtggaattagggaaacaagtgatttaactatattaaaaaaaaaaaaagttaggctctagatttaacgttttcaacctcatttgatctagcaatattcaaggaaaggccatacaaattattttgcatgaaattaaaatgttgaactttttcacatgtcaaaaatgctttgatgatgcaaacttttcttagagattgcatatttgaaggaataaaaaggataaagttcaatcactgattttttttctctttttgtggtgaaagttgaacatgaacaatgcaggtacccattatctgtgctaaggcaaggcatacatacctgagagacctacagacttactgccatatggatcaactccgtgcacaatgggactctctgtgtcctgaagggacgagagctcagagggacatagtgacaaatgggaaagctacatgatgatgagactccccagttgagcacacagttgactacggccatgggagagagtgtgtgcaggtgggatgggagtacaggtgaagcttaggtaacacccgtacctcatcatcccctgtgcgtctgtgaaaccgcctttacaaaattatacctgaggaaattatgacagtgaaagaaaccagacctaaccaactccatcttgcttctaacctttaagctgtccttgttcattcctggacatagattgaattaatttgggaaggaattcaattcctggtttgactctgaaacaaaattgatcatggccctttcccgaaaagacccccttcttgcctggggaccagtctgtctttgcaggactaacaaattacctgtaagattagacattatggtttaggggtcatgcagcctctggttccaagtctgaacctccccaaattgctcctgggatcacatcactattgtaaaacctaacatcagtgcttgagatatgttgcagaccctgcacctggtggatcagctgacaccacccaaaccggtaatctggcccaaccagttctgccatcgcactcgggaacagcagacagcaagaaaaactcacttccgccccctgtgattccatctccaacctgaccaatgagcactaccggcttcccaagcccctgcccgccaaattatctttttttttttttctgagatggagtctggctctgtcgcccaggctggagtgcagtggcgcgatctctcctcactgcaagctccgcctcccgggttcacgccactctcctgcctcagcctcccgagtagctgggactacaggcgcccgccactatgcccagctaatttttggtatttttagtagagacggggtttcaccgtgttagccaggatggtctcgatctcctgacctcgtgatccgcccgcctcggccttccaaagtgctgggattacaggcgtgagccaccgcgcccggccgccaaattatctttaaaaacttgaatccctgaatgctggggagactgaattgagtcacaataaaactccggtctcccacacatctggctctgcgtgaattactctttctccattgcaattcccgtcttgataaatcggctctgtctgggcagcagaaaaggcgaacccactggtggttccgtctgtgtccttacctctgttttcaaaaacaacaagtgttccactactaaccagaaaccaacattccaccaaaaaattattccactcgtacaagcttggaaccagttagggagatttatacttaaatacaatttacatgtaagaagtgtatttagatttgggtttcggttctcgttgttgttccataccttggtaagcaagtttaaatccttgccggttttgcgaatggtcactataaaagtggatgagggtttcatgcgttgtgctcagcagggccgcggggagatccgtgccgctaaattgtccaatcatggggctggtgtggtaaggtccattttgaatttcaaggaagtcatgattagcttcggtagaaaaattcagaaactgaatatgtgcacctatggaaaaacatgcaaacttaatgaaagttcatatcaaaatgtataaaatcaatgctcataaaaagggactgaagtgttagcagtctccccagacaatccctctctgtgagacagaaccatgccgtggaggacggcattcactgtggatgacagcaaaccctggctccatcttacctctgccactttttgccgcatggtctttttccatgacactcacgtccagaagtcaatttgtttgtgaaatatgaatattaccagcaccgtaccacagagctacacaggtggaatccttaggtaacaactagcacacacgcactcggggatgattttgtccggtgacttttacaattatgacaatcttaaatatgaagttgtgatcatctgttacatcacccaaaagctaactgatagctttatcaaggaaaaacaacaacaacaacaacaattttggttttaaaacatgccacagagttttttttgtttttattttgtgtttgtctgtttattttgtctgtttgccttgtcccacagttctatgcaaccaactttaaaggtggcttttactaactggacggtcataccatagcacaagtttattagtttagcaagcggtcattttctattgtgttacgtgtgcaaaacaaattattgatgtttgtgagaaacccaatctaatcaaccgcaccataactctcacaattaaatctaacagcctggcacagttgagaataccaaaagactgttcaaatgaccagtatctctgatatcatactcatctgtgaattaaataaactatggctgataatttaaaaggaaacaataaaaataattgagagttatttgcattgtggcattttttttgaaaacttatttgactactatgtcttagatattctaactcatttaagcaatttatatagaactccaaagacattagtctttgcataagtccatgcagttaagctgggccgtaaaacctaaactgagccaactaacagcagttgtagagtgttattccagtataaaagaaagctttactctgcatggttcttctgtttttgatagatgagaactttaaaaaaatttttgcatctaatatatttcctagattgggaaaattaaagataacacctacttgggttttcctacttcattggaagtgcataaaaatattcacacaaacacatccactcaggtgtcaaaggaaaacacagttgtcagagggcagtactttgtaaaaaggaagaaaaaagtccaagtgaaaaattgtagggaggaaacacctaaaatctctcaacaaaatttaaagtcatacaagaaaaacaatttcattaattatggagaaacttggcagggagaagcaaaagggtaaatagtgccctgcttggtgggcatcacgtagggccaacagtatgcctggggtccgatttgccaaccaagtttgctcccagcacagtaatcatcaccgtgctcataatttacaggcgagcaaactaaggctctgaaatgttagatgttctgtctcatgtcacacgggaaatggcagagtgaagtttaaccccgcactaacggacaaaggcctcactttttctggtttggtatgccaatagactagacaagagctgacagtctcatgatggtaaaaatattccactcttcttggagaaaatcagtttgtattatgttcaacctagattgaaagaggatgaattaaaaaaaatagaacgtgaaaaactgcaggatgtggctgaggagacaaaatacagaagaaaaagaaagatctttaataatttaagcaaaatttagaattctttttagaatgagtaactagattcatatcacgttgtccaagtctatagaccggtactacatcgccagtcaagaaaggacctgtgatggtcttggccattctaacatcgtctgctgtatataatcaaggtggagcaactctttaaatttacaacatttctgcaaatattcaaaaatgtcaaatactgctgtttgttgaacaaccaccagtgagctattgtttctaaattccagaaaatatttttgtttaaaaggaactcagaagtgagaaaaaaagaaagaaaaaaagggagagaaagaggcaacaagggggggggggagggagggagggagaaggggtaagggagggagggggtccaggggctcctgtgtcccttggtttggagctgtctcctctgcctgctgtgacagctgcgctcctggactgcccagccagtggcacatccagatctgcttgtccacttcccactactgagctaaaaacacagtttggcggtatgcccacaaatctaataagaatgaatcttgttactaataagtaaactagagtaaagagttgtgtgtgtgtgtgtgcatgcatgcatttgtgtgtctgtgtgcacgtgtgtttgtgtgactgccttatgaacattgaatccatgtgctccacagagttttatagacattgctcacattaatcccaatcaggcggaatcaagaagctgacccgagagtaacaaaaaacaacctgctgaattgctggcacttctacgtatgtccagagtaccagacagaaggaaaaccggggccagattggaacacttaatattttatggtagggaaatggctgagaatgtgctcacttcagatgcgcatatgcagacttcagatatatttatccagaaacacattttgaaattcatgaaccggcacagtcacgaaacataacaacttgcaaggggatcagggtgcaaagaaatggaggacatccaacgtctcaaaagtacaggatctagtgaaagtggtttgttactgatttggaattcagtttgaaaaggaaatggaattatgacaattataatattgtgagcaaaattaccattttaagcaggataaattatacagccacatatcaaactacctaatacatatcagaaaatagaacagagcccagctctaatctggcttaaaatagaattatctagctatctaattttcagcaaattgcatccagtttgacattgtaaagcccaaataaaaggattaaaataagcataacctggttatccttctattgtctcagagagtactaaagcatatatattatttcaataacaataaaaaatctgaatacttacctttggtggaacttacccagcactgtcttatcccattgggattacatattgaaaattaagtgccagtgacaagtcacctgcacagagaatttttgcctttggcattgacaaaactttgaatagtaatgtgaccatgatctcagagttaaaccctagtttttagttgatagaacctgtgaatattacttcctctgttttgcaccttctgtgtgtaataaaatatagcaaaagtgttaatacctatggaatttattgaacattctaaagaaccttttatattgtccctatgtttctagaaagtctgatggcatggtaattttggagagcattgtgtgcactattagtgcagtagattttaagtataaaagataatggggtaaggcagacagaaagcttcattgcatttctgttaactgtgcccttagacactctcaagaaaacggagaccgaaatcctgagttggttgagctctgccagagcatcacaaaacaacaagccaagtctgtgaaaaggaaagaaaatggcacacaactatcaggtttagctactagataagtaaactagaatttggtttaactattaaaaacagcacttaaataataccctatttcatgcatttacaatacttcaaaatagccctatgggactgatatattatattccctttaaaaataaggaaacaagtttcaaaaacatttgagtatcttgtgcaatcattggtaggactaagatttctactcagctaaactcagagcctaaaattgtgagcaaccacagcttatgctgccaactgcctcagttcttttggctagagttcccttggtcattttgagggacaggctgtgtgggtcactgtcccgcagtaggtcactgtcggttactgaggcagggtatagaaaacagctgtttctggaatgagtaattaggaaagccaggtaagatgatttccacatgatgccaaaccagttaatcgcttttgcttatttaaattgtggctcgatccatgggaatgggctctgggagtagagttaatcaaaataattatttgactaaactggcaactgcttaactcctggattagacaatcgatcaggcaatcccatgcttatccagttgtatgggaagattcataatacccaataaaatcctcccaaggtgaaaaacatcccatatatttttcttcaagaaggggcaataacgtcttatattccggataagtgttattactcagagtaactggaggagcaacgcttactggtaggacagctgtgccctgagaatccaaatcccaaaactgtcaatcaaggaaacagatatgtatgttcagatactagagatacaatctgaagcctagaaattacatttaagaatgttttgcaagaacgattttttcttttttcttttgtaattcactttggagttttgatttgtcatgctgtttgtttcatactcaataatcttctatctctattttcaacttcccaaaatctcatgatttctacatttttacacgaaagcaacttttcttaaataagtaatatttgtaagaatcttgtgaaaacctttgtgcatttctcatcttatttagattgaaagtgctcttctataaattggagaaacgcttcctgaaggagtctgactccagcatccaaggaactggagctgcttcgggaagatgccaaattcatttcctacttcagctggggcactgagtcagaatttaggaaagagaccacgggaagctacattgtaacagcacaaccgccattgaggcttcctgcacacagtaaaatttgagcaccctggggggcagtcattttccttgttacttagtgttgcaagtttaagtagacacaaattactataaatctgacactctcttagggtctaaggcaatcaagtttcccataacgtctgtttcttgttgaaatttccagtgatacttcaaaggaaatattgtttaacacagtttcccaaacctctgaaaaccgaggaggggagaggcagagtagtgatagcaatgcaccatttgcacttacaggaggagctggttaactggttacttgcgtgaactacctatcacatatatgccttttctcagcattaaggaagacaaatcttctggctattcttttgcaacctgatcaccaagatcaccctaacagcattatcctggtaagatattttttgtgtgacgtcagttgaaatacctgtctaccttctcaatctccctgcttgtcccattaggaaataggggacccttttctgagttgtaaccacaggaaatgttccagaatcactttatggtttgggtgttaataggaagcaacatgagagatcaaaaaggggagaaatcataattacaagataattgtggtcacctctgctatattcccattttgttttacgtaaaaacttctggagtgagtgcttcatttgtaagtgcagatgtctgagcttaaaccccaaacttacttcctcaaaatttccaagggtgtgatctgatattttcttatgattccggagattctgagaagagcttgctgacaagaataaggcaaggttcagagaaacaaaaatgagctgtgcagtgctgtgggtataaattaggaattgaacaggagaatctgactcagaggaaatcattcacatgcggccgaagtgtggtttgacatttgaaaacaagactcatgacgctgctttaaaactcatgtgcatagaacggagacttcaagttctggtagtggatattacaagggagaagacgcagaaattaaagaaggccatgaatacatagaactaatttacttaaatgtttttcactataaaacaatgtggggttgaaagctaggtagtaaaattttctcagattctgcaaattgctcgaaaatgatttaagccctagaaagaactcctaccaggggcatcataattccaaatgttgaccacgttagaggacacatcgccactcacatgcctctcctcccaatttctcacttcgtatctattactgtttagaggttatagaatttatcacaggcaaacctggtgcgttactcaaatgtaatctataacaaattattctgaagcttacctacatctattctaaaaagctagggataatacttttcatgcctgtttgatttgagataaagtttcttttctcctcttctagatcctctttaaaccctcaggctatgcaatatccaatttttttaagatttacatcagtttaaagatatttcataagttatttttcatttcagtctttctttaaatagtttgtttaggtttatagatcccaaatatgaatttagacaatttggtttcattgaagttttttcccaaattattctctcgcacaatagtttataaataaaaaataaatacagaaatatactaaatgatacccttctcagaaatgataaaatagtaacattggaaaaataagttaagaaaatatttataccaattttattttattcataaatacaatgtttccagttagttttgagaagaaggtgacaaacatttggaagaataatacaaaatacaactgggtgactttcctatttgtttcacttttttgttgttgttgttgttgtttatcacgtgccaaaccctgcactaatcttctagccagaatttttgtttatttattcatttacttattgagacagagtctcgctctgtcaccaagctggagcgcagtggcgtgatcgtggctcactgcaacctccacctcccgggttcaagcgattctcttgcctcagcctcccaagtagttgggattacaagcaagtgccaccatgcccagctaagttttgtatttttagtagagacggcgtttcatcatgttggccaggatgatctcgatctcctgaccttgcgatccaccggccttcgcctcccaatagccagaattattataattaaccctcaccataaccttatgtgggtatttcaggtatagaaaggaggaaactggagcccctgtgccttaactcatttaaaaaaaccacacctccttcagggatagctgcagtttgcctcagatttctctcattctctgatgttaatgactataataatttgaccaacaaggctccggtccttaagagcgctagtgctgtgtaaactatcccgggttacacatacctctgaaagaattcttaacccctgactccaaagattagttcaataagttcatgtctccagatctccagggcaaggacgatgggcccagcttgggagaacagtggaagcaacgttgctgaaggtgattcccaggtctccgtttcatttagccctggcagaatcactgcctcatgctcagagagagtatgactgaaaaaaacaaaaccagcaaaccaagaaacccgggagaaacaggggctcctataataatccttccacagagtctctcccttccttgaccaccaccgtggcctcctacagatcactgggaggtgacggactccccaggccgtccccatcgagctgctcttccacagtcctcctcttttcttgtggaacagtcatgttggtcaactgcatttcccacgtccagcgcctgattgacctgtcgggccgtcattccgactgttcattccccggccactctctgctgagcaagtccaccctgactgctcactcctactgctactgccatcctgggcacagattctaaaagcagaagctttgaataaagtgtgtgatcttcttccagggcagttatttctatttatggttgtattcattcattcattcattcattcatcattcagctactatttagtacagaaatacccagctactctgcccgaggacattcactaagtacctaacttggtctacctaaagtgagtgctgtagagaaaatcacaagtagggagactcaaataaatgaactaaaatacgaaggaaaccaggaggcagacagggaaaggcgtgagaggggatcaaaatttcacaaagaccatgcatttctgaagagaggccagaaaaaggttctataatagtatacacaacaattaaatttatgaattatttaaggtgaataacctaaaatgttaataactagatattaaaaaaacaacttatttattaacctgaaaacaatgtaatatatagcaaaaatgtataaaacaatactatttcttgaaagttgttttatatttaaaaggagtcataacctttaaaaagccttcagaattatccagaagaaacaataaccattattgacttccagagatagattagaaaaagagctattataaataaagagattgataattgaattagggatgctatattttgtacttcgtatgcctactatatcatcattcggccaatttaatttgccttgaaaagagttgcatggcttaattgatttttcaaataagttttccactctcaaagttactctgccaaagctttatttaaatctgtacgccactttcaattacagatacagttatgccaacagaataaggcattttattctgcttaattctttccaagatggaaatgaaaaaaatgaacttttaggaattggtaacattttcacttaccatagccgatgggtaatgagatcctccaggtgcagtctaagttgttggggtaagaacctgggaagccggggctcaggatcacaccacccaaggtgctcagcgtccctccacaggttgctgttaagtggacaagatgtcagtcctgcaggtcctcactttctccctggaatctttgctccaacctgcttcactcaactatgctgagaaagagcaagtcttcggagttaattctgcccctaattacagcacacgatacaatgctgtgtgccttagttatttatgagctgtgctctccctcttgacagtgaactgctttagaataaagaccatttttcaagatccatcttctcctctcacactcaaaggctcccagtaaagatgagtccatgtaatgtttgcgtcacagtcaggcatcaaatggacttcagtatattagctgctactcattgagaggtagtattactccctattgattgattgctaactatgtggtacttactgtgcctagataaatacattgcatagattaactcacatagcaaccctgaaaggattaccattcccctcttacacatgaagaaaccaagcctggaagagatgaagaaatttgcctaaagtgacatgcctggtaaacagtacaaccagaaggtcattccagctgcgtctggttccagtacccaagtttcagccaccacacatgactgtcagatagcttttcaatttcggaaggcagctaactgcaaccactttctccccaggaaatcttatgctgtgagagagggtgaaataagttcatgcatcttgccttatcttggcgactcacatgttttgctactgtatctgaggtttgactacaaagagacacaactgattttacaacaaacatgcccagtgatacaagacgaagcatttgaagttccaatctttgatcatttgtagcctattaaaataatttcttatattccaaaattaatgcaaatgatgccacttcttttcaggaagcccaaaggaaatggctttattctaacaatgctctcattatgcaaaatgttttaaacaaaatattttctggaagccctcttttagaggccccctaggacctgtggtgaagcctttttcttttttaatcatcatcaagactgaaacaacttatttgtaatttgagaaatagctaaaacttaagtctagtgaatatggtgattgctcaagccagggcaccatattctggatttcaaacattgtataagttgaaaaatgtgagctacaaacatttaaaagtatatttttgtggtgtgagtcataattctggaaaagtcttggacaccatcaactgtgttgctatttaaagtataacctctcaaggcgacttctttgtggcagagactaggcatttgcaaggccaggctcccatgtgcactttgtccatgcagctgctgaatgtgcggaagacacaccagcaaatctgagtggcatgcctacatacatttagcagtaacaccctttcccttagggctcgtgggacctgcagtgacagtagatgtgtatatccaactgtcagaggtgttaaaccagaacaactccacctggaataggagctggataaaacaaggctgaaacgtactgggctgcattcccagatggtgaaggctttctaagtcacaggatgagagagaaggtcagtacaaaatacaggtcacaaataccttgctgacaaaacaggctgcagtaaagaaaccggctaaacccaccaaagccaagatggccatgagtgtgacctctggttgtcctcactgctacactcccaccagcaccaagacagtttacaaatgccacggcaacgtcaggaacttaccctctatggtctaaaaaggggaggcatgaataacccaccgcttgtttagcatatcatcaagaaacaaccataaaaatgggcaaccagcagccctcggggctgctctgtctatggagtaaccattcttttgttcctttactttcttaataaacttgctttcactttactctacggattcgtcctgaattctttcttgcacaagatccaagaaccctctcctggggtgtggatcacaacccctttcctgtaacacaactacagggaagacacgaatgaaaaaggccgaatcaatgacaaaaaaaggaaaacaacagaaccagtaaatgtggtattactaaaaagttccttttgattttagcatgattttcacacacacatgcagagggaaattataaaatacaaacactcatacatatcttcagctgaggactgaggcagccctgcaggaggggctggcccaggacctcagcgtagacagcatcatcaacacggatgtctgtgtcccacacagaccaactctctgtgtgatgggaaactgatcatgggcctgaccactgggttcatctcctgtcaaacatgcatcaatcacctaattacttgagagcttagttaaaaccacggtaatcctttgtttttgatgttgcttatctagaaaactacaagtcaatagataagcgtaaaaacagagctcccaaaagacgcatatccatcttttcttcctttgtaacttttttttaagacagagtcttgccctgtcacccaggctggactgcagtggtgcaatctcagctcactgcaacctccgcctccctggttcaagtgattctcctgcctcagcctcccgagtagctgggattacaggcgcccacaactgcgactacgcctggctaatttttgtatttttagtagagatggggtttcaccatgttggtcaggctggtctcgaactcctgacctcaggtgatccacctgcctcggcctcccgaagtgaggggattacaggcctgagccactgtgcccagccctttgtgacattttaaggcgactgggcttgccatgtcttagattggttcagtgtccatctctgtgtggtcatcaagttgcagactgacttcctgcctcctgcctgggaagctccctccatgccagaccctttcttataggtaaatagcatatttagagttattggtaaatgtggtttttgtaaagggaaaggagtttatttttataaaatggctagagaccttatattttactggatttatacatcttattttgtgtgaattcttggttttggcgggagaaagaatatacagaatttttactgaaggacacagacacaccatgctgaagagccctgcggtgcagtgagacagggaggtcctgggccacctgctgtgacatgaacttcacccagctgtagagccctagaaaactgcgagaccattctggggcttgttataaatattcaaaacagtcaatactggttaaattctgagaacactgcttgatatattaacctctagagaagtggttttatatacattctcttcattagtacttttatttttcaaaattaggtcatgggatttccaggagctcttaagtaaaatattatctctctatggacttctcctcttacaattccccagtttggagtaatctaaagctaacagctacaaaaaaccttttaatcactagaatctgtctttgagatttatcatgggtcatgtgtgagtttttaaaacaatgaaaaaacttgtataccctgtaaagaattacagaagttgacataacttaaacatgtgctaatatttacgatgttaagtaaaagagaaaagcctattatattttgcaaatataagttaattctttgaataaaacatcccattatgtaatacaaagtgacagcaaaggcatattatttgagtctatgtctgcttagaattgatttcattgtgaagtttaaaaaatttcaattcctgacttttagggaaggctcttcatttaaaaataaataggcagattgatgttctgtatgaatcaaaggcagttttaattgtttcgttttttaaattttttaattttttccttccaaatcaaggctgggattttttttttttttttttttttttttgagacagaatctcgctctgtcacccaggatggagtgcagtggcgcgatcttggctcactgcaagctccgcctcccaggttcacgccattctcctgcctcagcctcccgagtagctgagactacagatggtcgccaccacgcccagctaattttttgtatttttagtagagacgggattttaccgtgttagccaggatggtctcgatctcctgacttcgtgatccactcgcctcagcctcccaaagtgctgggattacaggcgtgagccaccgcgcccggtcaaggctgggattttaaacgtctgtaaaagtagctcaatgtttttagctgacatgttaatctagacatttatttttaccaagacatagcttttaaaaataagatactgtcctctaaggtatatttttcacttgtaagcaactatgatgtagtgaacataacataaacagacgttctctcctggatgagcctatcataaaggctgaagttttttgttttacaggtttcgtgcagttttattttcctctgtacacaatttcacctgcatcccatgcaaggcagttaaattgtgtattactaaaaaccattgaatacctaaatttatttgagatgtggggaaattaggctgtcagaagaatgtgtaacagacagtaattacctcgctttacttgtgggtgcccacaccacactacgccgaaatgaattctaaacagaatgtgaatagctcccaggacaattttaaggctattctgtggcctttaaaatagctaatgttcatccatatagagttgaccactttctcctaaaacaccatttggcagtatggcatgtttgaggctgactgtctggacataaatgggttctgagcacacccccagcaatacttgagtgttcgaagactgtggggaacaataaagacagcaccccagaagtgtgactgttataatgatccaggctctctgatactcattcattccctagccattctttaattgaaattcttgagtgtctaccatgtgctgaagatacagaggtgagtattgcaagtctctgtcaccaaagcctttggggattgtagaagggcaaattaaagagcaatatcattacaactctgcaggaagtaaagtcaggcacatggtggtggtagcccagggtagagatgactcactgcacctgcaggtgggagctcagagagcattgaggaggggacactctctccagtgcaaaattcaagagggtgcctaaaccctccaataaatattttaatgcaatatttggaaaaaataaaaagaaaggcagaaaatctatgatgaacaaaatatgaaaattttaaataaagacaagatcagtactgccgatgtttccttttgcctctttcctgtgataaagttggagtatggctgaatatgggagctgtaggttaggattccatggagacgataatttaggaggggactgtgccatcttaaagatggggcattggagctaagaatcacaggggaggatacgctcaggtggaaggggtgacaggagtgagaagtcacttggatttagggagtgagggagaaatttaaggtaatacccagatttgttgtttagacaaaaaaaaaaaaaaaaaaaaaagcaggatactgctaatagcattcgcagaggaagtagatccaggagaacaacaataggtttggagaagccgatcactttgtgggttgcgggtaaggagtgtcaagtaactgaccatgatcctactgagacagtacctgcaaggttgaatggttgcctgagctacaggtaaaggtttctgagttgggctacaacaaataggtgatgggtgaagctgggggcctgaatgatggggagcaaagggcaccctgacatcaccaacctttgtactgagggacttgtgaccaccaccttcaatgcccctggaatcattaaactcccatcacattacctatgctaacagtttagggagtctcaagccattaaatacagctctggaaagctttttcctaaagaagccggctgattgtgcccccaggagcgcatccacaagatagtcaccaggctgtttccaacatgaaatactccatcactccatcagtaatctgtcattctgaattttcttcctgggaacttgttttttctgaggctaaaggtctatacagaaaactccccagactttcagaccagctgcattccttctttgccacaaattaacaaactggccttctgacacacatgtcgttttggtgcagggccgtgagcgggcagtcttgcctctggtctgtgcgggctgacccagacacactgagaagacggagttgctgcatccagtggggaaggtgcaggttaaacgcatcattctgctctactgcattatgtgctattagtatataacacgtgttttgaaattaagaaatttagaagtgcattctttgaccccaagagtagagcaggcatgttcttcccagtgtgtgcgcagcagcagagttacagaaggtgcatccttaccaatgcacaggggagacggatagttccaacggcgaacggtccctggcatacaggaaatgtgggaacggccctgtttaaaagaaaacaaaagaaaatacatataactaaaaacagagtatttaaggattaaatgtttgagaatatctgcattttttcctttcttgttttaattataaatatttgaaaattcaaaaattgtgaaatctgtttttagtaatgattattagtgagtcacattttgaaccaacatagaaaagtatccattttcaccgtgtttctttctactaaaaacaaaatcttgcaatgtccttttgaccagaccataattcgactcagctcctttcttgatacttaagagtactgaattgggcaaaatatgcattttttttttcattcaccagaatttacagcttttggcctaagaagctgaaaacaattagaaagtactaggtggtgattaaaaggccaaaatgtcagcaatacaaagtctgcttatggagaggtagcttcggtggttgtctgtgcttccgcgtcacatgactaccagggttcagcaaagcactgggtcgtttctttatcacagaacggagacttcacattcattttctcactagacatcctcacacatcacaacaacctgcctgcaatgaaattaaccctcatcactcagggtctctttaccctgtaaatacatgaattttccactttctactttaaaaaatctgttccagtctttctcaatgaaaaaaaaaacaaacagtagagggttaaattcaaagatgttttgtgctaacatctctttctcagtaaaagagaggtgatccatgagacctctgtgtgcggcctatttttatatttttcctgatcgtgactcggtggccttatcagccaggtttgcttatctcataaatttccatttgccacccacaattggcatagaggcaattgaaaaacaatatctaatgtatgttaaataattccagccacactgggaacgcatcaaacaagcgtttgcactaatgcagttatcaatggcaaaccgattccctaagctctcaaacatttcatactcaatccacctgccacaaaactaactttctcatacctcttgatatttttaaaagtagttacagtaaagaagaccatatttaattttaaagaagatactccaggtaattttgtgctgccggcattgacactctctgtatccccattcttcgacgcattaaattatccttacaaatttccttctgaaatagggaaaaacatagagttcaaaagtctcaaaaaattttcatcagagactaccaataaaatggtcatttattaccaatctaggtaatattctgctattgattttgttataaacgtttccgatgagcgattctagctacaagttttctaataaatcaaaacaagataggaccctgtgcatttatttactagtttttacaccaatgggaattttcttttttatgtttaaaaagaccattaaaacaagttgagagaagatggaagtcatacatcattccaatattcaggatttactttcagcgtgtgatgtcatggcagcccctgaatcacactaggcatatgtatttatagacactcacgtgtgaactatgcaaggaacaatgcttttcatgactaatatgtaattgatgcatctgttgttccaaatatattaaagtgttagtaaaattgtcagttgttagcaattcaaaaaaaatccagaatccttttttgctcatgtgaatgacaaacagcagcttgcaaactcaaagcttggcattgtttgtaacgaagaaaagaaacacagcttagtttgcatttgaaaaacagagctaataaacggtctgctgggactgtgcagaagtgcatccacaggcctgtgtccctaagcagcatattcaataatccattataagaaatttctttggtaaagaattatttctattttcttctctgagagctgtcataatatcatttataaaagaacggcaacagaatctgcaaagtctcaccatcaggtagaaagaagaggaacatcgatgagcaagagcaaatattacagtttgggaatttgagggagaatggaggaaacatgatatttacctgatttcaggcaattataaagcaagccccgaaaaaggcacaaaaacagcatgtcagtacagattgaggtgtccctctaaatgagatccttgagatatgaaagacaattcttttctttttttctttttttaagatagggtcttgctctgtcacctaggctggagtgcagtggtgcaatctcggctcactgcaacctccgcctcctgtttcaagcgatccacccacctcagcctcccaggtaactgggactaaaggaatgcgccgccatgcccagctcatttttgtattttttgtagagatggtgtctcactgtgttgcccaggctggtctcaaactcctcgattcaagcaatcctctgactttggaatcccaaagtgctgggattacaggtgtgagccactgcaaccggcctaggataattctttctgacatatcaggtggatcaggaacgttgtgtcctaaagattcagcctgaatagcttgagtgtgtttggttacaaacttactgaggtatcccaactttcaggagtccttactcaccagtttccactacagagactctcgctctgcctccaatctttttgcagagttacaattattgtggtacccaccaagatggtgttataatgtaagtggtaggtttgttcttacgaaggtggctttatacattgatactggtttctaataacagctacaatagttttcctatactaaagtgtgccagttatttcacagatattttctctaagctgaaagcatacatcacatggtacccatgtcccacggttgatcaggagaagtgagattttgtatataaagcacttggtaatgcacccctttagcattcagcgtttgccagcccctgttcttgctcttaacttgattcactgctacacaatatttaccccaatgtacatgcagaaactgaattccacacagtgctgttatttcacggctgtagtgttgcaactctgcatataagaacatagctaaacaattttcctttaaaacctatcagtgtcagtgtcattataaacatacagctaaaatattctattacctgaattaactgaagagctggaatgtcaatcgacctatatatttctcctgactttagaatatacatgttttgattatcaatttttattgctggcagagagaattatataataattatgctaagtgatagacactattctgagagtaggcttactcatggttaaactagaaaatattaataataaataataagagaaaaatgactactcttgccatacattagattataaatcattcatcaaaacttttatataaaaaactcttggctggacacagtagctcacacctgtaatcccagcactttgggaggccaaggcaggtggatcacctgaggtcaggagttcgagaccagcttggccaacatggtgaaaccccatctctactaaaaatacaaaaagtagccgggtgtggtggcaggtgcctgtaataccagctacttgggaggctgaggcaggagaattgtttgaatctgggaggcggagcttgcagtgagccaagatcaagatcatgccgctgcactccagcctgggtgacagagcgagactccctctcagaaaaaaaaaaaaaaaaaaaaaccctctttatatagaagatagtaaaagttcattgaaaaacttctacttaatagtttttaaaacttacttaaatgttttattttggtgccttatctacctagcccaaagagggcattaatgatgacttatactgaatgatgagaacagtttgcagggtagcaggtgcacatacagaagcagattcaattactggctgccaggagaggactttcaaagagacagtgttgatattttgcccctagaatgctctgtgcatagttattgggaacgcatatattttgaaataaaacaattgtgaaaaatacaatgcttagctttgaaagagtacattatcacttaaaagctgtttccaaatggtgacgaagatgaccaacatgcatgatttaatatgaatagtatgattcacaaactgagtgaggaaaacatgggtacaaagtgagggctttggctttaagagagctgcacaaagatgaccatgtgtatgttattcctgagcactgagaagaaggatacctgcagggtgtacccgggctcgcactggaaggagagcacgtcgttcaccatgtaccgatctccgattttgatgctgttgctggggagggctggttcttggcatgcagcaagacctacagctagaaatgcaaagacaaatgctagaaattatatgatgtaaacaatattcttatcatttgaataaccaaagtttatttctattgctctccttctgtagaaatgaacaaagacttcaactctttctcttgttattctaccaagaagactttgagtacctttaaatcagagctatgagttaattgttaaaaattaaattatcttattttcattacacaatgaatcaaggctttgatttcaataacaaaatttgttacttccacattgagtatagaagatcccaacttcaatatatacatattgtaaaaagtctcttcaaaaattgtgtttttatgatatgtaaaactccaggatattgccctcttacttttgtttttcaagcatacttagcagtctttatataaaaaaattatgtgtgaatcttggaattctgttcttctacaaaaaaaaaaaagagaaaaaatattttacattcaatctctctctctctttctcttaaagacaacaaaaaaggatctcatgaacagtctgttcttcattaaacagaaacaatatttacagaacctaaagctgtaatcctgcactttcctagatgaattgcattcagttaagacactcacagatttttttaaaggcatcatataatactggaactcagcctaaggtatcagataaacgaattctaaaacactgaaacctctctgtataaatccttatcataagaataaacaagatatgcagctaccatattttgtagaatcaaaaattgattttggtttatcaaaaggtacaaactttccattatgagatgagcaagttctgaggatctaaagtgtacagcattggatgttgatggatatattaatttcatttaattaaaaaatgcatttgaaatggtgctaagggcttgttgaatacaaataatttattccattattctaacatgtcatgaagaaatagtggagaaaggcttctcttggtaggccagcttcacattctttatggggccttggattcgcactttagttcttgtacttcacaacaacaggagagaacttatcagattacttaattgactgggactctcagaaaggaagctggggtggaggaggtgagtaggactttagttaatcagaaggaaaaaaaaaaaaacagcaggagaacaggtccactcaggggcagtcccatgctagtggtccccaggcacagagaggacgcagctgcctgcactgcccatgggccggtccccacgcggggctctgccctgaagccagtcagctttccctgcttcatctgcttcatgcctgctccacgtctcaccagacttcactttccgaaaaagaaaaaaaaaaaaaagcacaagtgcaaagataaaatgattaagaacttcaaaaccagcggccaccaagcacgagacccagtgtgactcacgcagtgcccactcaggaagcagctgtgggtcgaagctacagagtcagcagcaaggtcaagggaaaccctgggtcatccctgcatggctgtcactgtgccagacgcattatactaactccagtccccaccagaccctcatagccaggctccttgtgtctgatattaaacaaaaggcaaagtgaagtcagcctggctgcagagttgcacaggtcggtgtgtccatgtatatgagcctgatctctcatgcgtgttgagctaacagtacacttcctccactgcctggatgatggagcctgtaagagatgtgttcaccagtgccgaccccagatctgctgagtcggaggcaacaccatcccaaatccttcaccagcttgccgagtgtttccccaaatctgagagggcgaaatggagagagagaagtgtcttcatcttacagtaccgtgattgttcatttgagaatcccatgctacggaatccaggtcagaatggaaagcagtggtacataaactagttgagtaatgtcaggccacagaacccattgattctgtatagaatgagtaggtaggaggagtgccacgaactttttctaagttgaaatagatttttccttaaatggctgcatttttagaagtatgaagtaccataagcattaagcagcaatatactttattcctaccacagattttcaagccattggggctttacatagaagataaaactgctaaatatgaaaaaatatatacaatcacttaggcctttaacttcttttactaatgtaagtctaaaatcttttgttttaactttagaacatagattactacatttaaatcccatcttttctttcctaccacatattagcaaggtcatctaccatacatctctgagttttttatttccccctgaaaaaaatgtatacttaaaatactaggtaaattttaactacagtcgggaatactaaaaatctactttagggtgatactaagtcatcgtcattctgagatacttcaaggacacaccaggtgacacagaacgaagaatatcgattacaaaaacaggttccaaatatcaagacaaaatattttgaaatgaaaagtgaaacattacaattcatattaaaggccagttactaaacttgcatgttttacccataagatatgatgtgtttttattatatattgatttatatgcagttattacatattgatttattgtcattttctcctttcttgaattctattcaattgatcctctggggaaaaaaaaattgcatttatatctggcctttaaggaattataattaatttataattaattataaataaatgaataaaataaaaacacacaaaaataccattttgaccggtgtttaacatggccagactcaggaagcagttctatgcagagcacaatatttgaaatgtaaaaagaaccatcttttcttctcccttcgccagtgtcactacacacccagtatatgttagaagctaagaatgcaaagagattaatacctggtatgtgtaagaatattttttatcaatattatttaaacctgctactatattaaaaggagtgacaaagtgcataagcgattgatatgatcagagcccaagtattttccatactttgcatttctctcataaagatgcactaattcgcttgcaacactaggagtaattcaagtcatcatgagaacagtggtttttaatttttattttttatttatttatttttttatttatttttgagacagagtctcactctgtcgcccaggctggagtgcagtggtgtgatctcagctcacttcaagctccacctcccgggttcatgccattctcctgcctcagcctcctgagtagctgggactacaggtgcccgccaccacgcccggctaatttttttatatttttagaaaagacggggtttcaccatgttagccagggtggtcttgaactcctgacctcgtgatccacctgcctcagcctccccaaagtgctgggagaacggtggttttttgttggtaaaggtgtgtcagatgcaggggcagaagacagctaggcttgacatacaggacagtgatggggatgttaaaatagggcaagagtggagcacaggagaactctgagctttttgggaatgcggtgaaaccttctgagagagaaatcaaccatctacagaatggctccgaaacagaaaagccagaaaggaggtgggggaatgtagacaataacatagaagacaaggcagtgaaccttctgacctttaggggacagaaggtcgtctattgatgaatttttggtacagaaaaaattagactatttatatttattcactgtattagtcaaaatgtgaaacaaatatgatatgataggaagtaggcagggtggtgtttggtaataaatatgaactgtgtagaaggtaagcttgagtctatacatgtatacataattctctttttagacttttaaaaagaatcatgtactttaaaaaaaaagaattttaaaaagaattatgtatgataattcttatcacatcatgtctgttaggctgggcatggtgactcatgcctgtaatccaggcactttgggaggccgaggcaggcagatcacctgaggtcaggtgttcaagaccagcctggccaacatggccctgaaaccccgtctcgaccacaaatgcaaaaagtacccgggcgtggtggtgtgcacctgtagtcccacctactcgggaggctgaggcaggagaatcgcttgaacctgggaagcagaggttgcagtgagccaaggtcacaccactgcactccagcctgggcaacagagcgagactccatctcaaaaaaataaaataaaaaataaaaagagaatgctaatcaacaagtctgcctttcctgaagtgttttagaagaacgatgtttgcattgattgaaagtgatctctcatattgtcaagccaggggtagcagtatcatataaataatgggcaaacctatagaaatagacatttataagtatttatatagacacaaaacataggtatctaggaagacatatacaaataaaaagaattatttattcttaaggcagactaaaaagaactcacaaaacgtaactatgataggaaaattctagattaattttccagaagcagagatatctgggaaaaagtaagctgtcttattgtttaggaaaattttcaagagaaataatttgtacttctttcaaatcacagcatacatatgcttcataccataaatgataatatatcatatggggtgaagcaatgcttctttaaaaggtggttcacagggcggggcacagtggctcacgcctgtcatcccagcactttgggaggccaaggcaggtggatcacaaggtcaagagttccagagcagcctggtcaacatggtgaaaccccgtctctactaagaatacaaaaattagccaggcgtggtggcatgtgcctgtaatcgcaggtacttgggaggctgaggcaggagaagtgcttgaacccaggaggcggaggttgcagtgagccgagatcgcacactgcactccagcctgagtgacagagcaagactccaacttggaaaaagaaaaaaaaaaaaaaaaaaggtggttcacaaactattaggttggctatcacttttaatggcaaaaaccacaattatttttgtgccaacctaatacatgactctgaatgcccaggtgccctgattaaatgtgaagacaacataaaggtaattcttgtgcaatctacacatttaaaaacacttaaacaagaaagaacaaaacgcaggcattgggaaaggaggtgggtcttatgtactgtagtgttttatacaatattatccactgatacattttgtgttcaattccaatgttaaaatttggacatttacaaagatgcttctatgtaaaattgcaattagatgtagaatgtagcaagagaagtttttaaaccccatgaatccagcctatgaaagcaaagaatctaaaacacagccattaagaagatgagtgtcctaatttgaccaaaaacactttaatggcttcacctaccactgatcataaaacgtgagcattaagaatcagaatataacaatcagcctcatcaggtccctggaatttattgtagccatttttctaaatccatcaggcaaaattctgagaatagtttgcttaaatcttccagataaaaatgattttagaacacatgataaacatgcaattttaatcaaatacttaaaacaggacaaatgggacttttgtagatattatgaactgaaatgaccttgggcaattttcctcaactgtgcatgactggcagagtgtaaggttttcaaacatcacaattagaaaaaaaaaaaaaagatatttcaaactagagagctcaaaacaaaaaagttgataagcagagagtgagggaagcagacccatgtgaagagattaatagaggagtagcatgaaacagggtcaagaaatcaaaatacaggcgcatacagacacctgagtattcaacgcccaggtagaccatgaacactatgtggaacgtaagtggttattctctaattttgaaaagacaacaacttgttggctgtagtgtttattgtaattgactacataattattctctggcacacgacacacagatgaaaattcctctttttctagatgcgcacaggtatggcacaccctaacacagaggtgctgctcgttatttttgttaactcttaattcgaaaaatcgcattaaagttgagataatgtgctggaacataggggaagaaagaaatcaagtcacccaaggagacatcatgtgagcctgacaatggaggaagtaaatgtcaaatgccatgattatagacagctataaatgtggacctctgcacccagacttctatgtcacagtgtgtaaggagtcagtaagtcttcatcacacacacacacacacacacaaatatatatatatatggaaaacgccattaataacatagtaccttatgaaaagaaaagaaactgttttatttatcatctgggaaatttagattgtagaggtaaaaagattttgtctcatctgtaaactgttggcaggtttgacacatatcttaaatgctatttctattatttccacttgttacatcctgcagtctcttcaaagcataaaggagtgcatgtctggtgacaagggaagtgacaaaatacctttaggggaagtaaaatgttctctctctctctctctcaggggctcacaaattatattagcattttactggtgcagagaaactctgcagtgatgaactctcatcaagtttatttaatacatggtttccaaaatttctctggtcacaggactattttggtctacgtaccacccaccaacaacctggaccagtatcctcattcatgggcagatggtaagtaatgtattcaaggtcataagccaggaaatgacatagcctctgcattacacatgtgcaggaatcatgcatctcagtgaattacagactccaccccaaacagtacagccctgtttacatcctaggagaaaccagaggagacaagtttcaggactttggatttggcattgattttttgataggagaccacagtcacaggtaacaaaagcaaaaatatacaaatgtgactacatcaaacatgaaaaagaaaacaatggagtgaaaagtctacattctgctgctaagtgaaataagccagtatcaaaaaaaagacaaatattgtatgattccactcatataaactatctctagtagtcgaaatcatagaaaaaaaaaaggaaatgtggttgcctagggctaggagtagcaaacagacagaattagtgtttaatgagtgcagagttttgcaagatgtgaacattgtagagattggctacaaaacaatgtgcatatacttaataccactgaactgtacgcttaacaatagttaacatgatgtcatgttatttatatttttatcacaatagaaaggactgaggagcccgctgagtctagagctagaaatatagcacaagttgaacaaggcacctgtgagatatagcacggtttcttttcaaatagcatgctcagcttcttattctctaattccaagtaccccccactttcttctttctggtgtcactacatgcccagacatgccacagccccagctcacattcctttcctgatgtgagaatgggctggctctctagtcctctgtggatgaccccttcctcctctcccctctctcccatcacacgcccacctcatctaagaaagtttaaatgtttagccaactgagtctaaattgtgcggcctgaccccagccaatggggaaaggacacaagtgcaggagtcgcgttaggcataaaagcttctactctcctttgcggcgctgctgtggcagccagccctgctagaagcacccttctgcgcaaaagtaaatttgctttgctgagaaatcctgtttgagtgctcatttttctttacaactccgagttttatttctttttattgtattttatttttttttgagacggagtctcgctctgtggcccaggctggagtgcagtggtgtgatcttggctcactgcaagctccgcctcccgggttcacaccattctcccgcctcagcctcccgagtagctgggactacaggcgcctaccaccatacctggctaattgttttgtatttttagtagagacggggtttcactgtgttagccaggatggtctcgatctcctgaccttgtcatccgcccgcctcggcctcccaaagtgctgggattacaggcgtgagccaccgtgcccggcccgagctttatttctaacagcacctctaatgtgtgctttaccctcccatagcacagaatatactgcattttaagtcttttgtttacagctctctcattctgtagcatgagctcctaaagattgatcttgaatggccattgtgaatttaatttttaattaatccatggatcatgcacaactgtaggaaatacaaagcagttcataaatatgtgaagatcaaaaattgttcacactttaaaatagtgaactgtgtaagtttgtatttaaaatggactattgaaaacaagatatggtcacagaatctacccctgatttctttaaagcattttcccactgattggacattattacctaataattacatcacatgaaaagaaacgagtcaacacacttgggtgatgaactagttgccacatgatttagaaatgccataataaagcgggcacacaatgttgaaccactgaaggatttttagccggatataattaatgatctgctcaaagtgacattttggaataaatctgagcatggtgttgtgttgaaaaaagtcaaggacagaaagatcacttgaaatttatgattatagttcatgagaatgacaagatttggggaaacagatattttaaaatgagaaataaacaagtgccccaatcagatagtgttaaaaaggcttgaatgccaattatagatcctttataaagtatcgcatgacttcctggtgaactgtgatagaagcactgggaaagaaagcttctacttcatttttacttattcaacaggaagtaaagaatagacaacctggtgacagaaagtggggggactccaagcagcccagcctgatttccacttcaaatactatttccctttttaacactcaaaactttactcaccacccatctcaatcccactgacatgtctaaagtccactcccctgtgtctagagccttgatcaaaagtatgacaggactgaggttttcataaatgatgagttggtggttggctaagtcacagagccactagtcattacttattccatgtctagactctttattccctagttacttaccatgaaacatttgcaagacctactgtagaacagagaattctttcaagttttaacatccaagacataaatttggtagaaaaacatcatgaattctaaagtgagtaagaatatcctgaaaccaaaggaattatttaaaaaaatagaataatcataattttcaagtgagcacaacttgtcaatgagacaatatacttctatatctagctctctattgaaatacatgctttgtagtatcatcctttagatttatccattatttgggaatagaggatataagtgtgctcagatagtgccagtttaatacttgttaaatagtttgcatcctgtgtctctatatttgggttcagaaacccactgtgactcaacagttttccctttctgtagcatgcttctgtttccaaaggctagacttacctaaatgatattatatttaatgaaagtaaactcactcaaaaactaaaggatctacaaaatcctgagaattcccttatgcagtaaatcgagctccttgcctgtctcagaaccatgtaaaatcaatgacttccaattattcttagaataaatcctgggctacaacgtactgcgcactgtggctcttgccccctttttcaaccttctttccttttcttctttgtcttccttttctgactgctcacagcccttccttgttctacatttttgtttgttttgtttcacaaatgtgctgggttcttttccacctggggtctctgtattgatattttgctttggctacagcgtttttttcctaagtgtttttatggctgactaatgctcattttttttctagggatacttttaatctgaggcattgctgtcatctgcatctcagaaccccgccaatttgcttcaaggtgcttatcataacctataaccagatttaggtgttttctttctaattgtgcccccacctcaagaatttaaatttgaaattagcagagaccacattgatcttgttgtctggttgtgactctacttacagagtcaagagggcagggcgagacatgtgagtggagtgtgtataattggtggtgcacgtagggaacctacaggacacttaaggggggcagagaaggggaatggagaaagaatcaccctcaggggaggtgggaggaaggcccacatgcactctgtgaaggtcattcctaaagaaaaacaaaccaaacatcgtctcccatgaggcacaagggcagttgaacccaatggcaattgtcagtttccattgaaaccctttcccacatgggcaacattctaaaacaacagtggagtgagaagcggcaatatttatctcatgattgatgattttctgaagcaataagcaggaggtcagcttggaagtacgtgacgttactgataggacctaccactgaaataactgaggtaatcctaagtggctgtcccaagaagtgattgtaggataagtccacccctacccctgccttgtcaaatacattagaacttgaaactccaaagacttgtggaggacaacttgatttcaatcactttatttaggaaggaagtcaactgaagcaccatgtgattacgtaatttatttggcacctgtcccttacactgagtaattgttaaaacgccaaaatatcaccagtaggagtaaaattttaatctgttattagttttttgtgttacactcaacacacaaataaatattgaatgcctaaagtaatattgtagaagtgacttcacattcccagacgaggctctggaattctctgtgatgtaagacagaagccagaatttacattgttttagatatttccatggtccttggtgcacttagaacagtagggatgagagagacatgaataatctttgattgatattaatgaaagcaattttaataggacgcaggaatgcattgtttgtggccaaactgtgaagttgaaggtgggtcttaggaaaattttttgaaatgaatatgtggaaaaagatcttatggagtaattaatgtagaaataaatgcagtaagtgtcttaacatgaggcaatgaagattagttattacactattggatgaatgctggtttatatggtccttcctctgttggaggtagtaagctctcgtctcagtgcacagaatgaaatctctgtaaacacactcgctatattggagttctgctttctctatttatcatgtttcctgtgatgttactcatgttcaccaaaattccaattaagaactctcctcagtagtgttaatgtaatattaaagtgccattaaagcatgtattaataatttgaatgtgcttataaggattattgtaattataggggctaatccaagttatctgtattcaattatggcaacgtcctgccaaaaatgttgagtatgtttcatttcaaaggacataaggcattttccagaattttaatcctcatttagatacttccttctaagtacctgttttgagatgaggaaatgaaatggagctcatacatcagtgaaaacaagaattaaggaagtattttaatggcacattcataagaaacgtgacttcacagtaatattctattgaccagtgtaatcatcagcacagcgaactgcagaaattaattcagttagttatattatgttcccaaaattatatcagaaattgagacagagtccaggcacagtggctcaagcctgtaatcccagcactttgggaggctgaggtgcaaagatggcttaagctcaggagttggagactagcctgggcaacatggtgaaagcctgtatctattaagaatacaaaaaattagctgggtgtggtggcatttgccttcagtcccagctactccaaaggctgaggtgggaggattgcttgaacccaagaggttgagactgaagtgagctgagatcatgccactgcactccagcctgggccagagtgagattctgtctcaaaaaacaaacaataaacaaactataaaaattgagacataaagatcacttctatattttctagaaaaatttttaaaagactatattctcacaaaccttttagaatatagaactaagagcttatctctcttaattactgttttcttttcaaaaagataattacgtaagtaaataccatttccttttatgattttattgtcagaacatttaaagctaaatgtaaagcctaataatagctatcttaaaaatctaggtggctgatatatttatagctttctctttggttgggctgcctttaaaattttttccattaaatttttttttattgtacacactttttttatgttgcatcaaacacttaaagagaaggcagtttatcactttaaaaaatctagatattcttattttttacatgtttgactatgtattttttgagtgagatcttatttgttcatgacatattttttcactatatagctaactaccaattatataaatacatgcaagaatgacttaatcaggtataagttttgaactcagtgcctttaaaatagtagtactatatcacaaaattatctacatatgttaataattgcaaaatataaaagtgtgaatcaaatcaggtaaaacagtaaaatatttatgtttagtttataacgataaaatcatttgactaaagaaaagtaatactttgaacattcaactatactaaaaatgtagaaacaatgtctccattttactcccacctggtaaagaaatagcgtcaattcaaataatgaaagagttgttatatttgttttcttccaattacctcttttttcctcataaccacaaatcactgattcaacctcctacgttattcagaatatattgtaaatgtgatactgcaatttttctatcaggattttctacttccacttccttctttcctttctttcatccctcccttccctccctcccttccttctttccttccttcttttcccttccttcctgcctgcctgcctgcctgcctgccttttttccttccttccttccttccttcttccctccctccctctctccctccctgccttccttccttccttcctttttgtcctccctccctccctcccttcctgaggttgcctttgccatgggtttcatgtttgaggccccgttccctctgcataggcttctgtatctacgagcagagcttcagacgtgggaacatggcttccacactggaccatgtctactgctgggctactatgtaagaaagagtaacttaaatttgctttgcagaatatattagtattatatcttatggattctaaatatattttgttaacttcactgggtttcctagtagtgaatgtgaattaggagaaaaagtaaccttttaagaaaggcagtgaaataaaaaccttacatagaattactttggagctattttgactcagtggcatacattaacactaaagaagctaggataactgcaacagtcttttgcttgagttcaaacataccaattaggtttaggatattaattttggatagatgtcattagatgaggtattgaatgtttcactgtcttgttagaagtaagctaaattagaaataacttggaaagacagaaatacgtataagctgaatcgtaataatagtcaaatttagtgaagaaggcctgaaagtgaaaaatatgattattaaacaagtattattatatattaaaatcaaaatactttctattgtaagccatctctaaatggaaagcaattcttaattagagggaaccattctgctaataattaatctttaatgagaatatacattaaatttaattctgtaatttatctgtgaacatctctgaatgttttcacagttatgatgaaatccatcactatattaaagttatgtgggggacagatagatagatctcattaaaaagtgtgcattcaaaaaaaacttctccacagttaacctaaaaaatattttagtattggtataactatctttgaactagggcaattttcaaacccctaagacccttaaaatctctagagtaattttaaaacctactagagaaattttcagatccttacattgtaaaaccccgtgaactagaacaatgcaaaaatcccatccacttgggatgtagagatctgcaaaaaagaacatccctcccactttaacaacgtaaaaatactgaagtataaaatgatagcttttcttgaacccatcagggagctgcgtggcaggtaccctggtgacctcatttccttttctttctttctttttctttttctttctttttttttttcttgagacagggtcttgctctgtctcccaggctaaagtgcagtggtgcaatcatggctgtctgtagcctcggcctcctgggctcaacggatcatcccacctcagcctcctgtgtaggtgggactacaggtgaggccaccatgcctggctaatttttgcagtttttatagagatgaggttttgccatgttgcccaggctggtcttgagcttctgggctcaagcgatccactcaccacagcctcccaaagtgcttggattataagcatgagcaaccatgcccagcttggtgacctcatttctaaaggacaaactcccccagaagagacgagagccgcatgctacgtgtgaagcaaaacaatggggaaaggcgaccagaaaagaatcatcagcttaataaacaccaactgtcgcaagtggagcctgggcctcgtgtgactctggatgcagacgcatggggagtgtgcccttccacccacaggcctctatcagggggctataagaaagcctaggggcacagctggaggccagaaagagctctcccagcccccagtgcagaggctctgtgacgagaagggcgtgaaacaccatgcatgtccctgaagctttgctcttaggaaacacaaatcttaaaccactgcaggggtgcagcaaaacctgtcatttcaggatctcatattatacataaagtgacataagattatttgaaggtaagctctgctctataaaaggtgtgtttcaatctctaggagaccattacaatattaaaaattcttccctaataagcccatagtagggataactggggcaatagaaatacttaattacaccaaaatctgtcagagaatgtgggaagaaataataaaaaaacagatggggtaaatagaaacactccagtctcggggcccgtgtgttcaatcttgttgttcctcccaccagcttccaccagatcaatactgagttcaataacagtcactgccaccttgttggccagcagtaagatccatcctgtacaccttgaggtcaggctttgtaatttccaggataaatcaatattatcaccgttcacacagttgcactctaagatatctggatatgtattttgtcttggtttcattggttttctttagaaaagaacgcagaacaagagtgacacttgtgttaattctcacatgtccagttaagttaaataacgtgaacgaagactaaatggctatagaatatattaataattcaaagatgctaatctttttgagcttttacttggattctgtaagattacaaagaatctaggtcatatacattaaaccagaggattctgtaagatccctgagactgtagatcatatacattaaaccagactttcttggaactgcttttgctaccattactattttacagcccatctttcaaatataagtgtttggtttttgtttgagaaatttccaccagtgtccatttggatgtactatggttaagggggccttgttttcatttctatatgagaaaagaactcctgagatagaagtagatgtagataagccttaatggcccaggttttagaaccaggcatacttgatcctcagtatggactcacaagctccttgattctccagacatttttcagagagcactgacctttggtgtcattgtttgtaaaacagccatctatacgtcaccttcctggtagggtagtctggatacctcgcaaggtgctcagtaaatggtattcgtaataaaatgcacttttcatgcctgcctctgcatgccatctgttattaacagtgtggctaggacccaggaaggctaaaaatgctctatgctctgtttcttcagttggaagaaatgagcagacttcaaaaatatagggctgttttaaggacaaataagtaacaagcggtaacaagtttagagcaagacctggcatagagtaagcgtctactttttttttccatttttatttcatggacataaaataaaaatctgaatttagagatttgtagattggcagtccatatcttaaaataaatgcaaaaatatgtcaacaaatttaagatatcagaaaatcttttggcgatttacatcaacagtcctgataccatttgacgctaattgtagtaaggttaattctacaaatactttctataatctatatttctttttttttttttttttgagacggagtctcactctgtcacccaggctggagtgcagtggcgcgatcttggctcactgcaagctctgcctcccgggttcacgccattctcctgcctcagcctcctgagcagctgggactacaggcccgccaccacgcctggctaattctttgtatttttagtagatacggggtttcaacgtgttagccaggactgtctcgatctcctgacctcgtgatctgcccgccttggcctcccaaagtgctgggattacaggcgtgagccaccgcgcccagcctataatctatatttcaaattctggcatgaagaataggaacagagaaatgagttcctcttaataactgaatggcataaactatcagaatggtgttagtataaaaaacaaccacttaaaaaagaaaataacaaacaaaaatgtggcattatgtttagcccaattaaaaaatacattaaataattaaacaaaagcttggattctcaaagttcatctgaatgagaaatatgttagtctctcttttttaatgaatgatattgtctaggaataaagagaaatgtagataattatattgatggggctgaagcccaggtaagtgcatatctcactgtatataataataagcatagatgaattatttcactagcccctctttccaagacaaaggaataaaaacccagatgctacaggataactttgagaatgataagagcattcatcaatactaactcccccaaaactattagtgaatttttaaatactatcataaacaaggcttatgtttttctatctacagagagtcacaaagtatatcaaagtagcagattttccagacacatcctacataagtaacatccacagtatcattttatactgtcactgaagtagtcctcttcatataaattgaaataaacttgcagacaaatgcccataataagcaggaaaatttaaccagaatgtgaaacagccctgtggtttgtgcctggcttagaatatttatcatcagctggcaatctggcctttcaaaaatatgcatgcatttacatcgtagcaaactgtttatctcaattcaaaagatcacttattaaagcttatccatgtatttgcttatttgcaactgcttattaaaggagatgaatatcaacgttaaacatttttagtgcttgaaaacaggtcctaaaataaaccttactctcattggaaattcttatttcgcttttacaaggtttacctgcataatcaaacgccaaaaaagatctgtgaatctgacctttgtcattccatttatcagactattaactctgtctcacatccatctttaaaaggttagagtcgactgtgcgatgccttcctccaattaaaatgaataacacacaaatgcaggctccggagcaacagctctctactcgttcttattttaactgcctttgagactagaaacagaaaaggcttatgaccataatctaggcagaagtcaggattgtccaccttctggggaatgctaatatgagtattttttaattactcataaaaaactagtaatattacaagtggttcatttttgtgctttttaatacaaacaacctgaaattatagcagttatatctaattacttgagatttgaacttatacatttacccattaatttgtctctcataatgtatatttcttttgtttgtttgtttgtttttgaaacggcatctcgctctgtcacccgggctggtgtgcagtggtgcaatcttggctcatggcaacctctgcctcccaggtgattctcctgcctcagcctcttaggtagctgagattacaggcgcccgtcaccatgcccagctaatttttttttgtattattattattttttagtagagacggggtttctccgtgttggacagcctggtcttgaacacctgatgtctggtgatccgcccacctcttcctcccaacgtgctgggattataggcatgagtcaccgcaactggcttatgtatttcgtagagccagatttcataacactaaatttcatgcaagtctttcacagttttagaaaaataatatttcactgtttaataagagcatgatttattttttctttaaaaaaatgactcagtataacagtggaagctgtatacagaaagagttgaccttacttttgtattccaggtggaaaccagcagctgccacactaatgtcagactggaaatgcaggtagagttggttggaagtactgttcagcagtgccggtactgtggtgcctgtaagaaacaatgcagatagaattgtaacactacaaatacattcacttttctaaatataaaacatatgagaatacttattaggcttacaaatccctacagtttgtctgattaccagatatttaatctgagtgttggttttattatgtattcagccattctatttttctaggtacaataaaaagttacccattgtctgctctgacctgctcaagtcgatgtgacacctttctcttgtacaaaaactcctattgtagcatgaggtttttttgcattgttttatccatgtaatcttctgcttcttaaatttatttttttacttgacatgaacagagaggaaagaaaagttcaacagccaagagtaatgagggttgagggagcagtcggaccctgtggatagtgatctgacatatccttcagaagacgttgcttttgaccctgtatatatgctcttcctgatccctatgtgactcatgcttagtaatgttccccctggatctgttgatgatttcaactaaagatgcatgaaaaggaatatatagggctattttgacatagtgatttctttacttaaaatgttctagcctacatcacagtaactaaccgattggaaagggcaatacagataccgaggaccagggtaagaaagaagtaatgatgctggcaggtgctgaggaaaagaaaatcgttcatcactcagaagtttgagacattttggtggaatgaatcataatatggaaaaataatagacaagtttaagtcacttttttcctgatgtatgttcaatactctagtaaaaacattctctaaattggaagtgtagacatactcgatgtcaaagaactatccattgtgtaaaaataaccacagtgtagataaattattcaagtactgctgtataaagggagaaatgataatttaaataacaaagcaaagaaataagttgataattattccaaacagatgaacattattgaaaagataagattgtctatcatccttagctcaccacttaaactatccaatatcccccaacagattttatttttttagatggagtctcgctctgtcacccaggctggagtgcagtggcacaatcttgggattctcctgcctcagcttcccaagtagctgagattacaggcatgctccaccatgtcctgctaagttttgtatttttagtagagacgggatttcaccatgttggccaggctggtctcgaactcctgacctcaagtgatctgcttgcctcggcctcccaaagtcctgggattacaggtgtgagccactgcacccggcccccaagagatttgatcagaccaataaccccaggcaaggactctggctgtctttttataagaagctgtgtgtgtgtgtgtgtgtgtgtgtgtgtgtgtgtgtgtgtgtgtgtgtgtgtgtattgttagtagagaagggggactctggctgtctataagaagctgtgtgtgtgtgtgtgtgtatgtgtgtgtattgttagtagagaaggactctggctgtctctttataagaagctctgtgtgtgtgtgtgtgtgtattgttagagaagtggtttcaccgtgttagccaggatggtctcgggggactctggctgtctctttataagaaggtgtgtgtgtgtgtgtgtgtgtgtgtgtgtgtgtgtgtgtgtgtgtgtgtgtgtgtattgttagtagagaaggggttgttagtagagaaggggttgttagtagagaaggggtttcaccgtgttagttaggatggtctcgatcaactgacctcgtgatccgcccgcctcagcctcccaaagtgctggctttacaggcatgagccaccgcacccggcctagaagaggctttttaaacatgaagtgtgtcgaactaaacgcctaatctatctatccctgaaacatcgagtaggtctctaacgcctaatctatctatccctgaaacatcgagtaggtctctaacgcctaatctatctatccctgaaatatcgagtaggtctctaacgtttcttaacgataccatcggcatccatccacgtcacaaactgaacgcctaatctatctatccctgaaacatcgagtaggtctctaacgcctaatctatctatccctgaaatatcgagtaggtctctaatgtttcttaacgataccatcggcacccaccgacgtcacgaactgaacgcctaatctatctatccctgaaacatcgagtaggtctctaacgcctaatctatctatccctgaaatatcgagtaggtctctaacgtttcttaaagataccatcggcatccatccacgtcacaaactgaacgcctaatctatctatccctgaaacatcgagtaggtctctaacgcctaatctatctatccctgaaatatcgagtaggtctctaatgtttcttaacgataccatcggcatccaccgacgtcacgaactgaacgcctaatctatccatccctgaaacatcgagtaggtctctactgtttcttaataccattggcatccatccacatcatcacattcaaagcttcctctttctccatgaccccagactgccctccaatcagtcatcacgccttaactggcgtgcattctaaatattttcccaaattatttcacttaattcatattattttcacaacaatcaccccagtgcaggcagccttatgttaaccagaattagtgcaataatcttccaacttgtttttttgagcctgatcttttcctaattcaatgcattctccattcagcagtcagaaaacactttacaaatgtatatatgatgagacatgttaaaattctcatagattcctgatcatcttaggaccaaatttcacactccttgatttggcccaaagaccctgcatgatctgactgctgcttgcttttctagcttcttatcattacttgtttttcagaatcattttttcttgcttcaagaggctctgtatcataggcctgggatgttcgttccttctcctttgattcactttgactttcctatttctattcattcaaatataaccacttatttcccaaactaagccactcactcaattcaataaacatgagtttatcagccagataaactactaactcattttccaaacatactagttattctctgacttcgtgcaaagcagaaccttccctgattaggacacagcctcaaaaacttgaacctcatcaaatccttaaaggcaatgagcagaccaacggtgccatgcaaaatatgactgtgacagctttaatctgtcttcagttctgctcttatcacattcatctcctgcctgggctaatgaaatagccatcaactgagcttcagaatggatatttgccttcttcttacgcatttgttctgcacacaaaataacctgcttacaattaaataatgcttgcacattttatttctatacatgggcatacgacgtgtcttttaataaaattttaggtcaacttcctgatctatactgtgctttcaggactcatcctatggagatggggaaatttaatctttaccatggctgggaattcctttcctgcctcaggatagccaatagtctcagacttttgagtccttgactccttacttcacataagctcattctccaaccttatccggacccttaaattttagcagtttcatgtttttgtgcacacctttgatagaatgctctttgacaagtccctgctccaaaatctagcctaagtgcatcaggctaccactttgttttcaaggtcctgtcacatccctgttttgtcctggtttgtctcctttataatatagtcttaatcatatgtataagtccattgctttctcaagttccgtgaggtactctagggaactatcaagaactgaagggaccatggaccccctaaatttatagccagttggtcagagtgcaggtggcctgggaggccccgagggcttgcagctgacgtcagaggggagtcctgtggagaagcatgaagtgcacgaactccgtgctaactccaggaaattagcgtcagaattgcattgcagtggtatttatgtcaaacatattttttcaaattttctcctggctaactccaaaaactgaaattaataaaaaggagattgttgttatttttcatgcatacagaggcaatgtggtcacttctttttttcactattattagtaaggcatttccctgctaactttggctaatccatcatgcagctgtcttaattttgccgtctcctgctttctgctggtaatgcctgcatttgtgtgtaaaatgtgttctgtcacagatttatgactgagaacattaggttaaaaacaattcaatatttaatactctcttttgaaaaattaacctatttctaatattaggatatatgaaattattacacatctgaagctaagttcacttgtgatagttactcgagggaaggcttaatatgaggttgctgtacagcagttgataaatccaaatatatgtgaatgataagatttgatcctcagacaaaacgtggcaagacacatactttctaagcaggttttaccaactgaattcataaactgtgaggtaggtgctaggaattgtgcatgacactcagagattaatatagattctgaagaaacttaaatctctacaaactaaaagaacactttacttaaaaatgagcaacacaattcaatatctgagtgtagagaaacagacacagactgcatggctcccgtgacttgaaggatttcctgtctctctctgatttgtctagctatattttactaatctgttaagatattttaatttatttttcccaggtagcttttttttctcttacatcttaaaaaaaaaaaaagtgtgacttttttccctcctgtaacacccatcacctacctgtaatgctgtctatttaccaaatattatttatataattacattaagtgttggcatctgtgtagattttaacttgtgttgttgttgttgatgatgtttttaatgagagaggccttatcttgtattcctaacaacaaacacagtgtctgatatctagcaggtactttaagaaatcacatgctaaactaaactattggaagagctatgtggtcaggggaagaaagagggatttcctggtggagatgggccttgagttctagcttttaaggacagtaatgggctatttgaaataaaagttcctaaaagtataaatagtacacaggcagacaaacatggattgtgaatgacagataacaataagatgatagattggcactttattcccaacaccttaaatggccatgcccaaataaaaatatggttttatttgctgagaaccagagataagatctttgaaccatttgaagtgataaaatggaagttgtatcagacactgtgaatggcctgtgcgctatctattttctttatgttttttaacctattgagtaaaagtagaacggaaatatttagggaaaaaatatccacagttaagaaaaaatatatattccagcctccctttgcagtagagataaacaactgacagaattcagacaaatgggatagaaggagtcagctactgcaagcaagaagggactcatggaaaacagtactttttctgtcatcttggacaattctctagtagctaatctttgttcttcattggtaaaacagagatagcaataatcccttagaacttagttggtgctgtcatattggctacttttggtaattttagtagagacagggtttcgccatgttggccaggctggtctcgaactactgacctcaggtgatccgcccacctcagcctcccaatgtaatgccgggcttacaggcatgagccactgcacctggccatactcaagataaaattaagcattcatgttaacagaagttcataactggcaaagtaaaggctcaggaaatgtgggcaactgtgaggacagtgatgaccagggagataatcgcaatactgatcatcatcactgctcatgaagtttgagtcctaatgctattacagtgtaatgctattacaaagcaaagtgaaagaaagcggtgtcatgcatctggaggcaggatatcctgttaaacaaaagcaaaattgagattgaatgacgctcgagggcaatgggaagggaagacttgcagggcatttggagagcagactcgtcaaggcgggtgcattcgtgagagtcggaggtgcaaggaagactaagagagggtggacttgcagtggactacaatttcgtgcctggctacatatgagtagggtagaatctcaggactagctgagcccacatgctcagtgtaattttcccagattgcttaatgtcaggctgtgcattttaagagttgagaaccgtttcctaacctctgcctctttgctacctcacattactattcctggcttctgctgccagcctgagacctgccgcatgtcaaagctctgctatctgacacttttagattggtctcctcctcgtggagaacacagctttgtttttactcacctgtttcttgatggtcttactctaagactttcagcactagagcaaccattatggagatagaagaattgtgtaggaaaatttctatgtggagtgtttgctgttatttatgttgttttcttggtgtttgcagattttgagtcacacaggtgaggaaattgactccatcttacctgagaagcttcccagtctgggtgcggtcacatccccaccatcgtggatctcaagggagtcccagttctgctccgtggcaaaactgatcacttggatctaccaaaccatgacattaagttaatatttatttttggcttaacacaattagtctaattagatggggttttggggtttttcatgattaaggtgtatatgtatatatatatacatatgtatatgtatatatatatacatatacaccttaataatgcctccaatgccatatatatatacatatacaccttaataatgcctccaatgccataatattatatatatataccttaatcatgaaaatcatctacatgtctatctatctatatatacatggcaaaatttaaaaaaaacaaaacaaaccatgaaagaacaatttatttttctttttcttttcctttcttttttttttttttttttttgagatggagtcttcctctgtcacccaggcttgagtgcaatggtgcaatcttggctcactgcaacctccgcctcccaggttcaagcaattcccctgcctcagcctccctagcagctaggattacaggcgtatactaccatgcctggctagtttttatatttttagtagagacagggtttcaccatgttggccaggctagtcttgaactcctgacatcaagtgatcttcctgtcttggcttcccaaagtgctgggactacatgcatgagccaatgcacacggctgaaagaacaatttctacaaatggtacttttgatagtttttattttaaaaaattgattatatttattcaaaatatagaaaaatggttagaaatattttgttgaaatactaagaaaagggaaacagagtatagtctatgtatttaaaataaccagtataaaaggaaaaaagagagagggagagagagagagatggaaagaaacatagaacaaaagaatgaaagaaagaagcccatggaccccagctgagccctgttgtagactgtggacttcaaggactcacctgaattcccgagccctccgtaactatgatcttccatatacagttcaagttgtttccgtatggctcagggtagccgggggacaggattgtacctcttcgttgagtgaaattgccactgcagggtactaaaagacacaaccatatgtcatgaaataaagtgctgtgggacagtgttgatttggcatgcagttttctttcactgtgtgaccacacagtaagagaaaatgtacatgaacaatgatacgttaaacggcacttttagccaaggtaaaattcagtgtattctcttttaaattagcaaaataattattacctattatgctactcagttatagatcttgagtctataaataaatctatccaagttctctaagaagggatgatgtccaatgatggcatctccaaagtgaattctgtttagaataatttacctactataatttaaggaccttggcagagttttctcttctccatgcagacatgcatctccaaatgatattaatgggatttatgagcaaattcaagagaagaggcgcttaaaatgtacaaatgattcaagtgctaatcatgattgcgctggagctttccacacaaaatgaagcaggtaaactataactaacaaggtcactgttattcagcctgcatttacctattaattttcaaagattcatcagcaccaatttattaaaaggacgttacacaagtaatatagcaaatcaacatgataatggttttttcccaaaatgagattatgttccacacccataactttagagttgatggcctacttcataaatatggagaagggaaacatgctttatccttgttaagatgatgagttgttttatgaaacacaataatttttagggtttggctactaactcaattacttcccatgaaacaaactgccctttaaatgggtcatgagccagatggatttacgtagcctggatagaaacatgagaagtaactctttggcaccaccacagagttctggcgggcagccgcttagggacactgctcacccacacagctggggatcgtgtcgttccactgtgccaaggcgttgggcacggactggcagtggagcgccgtggaaccctgaagcaggtatcccgggttgcactcgaatcggacgatggagccggcagaaaactcagaaccaattctccttccgtatctgggctcggggacagagctgcattgggtgtcactggtacgaggaacagctagaagcaaagtacagaacacagccgtctgtatctccatcagcaagccaggacgttgcgtggaacgtgggtttaagatgggaccaaggagagctgatgcagacagagaatttaataacgactccaacaatcgctatagagaatgatttgaggcgctgggaccacgcagagctggtgcagatagagaagttaataaagcctccaacaatcgctatagagaatgatttgaggagcacgttcccaactgtacttcgccctcaggaccatctcagtgtcctcacttcagatgaggaaaacggcataaaaagactcagtgccttatgaggacggattgatattcaggcgattacatttaatcatcctgctagtgataatgagatgactaaccatgcgtacttgtcctcacaggcctctgagtctaatgagaaaagctaccatatgaaggatttgttataatatggccatcgtgatgtaataaaaatcttaaactaccatcagatccagcaatcccactcgtgtatacttatctaaaggaatttaaattgggatcccagagaaaaatcggtactctcacattcattgtagcattcttcaaaatagtctagatgtgcaaacaacctaaatgtccatcatcagatgaacagataaagaaaacgtggagtagataaaagaagaaattctgctatttgtaataacacggatgaaccttgaggacatcgtgctaagtgaaataagcaaataagcagccacagaagaacgaataccttatgattctacttctatggggagatctaaagtagtggcactcatagaaccagagagatttacaatggtagttactgggggctggggaacaggaaaatgggaagcaactgttgagtggctataaagtttcacttacataaaatgagtatgccctggagacctgctctacagcactgtgtttatagttaagagggtagatttttctaatgagaacacctgctccacgtgccatcatgttgcatttagtcctctctaaagtcacctaggatgagctcaaatcctaacaagccccagccgggtgcagtggcgcaagcctgtaatcccagcactttgggaggcagaggagggtggatcacttgaggtcgagagttcgtttatcagcctggccaacaggtgaaacccccgtctctactaaaaatacaaaaattagccgggcatggtggcacatgtctgtaatcccagctgctcgggagtctgaggcaggataatcgcttcaccctgggaggcataagttgcagtgagccaagatcacaccactgcactccagcctgggtgaaagattgagaaaaaaataaataaagtaaaaaatgaaaaaatagcaagcccctccagttctctcttgatgagactttcctaggttctgtaaaatgggaggccttcattgttgcagcaagcaaaaacccagggatatggaatgacgtgtgtgtatctcatgggctttggatagtgggtactgacaggtaagtatcagtgcaacgtgtgggtgagataactattcaggttgtatggcagaaattaccatctacaggagatattcctgtttatcaaaaggaatgtgggataaagattaaaaaatacttcaattggcaaagaggtccatcacactaggcaaactctgaaaatagttatgccctttgaaatttgcttattttgtttttgtcctctgcagtgaaaaagacagtatttaggtactgtctctgggattctatcctcctcagtccttgtgtttcttcatcctaaatgcacagtcctttagcagaatgttctcgtatatgaattttcccttaaaataacccttctatcttcccacggctttttctgacacactggaatctgttttatttatttattttctgttgaatcagaccaacgacagacattatttgggtaactgctgctggggaagcagttccatgaaaacggaaattggcagattattttgattaaacgatgtttcaatttggtgttgagatattttctatcagaaggcaaaattaataaaagtgtctacctttctaacagcactgatgtggaaaataattaatgatttatcagaatcattcttctccaagctaaaaatgaaatacagaataacgataatattctattataggtcaaggatctcttatctgaaacgtttggtgtttcaggtttggaattcttgtaggtgttggaatatttgcataaacataatgagatatcttagggatgggacccaagtctaaacatgaaattcaatgatgtctaatacatgctttatacacatagtctgatacaccttctacacgtgctttatccttgttaagatgatgacttagtttatgaaacacagtaattgtcatggtttggctactactcaattgtttcccataaaacaagttgccctttaaataggtcacgagccagatggatttatgtagcctggagagaggcacgagaagcagcactttggcacaacggagaagtcctggtgggcagccattttatacaatattttatattttgaaatacaaatacaatattttaaataattttgtgcatgacacaaagtgttgactgcattttctattgtgatttgtccatcacaggaggtcaggtgtgaaatttttcctttgtggagtcatgttggtgctcaaaacaaagcagatttggagcattttgaattttggatattcagattagggatgctcaatccatataacataatatttcttgaaattatttgtgtcatgtttgcatgcttgagtattttattagagttgaataatggcatgaagaaaaaaaaaaagatatcccatagaggcttccacagtcatctcaaggatcttccacaaaatgaagcgctattgccagtttttctacttacactggattgcttacaaaatacctgctatcgtggcaaaggttgcacttatctaagaggcttcaggtattgcatctgtcacttgtatatctgggagctatacaaatatatttgagagctatgcaaacatatttgtacctttgagagatacagggtatcactatctttccaagttcccaaaatgaggagaaatatagcaccaagggtcatttgtacacaagtcactattaactttcttcatgaatttcagagtggtctattttcaaggaaaatgacaataaatgaataacacctgcatctggataacaagacgaaaaatgttttttagaggaagaagtttggaaagtgaggacaccaattgtaaggacttgagacagtaggatagggaggcagggagaagctgtggaattgagacatcacagctccacggaacgtctgggaagcgggtgggtggaaatcagacagtgctgtgtaacttcatcctccccgcccgtcctctgggtctggcccttcacctggacatttcagacggcatccgagagaaaaattctattgtctgtcgtcatcattctctatcctttagtaaatatttcacactgctgtgaagccaaattgaaatcgggccagtggaaaagtgagcaggaatgaggtcagcctggaatagagggtgatcaacaaaatgattgacttctcaggccagacaaccgtgtttcttcagaggcagaacgctctcctctggggctttgaggtgctgaaagtgggaagcagcgcaaatgtgtgctcatctgtcgggaaaagccggaagcatgttgtgacaggttcgatgatcacccttcaacaccacaaatgctctaagctacagatacatgctgctcctttactgcacctctgttacagttgatgtgaaaaccacaacaacaatcataaaataaatctgagtgcatgtaggactcacttgcaatacctaagtgaagcagttttctttttgatgtagtgactgagggacattttctctctcaaaatcattcctctctcatcgttggaaaatcaggttggacaagccattactagtcaatgaattaaaacatacatcactgaattgcaagcaaaattttacatttattcttctttgcaaagaatatgctttttataggctcttgacacaaatgtgagtttttagatgtggaaaaccaactaagccatataattcatgccctctaaaaagaagaagaaaccaagggaaaatcaatcaaaacatgtatttgcctgcccagaaataacctcaagtaaagaaattcttaatgtacatctttcctacccaaactgagaaaaaaatatttctgtgtttttaggtctgtttattttcaggagaccatctgattaactattttattttattttattttattttattttattttattttattttattttatttcatttcatttttgaggtggaaactcattctgtcacccaggctggagtacagtggtgtgatctaggctcactacaatctccacgtcccaggttcaagcaattctcctgcctcagcctctcaagaagctgagactacaggcacatgccaccacacttggctaataattttttttttttttgtacttttagtagagatgggatttcgccatgttagccacgctggtctcaaactcctgagctcagataatctgcctgccttggcctcccaaagtgctaggattataggcatgagccaccatgactggcctaattaactatatttccatgaatgctaaagagactgagtctttccagcagaagaccctggaagaagaagccttgagctcctgagcctgggatgcaggtgctgcttcaggtgaggagcctgggagaggagaacccaggttagagatggtgacccggaaaacatgacttgaaaaagtcctggccaatagacatttacaagctgggcactgcggaaggggttcaatatagaaatatggtttccttttccctttaaaatgtacagtaaatccttgcagtttactcattttggtgtgactgtgtgatctggaaggaactgaaagcagcattgaattctatgttgaaacaaattacagaaataggccttttatgaaaacagccaggcataaatataagacaattgaaaaaagtagcatggatgaggtactctccaacatgaaggtttactgagacacagtcaatcatgcacatcagagggatgcgggagaagacagggcagggtgggcagctgtgaccaccctgtcttaaatccacaggagcctcggagcaggcaggaaagagaaggatgtgggctctgcctctcttggcctctgttttcaggcggattgattctaatgttgaaagacgtgaattacaggccaaagcaaagtctctaaatgcaatgtaattacttaatggcatagaatcaatggcctcttctaatcctggaagaagcagactgtgctggagttactaagaaacagtttgtgtgatgttcggcttttgcattgcgtctaagaatatgttgattttcggtgtaatatattttctgtgaaatgacaaagatccctaaacctgtataaccacggccagtaatgcaggtcctgccagtccctgcttgatggtacaagaccagggaatttagggagaagaggggaagctacaggagtctcctccactgtgaacactcgaggaattcccgggagctaagaaactggtataaaacactttctgcttgatgccaaaaagcaaatgtacaaggctgaacatattcaacatttaaaagcaagaattgtgtatctcccacgtcttcaagaaagcttgctaatgcagggaaaaaatgtagtcatggttcagacttggaatatttaaactgtcagaggtgtttgatccagagtgactccatcttcaataggggctgtataaaatgaggctgagacctactaggctaaattcataggaggtcaggtgttctaagtcacaggatgaggtaggaggtcggcacaaggtatagatcacaaagaccttcctgacaaaaagacgccgtaaagaagccggcccaaatccaccaaaaccaagatggcgactaaagtgacctgtggtcattcccactgctcattatatactaattataatgtattagcatgctaaaagacactcccaccagcacgatgacagtttacaaatgccatggcaatgccaggaagttaccctaaagggtctaaaaaggagagaaatcctagttaaaggaattgtctacccctttcccagaaaactcactaataatccatccctcatttagcatataatcaagaaataatagcaagtagaagcagctgagtggcccatgctgctgctctatggattagccattctttattccttaactttcctaataaacttgtttttactttactctatggactcgccccaaattctttcttgcgcgagatccaagaacctctcttggggtctggatccgcacccctttctggtaacaaaaccattacagatactcttatacttcaggaggggaataattagatttcttttcatgccagcttctcaccatagctttagcttctcaattctatttgattatatcacagctgatgaagtggttgctgattcagaggggggtgaaaggttgggcaggcaggactcatgcctgagccacagctgcaaacagtgctccataatcactgaaacttgttggtaatgcaggtcactcatctcagtctccatactgctccttccatcactggagaccagtgagttgtgagagtttcattcctgggagagtggataatgaccatgcccgttcattcaacggcacgaaactaaagataagagaagctcctggcaagtgctggctcaccatggatacatccatgctgaagggttatccctttctgaagggtcactggccacagccttctctggggcaccccatgatgtcactcacaccttcttctctcatgctttccaaatgtacccttctgctctcaagaagtgtggaaaacacacaaaaacccagcaattgcatagagtaactagaatactgcattaaagagcctctagacttacattgcttcagaagttcagaaagatggtaacatcatcattaattctgtcttcacattactaaccaggatgacatggagggtgggaagcagaaggctagagaccatgatctgtgcatgtctggagtcacacgtttttttgcacactgatgctgttgcaaacatttttcactgtagaccccagcagctctttataacagaactgtgtctgttaacaagggttagctatcctacaaccacggaagacataaagtctgtgtgcaatttgaagctgaatttgtttatgaatgaatgaagctgtaatggtgtatgaaagcactgtttagaatatttttctataatatagctcaaataatttttttttttttttttttttgagacggagtctcgctctgtcacccaggctggagtgcagtggcgcgatctccactcactgcaagctccgcctcccgggttcacgccattctcctgcctcagcctcccgagtagctgggactacaggtgcccgccaccacgcccggctaatttttgtatttttagtagagacggggtttcaccatgttagccaggatggtctcgatctcctgacctcgtgatccgcccgcctcggcctcccaaagtgctgggattacaggcttgagccaccgtgcccggcttcaaatactttttaggcttcaatggaactactgtctttcaagaagcaatgttccatttaacttttcatgtgtatgcaaaacttttaccattgctgttgagtaatttataagttgcatttatgattctagttcttccaaaaaaacttagttttgacaaaaagacatcaattttctgcataaacacactagtaggagcaaagcaagagaaggaggtatattagaaatttataaaatattgaggatgttagagtcgtcatatactcttgaggacaagaaaaataaatttcctctataaatgatgttcttttctttctacttttccgtatctttgacattttgatgaaaacgtattactttaaataagcataatttttaaaatacatgcctaccaaggacaacatttgcatataagacaccaggatatttgcatgcaatatattgtctgatgatgggatagattttataatctttatcaaaaaccaaggaaagccccttataaaggcagacaaggtcagtcactttagtgtttccaggagaaaaaatgttgaggcagcccagtttctttacacatctcacatactttggtctaaacgtgattctgcttttgcaaagtcagatagaatttatttgaaaaaattagaagtagtaagagacgggttgtttcaacaggccactctctaataaagtccatttttaaaaactactgggtaattatttacattttaataaaaggtgtaacttataacaatgtaacaccttttaatgcattagcatctccattcattcaatggctacttacacaggatcagagagatctttgtctcctgattaactgttaagcatcatcctcattctcttcccattactctttaaatgatctaattgctgaaaactgaagggtttttacactgaactgttttgaagtcatgaatttcccaatttgagatgattagaaacgattgatacataatataacactgttatactccacctttttaaaaaatacgtaatagtatcaataatgttttctggaggaatctttattaaaggaaagaaaccattgctaagaaaaaatttttctccagatctgaagaaaatacttaacagtggccattagtatctgtagcctccagcaaaattgagacctagaaaaactaaaatattgctttttatttttgaacacacagtttatctctgaacaagatcatttcttccagatctcaacctttacagtcatgacaagctccacgcaaagacttaatccaagcttctgaaagtgtatgaacagtttatgtggtcattttttcaatgcaaaacaaaagtgaaacaaattaggagaaaattctttactttgcagaatctttgagcaatctcaaatattttttaaaaggtttaaattaaaagataagtataaaggtgtaaaagtacccaaagttaataaaacacaaacaaaataaaataggtatttagttaggataagagatgcatgcgtgatattttgttttttgttttgttttgttaaatttccatttaagcttagtttttataataaaatgtgaaattgtataatgcattttaaacatatttcctatattgttactaagatctcaactatttcaaaatacgtaattagataaaatactgtatttgaagtcatcttacgagatgtgaagagctacagaaaggtaatatgatcaatatttattcccttctagtgcctgataaattagatattattgtgtttttgtagtagaaatatgagtttcaactgtcaaaaaattgtaatatttttattaaataattttattataaacatatgaacaccttcagctccttaaatattacaaaaatgcagctgagatgttttgagtgctttgtctgagactagccgtgggtgcagcatcaggaaagaccacagtgacatgtggagacatgtggagtgacgcttaccttgatacacgaagtggaagccgcgggcagaggcaccgctctttgcactgaatcggagcagaatttgatttgacgtagccaagggcaatgtttcccctagaaacgaaaacagagacagattcagaaaacacacagcaccgtgggggacggtagtattttggaaaatggtgataaagttgaaatttcacatttattttttgaacttttaaaacattttcactttatggtttaaaactcaaatatgttgtttttataaagattaaaaactctgtcctaggcaagaataggcagtgcatttgattaaaatatactgtaatcattatttcgcttatgatttcttttgaagaaagcaccaatggtaggcctatataatagagtagacagaagtaaagggtgaatcatttgctcagaatcaccttactctgattttagttaaaattaaaataattttacttaaaaaatttttaaaagtaactgaatccaaagatgattttttttaaattaaaagattcagaaaaggccttctgaagtatatttttaacctttaaaagcacatataggccaggtgaggtggctcacacctgtaatcccagcattttgggaggctgaagctggtggatcacttgaggccaggagtttgagaccagcctggccaacatggggaaaccacgtctctactaaaaatacaaaaattagccaggcgtggtggtgcatgcctgtaatcccagccactcaggaggctgaggcaggagaatcgcttgaacctgggagatggaggttgcagtgagccgagatggtgccactgcactctagcctgggcaagagagtgagtgagactttgtctcaaaaaaaaataataataataataataaaataaaaataaaaaatatataaaagtgcatataaaatgtggaagagtctgtgtcaagcagtggtgggaggtgtgtgaattggcataaggttttcagaggacaatgtgttactaataatcaacatatttaatgtgtatcctctgatgcattcttagatacatcattgaaccttggtagaaaataacaaaacataggtcttaagacttttagttaataataaaatagagaaaacctggaaatataatcaaatctgaacattaattggtcaaagcttgtgacgcatatcgtttactaggcaaattagtaaatgtacccagtaccaaactgatttagtaaatgatgaaaatgtatcagtacaaataaggggtaggtcatcaattaaaagtggggttaaattgtgctatattaaaccgactgaataccattcagaactcagagtaagggcattgggtgcataccgtgtttgttagagacagacttctgtatgtgattttaagggtaagaatgggataaaaataagttgtgaaataacattccatgttttatgggggctcatgtgtatttgcatgtgtggataaatgtatgcatgtatacatgtgaacacgtgtacatgtgtggctattaatgggtctctctatgtaggacttacaggcttagaatgctttagaccgaaatgttaatcgtttttatctccagaaggaaggttaagacacatgggatacaaaattaaacacagatgatagttgattatcccaccctctttttcggatctttgcaccttttactgagataaatattatattttctgcaatcttagtaagatgataaaagcacgtgattttatgtgtgagataaaaacacttttgagatcttatatctaaaataagatttttctaagcacacacgcaaattcaaaaatgattacatttctcattcatcaaaacaaagcaaaagaaacagacaagttaaaaattaatccccctagctgtctgaactaaattaagggcaaaattctttaagacttacctgagtgagaccccgagagtgagctgagaagtctggcctgtgcatgggttccatcaaataattctgccaaatcattcagggctgtctggaaataggcaaactgtccaaagaccactaaaaaataagaggtgggatgttggcacaagatgctctaagaaaacaaaatggagatttttgatttcactgaatatctattaattgccccaatggatcattatcctaagaatttggtaaaaaaataaatattaacttattttctctgctttctaagttttcagttgacaaaactattttactttgcttcttgacttttggcatttaataaaagaaaaaatactgttttatttccaatttgaacattaaatgaggaatgtttttgttttaataaacacaacattaagaatatatgggctggatgtggtggctcacgcctgtaatcccagtactttgggaggctgaggcaggagaatggcttgaacctggaaggcgaaggttgcaatgagctgagattgtaccactgcactccagcctgggcgacagagtgagactctgtctcaagaaaaaaaagaatatctgtaaagacttccctatattttcaaatatttagcaacactttattcaatgaaaaataagcaaaggatcaaaccccatgatgatttgatgaggaatttaaaattcctcacaaaagattattataatgccaaattcacattaatacgttgccgtattcatacacactgacttatacacgtgattctctggcatataataggaatcccttgctgttttccactctacaatttcatgtatcctacaggttatgaaaggtgtgtgaacacacctcctccaagtgaaacataactacatgctttgtgacttcaaatttaactgatgctgtgtattcagattgacgatacagagggcctttatatttgcaggaaaacctgtgatttggtatatacttacaagcaatgaacaactaattcttttcttatttattgtaagatttgcactacaatcattctaagccattataaacaagaaatggaggtgtgtgcactagttgtgtgtgtcagaattccaacggaaacaattactgttaatatttgttagtatgacggaagtaatctaactgtaacagtgtgtgtgcccatgtgtgtatagacacacatacatatatttatgtaaccaactccatacacacatatctaatataacttgtcttttaagattttataatttcccagagaaaaacacaaagaaggcatgtaggctaggtgaattttcccaatagatgaaatgctctaaaaacttttttcaggaattagagagggagaggacttaataatttctctacagatcttgctcataccatcctcacccacccaccacctccccaagttcattagatttttatcatactggaggcccaaaacttgggtcacaaaagtgaatcatccacagataatttctactctttttcaagaaatatttagctgacatccacctcatactagaaactaagaaaaaaggagggaaggggatagtaacatggtcttaggactatcatgctctaacgtgtttggtaatttccaagacaaacatggattttgagtacaagatgtcaggagccagaatgcccagctcattctggacatggccccaacgtcttccttgaggaacctccttcacctgggttctaacccgtcacacacactgagtcccagtgagcaaactcaattgccaagagagaaaagctgttcactgctatctacgctgctgccggaaatcatgagaatgtgatgagaagaacaaacaaagggttatggggcttcagccgcgggaactgtcaatgcttcatggtgaggggatggcactatcagcaagaaggattagtggaagaatggaatataagaaattatatcagcgaacggaatacaaaaagcaaaatggtggcggggacaaatgcagcaaatagtcaacttcagctaacactccgtggataaaaaacaaacagggggattggaatgcaaaggcctgtggcaaggatctcaaaggccaccctgaaaacaaacactttgctccataaataacaggagtgactaaggatgtttatcacgatactaacatgcttagatttgtgttttagaaagaattcttggctatgcttttggatgagaatagaggaaactgggttatctgaagacctgtcttattaataatatcgcttcgcattttcagcctgtgttgacagacagggagcagcctcttcctacctggtaaggatcacatcaccccgtagtgtctggattgcacatctgcctcacccctcaccataagcctgccagggacatggaccagattcctttcatctttgcatccctgtacttacaaatactgtgagattaattgtttagttaattagtttatttatcaggaaagagtaacgaatgggggaagaaagtaaaagatgagacagaatgcattttcattaaagattcgctgtaactacgttattccacgctgaagctttctgccagataggatgtgatcgtttgtgtgattaaacttttcaaattgggaaattataaacgatatttaggatatgagtatgacttctttagctgaaaatttttaattgtgtaatgatgacaataatattttgtatttaactaaaatcatagaatatggctgctaaattccattgtaataaatatattttgtcatgtttccatgaacagaagacttttttgtgataatcaggggaatactgctgagcatttaggtaaaaaaaaaaaaaattatttcattcaaattcagaattaaggctaaagttaaatgagggactttaaagaatttggtccaacttaaaatttggaatccagaacccattttaagtattactgcccatttatcataacaaagggaacagcaaggtttggggagggtgtgcattacattcgtaagaggcccgggaatcatgacacaatagaagtttacaaaaacactggctcccacacacaagtttcttacacatcaaatatctttcttgtcacatgttaaaaatgctttatctcaaatacgtctaacattagaatttttacctgctttatatgcagagtgagtgctgtctcagacataaataaaaaccttgactatgtagcgttttcaattttcctattggaaagagggacatagtctttaagatgatgacagctactatctggtttactccagaaaagaatctgatccaagataaattgtcctggtcaagagtgagagtgagcattgcataaatgaagtgcagagcgaccagggaaggcccttctggaaatgaagtcattttggaaaattagctggaattggaagcaatgtttaggagggaaacaggaagtcagggttcagcaggtgaaacagtcaagactctgcctgcttctccgtccctcagcacttacaggttgactcaaggatgcagtgatttcgatcatgatctggttactgagttcactgaatgtatgtgccattcatgcacagacatatacacagagttctgacccacccactactttatgagaaatcctccgttgctcataaaaacaaccaactgaaagaactatgtttgggaaacctaagaagaaagccaaattaattctctctgattatttcggatcataaccctagaggggactgtgagcattaatatcacattggtaaaaggactgtaatggacattgtgcaggatatgtttggaaggcctgctacttaaatgcaactcatttgcttttatatgaaatatttcactaagctctagcatacttgtttatcaaatgacagaaaaattaacactgaaaggaaatatgacaatgaattaaaaatacaaggacatccttaccgaattcctttggtaccgtgatggaatagaggcatatttgaccagctgtgtaattatgggggtagtttggtgataaaactaccccttctgatcccgtgtactggcctccacagggagctgaaaataaaatcaaccgagaattagtcgctgtgcaataatagcgcaggtgataggtgagccaaagctgaaacacatcaaacacgtgagcacgtttattgaaaacttgacaaaataagaagttaaaatcttgttttgcattgctatcaaagtcatagaaagacaaagatttaccagggaagaagtaatccaacttaggagaaaaacctaatattattttcaagacatttgtctcagatgtattaaaataataagggaaacatctataataataataaaataggttctataaagacaaatgattaaattattttagaaagtctcgcggagttgtctgttcgaagtcaatcctcatattaacttaagagatacaaagattatttcagttttctatcacttttatattaatatgggaatcaaaggaaaaatgttttgttttttaggggattttctttgttttaacgtttcatcttatagtttcagtaaaagcaacatgcataattactaatgcttttggggtctcttcctatgagttcaatttaaaactaaaagaatccatcattagaaagttagggcttacaaaatatagagaggtgtgtgtgtctgtgtgtgtgtgtatgtgtgtggggggtatgtatgtgtgggggggtatgtctctgtgtgtatgtgtgtgtgtggggtgtgtgtgtatctgtgtgtgtggtatgtgtgtatgtgtgtttggggtgtgtgtgtatgtgtgtattgggggtatgtctgtgtgtgtgtatgtgtgtgtggggggttatgtctgtgtgtgtatgtgtgtgtgtgggtgtatgtgtgtgtgtatgtgtgtgtgggggggttatgtctgtgcgtgtatgtgtgtgtgggtgtatgtgtgtgtggtgtatgtctgcgtgtgtatgtatgtgtgtgtgggaggttatgtctgtgtgtgtatgtgtgtgtgtgtgtatgtgtggggggcgtatgtctgtatgtgtgtgtatgtgtgtgtggggttatgtctgtgtgtgtgtgggtgtatgtgtgtgggggtatgtctgtgtgtgtgtgtatatgtgtgtgtggggggttatgtctgtgtgaatgtgtgggtatgtcttaattttcccccagttatcttatttactttggcttcacttttgctgagaaaatgaaaaacactgtacacagatgttcaatgcactttttaaagcatcatggaagagacctccaattaaatcccagccatttgatatccagtctttagattgccagtactctatttcattatatttctacatgagaaggggccaagtcagctcccctcatctgtttaacatagggcaatgaccagcgtgggagccactcaggacagcctgttgcacccttaccatgctggctgtggcctgactgcacttcctatcttggatataccgccactgatttgaattcagaattagcttcagtatttcagaaagattatatttctacagctcatttcttcttgatatggccattttcttttttttttttcattttctttttttttttttgagatggtgtcttgccctgtcacccaggctggagtacaatggcatgatctcagctcactgcaacctccgccacccgggttcaaacgattctcttgcctcagcctcccgagtagctgcaattactcggcgcccgccaacacacctggctgatttttttttttttcatctttaataaatatgatgttggtcaggctggtctcgaactcctgacctcatgatccgcatggctcagcctcccaaagtgctgggattacaaacgtgagccactgagtccggccacaatggcaattttcaagcctcaaagaataaagaagttagagataacatgtttaattctttgaatgttaattagcattatgttaaatattaattgatggacagaacattttccatgatgaattaagctccttagaatatggtaatgctaaggataaggcaacttgttaatgattagtcaagaaatttcctgaatccctgcattacaatcgcttgaaaaacttaagttgtattctaaaagtcaaaggaaaacagctcagacatctgtcagctttgatctgttcatcaaagctgacagaaatttaagcagagattttacttaaataagctcagccttcatgctagtgtcttaattcaaaatcatgttatcactctaaaacacttctctaaaacacttctatttaggtttttatgattttaaatagaaacattttattttcacttttagatggaggatatttctataagctcaacttcaaaactgaaggtttccaatagaatgctggcatcactcactctaccaacgcagatatatccctcagatatttctctccaccttaaccatgtgaagtcaaccaggttatgtcagacctatctttccttttcctcaaaagcttcaagttcaagtttttaaaaaacttagcacaaataaagattgaaaatatattttatttgcgctcagtcacatacaattcaaacatatcattttgcaaatgatctttttccataaaacaattagttttaaattttagacaagaagtataaataaaaagtggaaacgtcatcactgggccaaaattttgattcccaaattattagcgatggtaaagtaattcttttcaagaacatcttctgatcgctctgtcaccaggctggagtgcagtggtgtgatgtcagctcactgcaacctctgccccccaggttcaagtgattctcctgcctcaacctcccgagcagcagggactacaggtgcacaccaccacacacagctaatttttgtatttttagtagagatgggatttcaccatgttggctaggatggtctggatctgttgacctcgtgatccacctacctcggcctcccaaggtgctgggattacagggctgagccaccacgcccggccatatgttttgtgattgttaatactgaatgtcatcttgattggattgaaggatagaaagtattgatcctgggtatgtctgtgagggtgttgcccaaggagattaatatttgagtcagtgggctggggaaggcagacccacccttaatttgggtgggcaccatctaataaactgcagcatggctagaatataagcaggcagaaaaatgtgaaatgagagactggcctagtctcccagcctacatctttctcctgtgctggatgcttcttgcccctgaacgtcaaactccaagttcttcagttttgggactcggaatggctcttcttgttcctcagcctgcagacagcatattgtgggaatttgtgatcatgtgagttaatgcttaataaactcccctttatatatgtaactattccattagttctgtccctctagagaactctaatacatgtttcaaagtataactacaaagaaacactttgtgcaagcatagaataaaagagcattgccttatgatagtagaggacatttttgaaaagtcaaagatgaaattcaggaaaactgactcagaacttttgtcttttactaccttgataaatagtgcttgtgcctgtccgttcttcctcagatcaaaatgctaagcaccagaactacaatgatacgtttcatacatgaacaacatttgtgttagaaaaatatggatagaatttttatttatttgtttgtttgtttatttatttatttatttatttatttatatttatttatttttgagacagagtcttgctctgtggcccaggctggagtacagtggcgtgatctcggctcactgcaagttccatctcccgggttcatgccattctcctgcctcagcctcccgagtagctgggactacaggcacctgccaccatgcccggctaatttttttgtaattttttagtggaaacggggtttcaccatgttagccaggatgttattgatctcctgaccttgtgatccgcctgcctcggcctcccaaagtgctggaattacaggtgtgagccactgcactcggctatttaattcttaataattgttatgtctgcattactgtgctaatctaagaaacaggcctggtgcttctcaccttagaagttattttattttaatgcaacaacaaaagaaaaataaataaatgtttgttatttggtaattaacatattaaacagattatttcctaaatgaataaagacatacaaaagcattcattgctaatggtaacaagaagcttgcttatccatttggctaattagaatatatacatctcgtacataaaagcaaccacatagaaccaaattgagtaaacaaaactagcaaacagaagtcattgtgacccatgaaaggggctcaactttgcttcaatttcagttacaattctacaaaaaacttcaataagcaaaatttgtaggtaatagacgaataaccaggaaaaacattaccccacgcatctaaaacaaactgccccaaaatgcaccaactgcatcccatgatgcaggaactatcaaaagatttacagtggagcaaaaggccccgaggttaactgttgatctgaataaatcacaggcgctggttcatgcacaaatgtgctgctctccatgagggatccaagatgcactacaggagagaccatctctgctttccagatttataacataaagctttatttgcatgtaaatggaatcctccatttggggaaatcagtgtttcatgcgctgtgctctttgatgactagtaaaataaattgtgcctcactccacagatcttcagacatggaaactgaaacagtctctaattaaaaatttggttttatatatatgacctatatatatataggaatatacatatatatgacctatatatatataggaatatacatatataggaatatgtatatatgtatatatcctatatataggaatatatgtgaatatatatacatatatacgtgtgtatatatgtataattcctatacatatgtgtataaattaatatataggtgtgtgtataaatatatagacaggaatatatatataaagtgtatatacactttatatataattatacatatatatacacacctatatatgtatatacactatatatatataaagtgtatacatatatactttttctttagccacagaaaaggtatttttcctatggctaatactttacccatgctttttctatggctaaagttttatcactccccacaaattcaactgtaattgaatttaatataaattaaatgccttttgtattattagttaacaaaagtacagaattcatgacctttcctcaattttgctacctacttttatctccctcacactagactctatataattgctaaagatatctgaagtgggggaaaaatacaccaggggatgcaaaaatcattttctgggatacaagaaagaaaattagaatttttacccaaaattacatcttttgttttcttgagataaggtattgccctgttgcccaggctggagtgcagtgatccagtcacggctcactgcagcctcaaccttcagagctcaagtgatactcccactacagcctcccgagtagctgggaccccaggtgtgcaccaccccacacagctaattttaattttttttgtagaggtggggtcttgctatgttgtccagactagtcttgaattctggtcctcaagcgatcctcctgccttagtctctcaaagtgctgagattacaggcatgagcagctttgtctggtctaaaattccatctttgtaaatgtctgtgttcatgtagtaattgtgtggtctataacagctgctgagatggtcagtacctgtaatgcgtggcagagatcgaggttgcatgctcaatagttatattgattggatgtcagatcaaaagggtttgaggtcattgccctttgttacatcaaaatggttttggaaaccagttacatacagaattaagatttactagttttggggagccttatgcctgtggaatttatcctcctaacacttgtgacctagagactgtcatcgctctcagccctgcgagtcttgtctggagtgacacagacgggaggaggtgaggcgagatctggtcactctgcagggcgcacctttcagtgctgccgttggctcacaagcccggccctgcccgcactggccatgcctcgtccagaagggaggatcctcaagaccttggacagcagctcacaggcagctcctggccaacctcaagagcacagggcaagcacccagaaccactggcatgcactgcccaggccgctcaggatatgaggggcacccaggctggtggcaagacaagagggggtggaggtgtggcccaccctgggccaggacagggaagggtgggtgctgggcagagacttccagctgcctcgtgcccacctcaccaagtgacacccacttcttcgtttgtctccgtcctgttttgggggctgtgcaggcaccagggagaccttggtcttgacctgtaatgctagatcaaaggctctctttacctcaaagccactctggctcactgcctccctcacccatgagcacgctgagttctatttgaagctcccatatgcttcttattttagtttttaataaacttaaaaaagaaacactctataacttcccattcacaaaagtctcccaaagcaagtaacacaatgactacactatcagaatttttaattaaacatgactagaaaggactgatgcataacctggcctatgatcacgattttaaaacacaaaaaataacgttcttcctctgtcgatctgttgcccaggctatagtgcagtggagcaatctcggctcactgaaaccttcacctaccaggctccagcgatcctcctacctcatcctcccaagcagctgggactacaggcatgagccaccacatccagctaagttttgtattgtgtttttggtagagatggggttttgtcatgttgctcaggctggtctcaaactcctgagctcaagggatccactagccttggcctcccatagtgttgggattacaggtgtgagccactacacctggcctaagttcttactctgtgccagtctctactgctgggtccagacagctacacttctttaacttaaaaggtttcaggatcataagagaatggacttagaaacatagaaatagcagaacacgccagggaagtaggttttgttttattttgttttgcttgtttgattttagtttcttatatactttttttttttttttgagagagagtttcactcttgttgcccaagctggagtgtaatggcacaatctcagcttccacaacctctgcctcccgggttcaagcgattctcctgcctcagcctcccaagtagctgggattacaggtgtgcaccaccacgcccagctaattttttgtatttttagtagaaagggggtttctccatgttagccatggtctcgaactcctgacctcaggtgatccacccacgtcagcctcccaaattgctgggattacaggtgtgagccacgcgcccagtctcttatacagtaatatttaaaatgtttatttggcctgaagctgccagtagcattgttaggctgtcttaagaaaaacacatttgtttcataatttatcaaacgaaactggtctttgagctcatcttaaaataaccctagaaatgaatgtctctgcaacaagccatgaagttctacctcattcttcttcttttttaaatatataccatgaaaatgtaaaaggtacaagtcaagggtccacagcctgaggagtgtttgcctatagagacccccatgaaaccaccacctaggtgaagatatgcaccctggccagcagccaggaagtctaccctcccactcttcccagttcacacccacagggcagctgctgtctgacttcatcactgtaggttagttttgtctgtccttgaaagctgattcaacgattttactaatttcattcctaaggaattacaaactattgctgttttggggggaaatgacatatccatttaaatatatacatattagttttttctctctatatatatacagataaataggtgtaaatatatatgtgtgtgtgtatgtatatatataaaaatatatgtacattaaaatatatatgtatatatgtaaaaatatatgtgtgtgtatgtatatatatgtgtgtgtgtatgtatatatatgtatgagactccatctcatatatatatatgtgtgtctgtgtatgtgtgtgtgtgtatatacatacacatatatatatatatatatgagatggagtcttgctctgtcacccaggctggagtgcagtggcacaatctcagctcactgcccaggttcaagcgattctcctgcctcaccctactgagtagctgggatcacaggcacgcaccaccacacccagttaatttttgtatttttagcggagacagggtttcaccatcttggccaggctggtctcgaactcctaacctcgcgatccactcgcctcagcctcttgaagtgctgggattacaggcatgagctaccacgcccggctagaagtaagtattttatatatggagagagagagagagagaagtaactagagaaggctaattagcacctcttataaagaacagatctagaacacacaaaaacagaagtgaaaaatgtaaaactgtacgagcgaaggaaaaatattgctcctcccagaaacctatgagaatggctaacacactagctgcattaaatgatcaatgaatgactgatattcgttccacactagctctctaagcaatcctcaccaccgatgagaggaatacgtgttgaaatgtgaaaccatttcttcaatgagatgctgcattttaaaggaaagttgtatttctagaaaatacccaagcgtgcactcaccattgcaggagggcagcacttggtcccaggagggtttcccatcagccccaatcacacaggtgatggatgaggggtcaagaatcttatagccagagtcacactggtaggtgatggtggagccaagcttgaagtctgttccaactcttgtcccattcattatatttcctgggtcaaaacaagcttcccgtggtttctctgtggaagaaatgaatgtaaactgcatgagagcagggatcttattcttgtttgtgtttttgtttgttgggttggttctttaattgtgttatttagggcctagaacaatgtcctaaataagtaagaaatgctcaaagaatatttattgattggctattgaccaagtgaaactattaattaaaataagaaaattcctttttaataaaattatatttccattttaaaaaccacattttgctacagaattgatataaaattaccttcatctacataaaaaatacagtactacgtttttatatatttatccatttttggctacagattttaggactgaatcaaagaaaaattgactctggaaaaattgaggttcattttctaacttttgtacatcaaacatattaacataaaatcattccacacctttcagaaaagactggagaatttggcttctcaaaatgaaacagtttaattcctgaaagttaagagcactttcttatacgaataacaacagacagacttagaagatgaagatggatgcttgttctcattcttttactaccgtatttctgttgttagtcttaatagagtaaacgtcaaacttagaagaaaaaaatacattgactgatagatgatggtcaaacattgtgcactggatgtactaacagccaatagttctaccttagttaaaataattgctgaaatttattgagggctcattatgtaccagacatggaactaggtgcatttcttgtttaattctaatctccaggacacctctgccaggaaaggatcataagaatgtaaaactcaaggaaagttaagtcacttccacaaagaccccctgcagagacctgcccacttctggggcccctcaattaggcattcacttttggctgcattaagtatttcttcttcccaagtaaaaatacaaaaccttttttcttcagtcatgttgttctgcagtcaatttcagttatcttctggtagccttaatatttttaattttctgtttcaatagaccatctaaaatatctctaaatgaaaaagtgtataaccctgcagtctaccaccctgctagaaatagataaatataatgggagaggaaaaagcaaaaacaaaaatgctaaactttgggaagctctggaggaagaaaaagagacctgattaactgtatttattcaatattttcaattatatttttaataatccatgtgtaatcatcaaccaaacagagatgtctttggtgatcattgacttaatcatcgtatacattatataaagaatctattataataatgtattatatttaataaactatatttcctatataatttacatactttgattaaatctatattaatatatattatatatataagttttctcatttaagaatttgagattaaatgatacatatatattttatatacatttcttgttttgtgccttcaaaccagtgctctctaattgctttgttgaaaagctgtttggatgtttaaaatggtagctgacatgttgataattctttgtaactgcattaaatcccatatagaatatagaacattattttaagcaaatacagatcaaataagtaaacctgtaagtactatgaaagttgctcagtttttctgatattttatttaatcattcaacacaatgtactgaggatctagtgaatagaagcatggacttgttcacaatattttcccctattgaaaataaaaaatttcccagtacacatctattaatgtatgtctgttgctcttgtgtcctttttgatcatttttttgttataaatctcttttagtctagtttcctgtttgattaaatatcacctacacaactttcttctttatgccactaattttgatttctgatggcaggattttttcccaatggactgcatctaatcttttagttccattactgacttgtcacttcaggatgttccgtgataaatcactggcacattttttgcttacaatttgccaggcttctaactagatgacttcataacagggtgtattttgtgttgtccgtgtccgttccacttatgcatacctttgagctttcctgcatcagaggccaggtggattgcctcagccaggatttgtgaattgttgcacagcacgactgcctggtgttccttctatttcccatcatgcctaagaactggatctgtcacctgctttgctatccacaccagcacttgctctgggctgcatgcaatacaatgacatcactgcaccaggcttagatgcaatcactgccctaggctggatgcaatggcatcactgcttgaggctggatgcaatggcatcatttctccaggctagatgcaatgacatcactgccctaggctgcatgcaatgacatcactgctccaggctggatacaatagcatcactgccctaggctggatgcaatggcatcactgctccaggctggaagaaatggcatcatttttccaggctacatgcaatgacatcactgtcgtgggctgcatgcaatggcatcactgctccaggctgcatgcaatggcatcattcctattctctttcctgtgatttttatttttcacagactccactggagagcttttaaaacctcaggaactacagcctccagttagatggccataccggttacccaaacaaaaattaaggaagttctttcttcatgcaacctgtaaggcccttcatacttcattcattcgttggcccatttattcatgtgccttaggatgccggggagaacaggagttgtcagagtgggcaatgatcagtgtacattctcacaattatatgaggaattgttttgtttacttgcctgcatgattttgttgggggcgtggggggctatcatagaataagtactgtcatggtaaaatgcattttagtgaattcttgttaagaaactaaattatgatgtggcaaaggctcaaaagtactgttttcaactattcctaaacgtgacggatcccatctcaaaggcataggatactctgattgctaaattgtataatttttaaaattgtacattttagtaaatacccctaagtgtgcagattctgatgtttgggagcaaagaaaccaattttctacttaaaactatataaacagttctggtaatgaggtaagagacataaaatatgttctttttaaaaagatttttcacacaaattgaactcaaaagtgtaaataaatataaatattttcattttttaaagaaaaccctcctaactgtgaattgatattttgttaagtcctcttccctaattctttgtaatacaccttgtattttattttgttcacatgagaaataaatttgaaaaaacatatatttattctgatggacccaatagcaaaatgttgagttgaaggtggtttttcaggtcagtctgttttccttggatgttagtggcagggaatggtttatagcaaatcaagggtaaatcactgatctgatgataaaagaaaagagctctgagcagcgtcagaaaccttgctaaaccagccatagctgactgaggcagggaagggtacagatatgttgacatggaaaatgttgagataaaatgaagttattggccgggcgcggtggctcacgcctgtaatcgcagcactttgggaggccgaggtgggaggatcatgaggtcaggagatcgagatcatcctggctaacactgtgaaaccccgtctctactaaaaatacaaaaaatcagccgggcgtggtggcagctgcctgtagtcccagctactcgggaggctgaggaaggagaatcgcttgaaccctggaggcagaggttgcagtgagctgagatcacactgcagcactccagcctgcatgatagagcaagactccatctcaaaaataaaaaaaaaaagaaattatttttggctgggcacggtgactcacgtctataatcacagcactttgggaggccgaggcaggtggatcacctgaggtcaggagatcgagaccagcctgaccaatatgatgaaacccagtctctactaaaaatacaaaaattagccgtgtatggtggcatgctcctgtaattccagctactcggggggctgagacaggagaatcatttgaacccgggaggcggaggttgcagcgagctgacatcgtgccattgccctccagcctgggcaacaagagcaaaactctgtctcaagaaaaaagaaaaaaaaaagttattttcatgtacttacatttaatcatcttgaagaaacaaattataaggtgttaaaacccgtcttaaaataattattaaatgtcatcaaattctttattttacaaaccacaatttatttttatatggccatgaactgggacagtttttttcccctctctttcttcctccagttaaagtagaaatgcacctcaggaatatcttcactggagagggaggagacatgtatcttcccagacagaggagacacatatcagcatttatgtattaaacagacaagcaagatgttacaaagcaatgcctacaataaaaacagtcctgatacaaattaattcccactcaaattcaggcaatcgcaatacctttaaattcaatggcgaaccctgaaaggcccacggaggcatcactccgaaatgccagaaacaggctgtttccgctactctctattctttctggggcctgagagccctggtaactcccaatgagggggctgttggaatcttccccttcatagatgtgtaggaagtcatagctgggctccatgttgaaactaaagaaaagaatagtaattatgtcatacggctaacagatattttatctcccagagtggtaagcctttgagctcagaaagtgattttatttgcttttgtataatgatttttcagttagggcaatcaaaaagttaaatgtagtatgaatcaaaatattaataaaatagcaatagtataaaatacatcaattgtgacaaatactatttgcctaattaccatcatgttcaatacaatattattctgaccacagccaaaaggaaataagtcataatagcagaggtatgctatcctttccgtgtactcattaatttgctaaatgagatgtaatttaaaagaaccaagctcaaaagagacacatttccactgaccttttatctttatctgaatatttttagttttgaaaatactggaattttgaaaatattgcaatttcaaaatattggaatagtcagtagaattactgactattcttacttttatttttacttaaaaaatgcagttctcccagcctaggtaacataatgagatcctgtctgtacaaaaatacaaaagttagtagagtgtggtggtgcacacttgtagtcctagctactcaggaagctaaggctggatgatcacttgaggccaggagtctgaggctgcaatgagctatgaccacaccactgcacccatgcactccaccctgagagacagaacaagaccctgtcaaaaaaaaaaaaagactccacttgcgtggataaatcagcgaatattaatagcccctacaatgcccagagtgtaacctttctcacatcatgtttcaccatcactgaatatcccagttttttttctctgtccctctctttctttctctcactttctccatttttctgtttctctctgctctaatattaacatacagtcagtccccaaagagtgtaacaatttaaattcaaaggtgtcaagggctgggctgtgtttgccattggtgatgtgtaggctgatagagtctctgagctttaaaactacgcacactctaagagaaaggctgagcttggttaagatgtctaagatcttgatatgaccagaataaactgataaagtagaagtattaaaaccatccattgcagcagagcacagtggctctagcctgtaatcccagcactttgggaggctgaggcaggcagatcacgaggtcaggagttcgagaacagcctggccaatatggtgaaaccctctctctactaaaaatacaaaaattagcagagcatggtgtcgtgcacctgtagtcccagctgctcgggaggctgaggcagaagaatcgcttgaacccgggaagcggaggttgcagtgagtcaagatcacgccactgcactccagcctgggtgacagacagagcaaaactcatctcaaaaaccaatcaaccaaccaaccaagcaaccaaccaatccatccattgcagctgccccttccctcttcttctctatagcaggtttttcatatgtgtctttaaaaagcactcaatttacaaagctcctactccctttcctttccaactgcagaaatttgggacaactgagacagagaaggtcagggtttttgcttgttggtttgtttgtttgttttgtaatcactaaaatgttctaggtggctccacttgatctggagattcggatgataaaatagcaacagaagttccctcctggaaaggtccactgcaccatgaaggggaacagagaacgtggtaccgccagcatcggtgcaacgcccagcctgcattatgccaacctgttttgggtcaaggataccctcactccacatcctgaatatacttattaaaggaaatttaggaaggtgtcttagtctgtttatttgacaagttcactgacgtcaggaatgaagaaggaataaaaggttggagttactaggtataggcgctagcaggaatggtgtgggttacgtagaattttattggaataataattgtatttagagtattggcaaggatgttattaaaatctggtcatgtcatatccccaatatttggcttagttaattatcattattggtaatttatgcaatactgcaaatactgccagacacaggaaaacaaacaaacaaacaaacaaacaaacaaacactatatatcccatctgctctcttttttttttgcctgtaccaaaattcatgcgtagaagtctggagtgaaatttataactaattttggctcctttggagaactccttatttctacctctgccagctgcacgtatctctaagctcttacagcatgccaaagcctgactcaaattgaaccaaattcaatttgagccccaatgtgtgagccccacaatccacagggacgtgtaatggaacatcctctctcatccacagccctgaacgagcctgggagcccatatgtccttcaggtcatatgattctttgcctttaccattagtaatgccagactcccaccctcccataaaaaaaacacacctgaatttgccatcatcctgacactgcatcttggccagccctcatcagcgccagcctcctgcttgggaagctggacatcctcatcccctaacaggattctggtctctccctcctcactacttcccaggtagatgtctgcttgagcacatgcaaactccagatcagagaagtcactggttttcactgatttctgaagtttctgagacattgggtcggctaataagtcataatctatgggttgggagaggcttagagattatctgtttcaaacttccagaggggtgtataaaacgcagtgaaaaaacccttgcacaaaactgccttaaatatgcatatcatcaaatgagttgcactttatgggagggaggaaactcctactaacaaggttttgtgttcaatttcatttttttttttaaagccaaggtcttgctctgttgctcagctcagactagacactcatagctcattgcagcctccacctcctgggctccaacagtcctcctgcctcagcctctcgagtagctagaaccagaggaatacacaagcacaccaagccaatttttaaaattttttgtagtgatggagtcttgctgtgttgcccaggctggtttcaaacttctgaactcaagtgctccccatcttggcctcctgaaatgctgggattacagtcatgaaccaccatgcctggcttcaactgttaacccatttataatatcttgaaaccagaggtgcctcctaattttaaggaagacgctactagaatttaacattaacaaaacccacatagatatctaaaaaatatagccagtgagtgttcactggttttctgtaatagctgagtaacatttggtaaatttgtggcagtttagtaaattcaggaaaagatgactatcaaccaacttaagattcagaatcatagaaacgtaaaattctactgactcagatctcatcaggaggagaaagtgagggtatgtaaacacattcaggccttgaatactgacataaagatctgcagaaaaggaaagtcgttccattgacagattaaaaaatgtaatcccagatacttgtccttggatagctgaaaggtcaataggaaagtctacagaatgactcaccttcataaacaacacattcatttagttcaaaagtcaaagtctaaagttagaaaacatctttggattcaataaattgtaattatcatataccatatactaataatataattatttaaagagtttattttcataaaatgactacagtattagaccttccatcgtctagtttagcaagtacaagttagcatatttttaggactgatatgtagtaactcagactttacagcaaccacatttggggaaactttcattttccaggctctattaagtcttaattttataatgatattagcagtgctaccctcaggaacgtcaggatgtgctgtggaaaggaattcactatcaggcatttagagtgataggagacattgatgagaaattacaccaaatgtctccataccatatttttattatttttaacgaacattctgtttaagccttctcatatgggacacattgtgtgcaagacaaacagtatttaaaaataattcaagtgcatcttaagtagaatgccccaaagcaaaatactgtatttccatttatgtcattttgcagcctggtgtagtctccattagacacaaaatctagcacttacctagatataacattagagactatgaggtcataaaagaagtaatttttaggtatggaattaaaaatcctactaaaaagaggtattctgcaagagacggtaccttttgaatatcaaggcgatgacaaagtccgggttcacttttactctccagtcacattccttcccaggaggatacggctgtgggtagttgggtgacaaaataacacctgctgggcccgtcagattccctccacaagcagctgtcacagaacaaaagttacagagaaaaagtaaggacagcgaagaacgcctgccagtcagtgtggaaggagacaccacagaattctttaagaaaaagacatcagcatttttaccagtccaagagattgtgtgttggttatcaattatcctgataaaattgtaagacccaggaactctgtacatttttcatgtaactgttaatgaattttacataatattccaccccattttcaaagagaattttcaaacttctgacacaaaaaatttctttcctataatttaaaattttctcaattaaatgaaagatgacttaatccccatacctgccaacgtgcacacatgtgcacaaacagaaaaacacttgaataaaaaaaatcccatggacatgattttatggccatgttaattattttgctatttctcacagtttataaaatcattgcctatttcttcttgagtgcatgcttcatgtggtacagggatcatctagctcctgttcattgttttatcccaaacgtctaggcggtttctggatctgaacaagtgttcaggaaatggttattgggtacatgaaaacatggcatttcacattctcccagtcccctggtgtatggaaggcttgaattactttccccatatttcaaagtggcaaaacaaaccccaaaagtttaagtgagctctaagtatacatatcagtgaggagctgagctggagcattactctctgaaaatatcatttgatcacaatgcttggtatattattagaaagaaccactttatatgataataacaaatttagtttgtgtttgaagtcatcaattttgaattaaatgtgtttacatttatattagcaaggcagtaattatgtagctcaatgtggttaataggcaagccagtttttgttcttgaattggaaagtatttaggattgttttatttgtgagataaggtttctcctaaacctctcatctcacggaaggtgtgaaaacactgccgaatttataagtatacacattttagatacatacaagactatgctgagtttaaaagttgtttatatcaaatactgtggtttgtcaccaagttgttttaaagcgtgactacaattaaatcatagtattccacttaaattatatgtcttatttcattcccattattggtcacacatgcactaaaaaatatgtagaaaagaaaatgtcttaattgctgatttttcccctatacaaaaagagactttgttttgtaaataagatgaaggaagatgaaggaacatgcttcacaattttcaataaggagtgcctctttaaatacttatttaacatttctgaaaacttagctttttataggaagaaataacaactaactccagtagttcttgttatactctcacagtctaactgaatgcaaactctgaatgctattgtagaaaacatttataataataaattccacagatatacgttcaagagtaatatgatataatttttacagaaaaagattaaaacttgattttccccagtatgactttttttttttttaatgaatttgaattgtgcagaagcaattgtcccaacagctctcacagggcagtgcctcctcagaatcacgccggggctgctgacagcatcgagcagtacaagcgtggaccgatcagggagcgggagctgatgcagagaaagaaggtacctgaaggtctagaagattctactgcacacaggttttgtaagatgaaaaatgacagattcagggcactggctacagggtgctaccagcaggaagagttcagggatatgattcaaatattgatttaaaagaaacaaaggggaaaccctgtcttattcacactgatcccaggaggcactttcaaatgaggtgatttaaaagctgaaaaagtggaattaaggagtgctgcctggccctgtttgttctctcttttggtctggtattcttcaagttagtttgcttaggttttaattagcttgcaaaatattttagataggattagaatagtaaaaaatgcaactcagagatgctagcaaattctccagaaggaatagacaaagagataaaatccacctattcttttcgacccaccaacccttttacaaaacctttatccactatgctcaacagcacacatacatacgtagcagctccttcaccaccagggtttgaagctggtctttaacgagacccatctacgtttctgcattaaaacatttgaatgttcacaccgttgggggcgataaatattttctaaatagacacctttatgtcaggatgctctgttgtccctaaatgaatttctgcaaacctaggatacattttggcttttcagagtgttttgcaatttggacttggggaaaagcaattgcaggctatataagataatgaagactttttagggacactttactcggaataaggaagttgaagccgaacgtggtggctcacgcttgtaatcccagcactttgggaggccaaggtgggcggatcatctgagggcaggagttcgagaccagtctggctaacatagcaaaacctagtctctactaaaaatacaaaaaatagccgggcgtggtggcacgcacctataatcctagctactcaggaggctgaggcaggagaatcgcttgaacctgggagcggaggctgcagtgagctgagatcacaccactgcactccagcttatgtgacagagcaagactctgtctcaaaaaaaaaaaaaaaaaaaagtcgttaatgtcctttggtctacagaattctccttctagactaagtcaaaaagctaaacagaggaggcttcatggtagaagtcatttcggatgtaacaataacaacaacaaaaaagtgaggtatccaagcaacactcaagaaaaagcaacagcaatggcaggtgttgaaaataagtgttgtcacacacaacaggtgagaggttaagagattttataaaagggaaagaaagagagagagccagtaatgagtaaatatactctaataataaaaagtaaaaaagtaaattagctgatcaatcaggaaagaacaaattcaaacagccaataagcatatgaaaaaaaaaagttcgaccttattattaatttaaaatgccaattaaaacaagacatcatcactttgtgccttaaaatctataaagtgtggtgttttctgtgagtcagagaaaacattaataaatatatatggctgatggcaggttaaatcggtgtgactgctctgaaagagattttaaaaatgggctggacacgatggctcacacctgcaatcccagcactttgggagtctgaggcaggcagatcatgaagtcaggaattcgagaccagcctggccaacatagtgaaaacccatctctactaaaaatacaaaaaaattagccgggcttggtggtgggcgcctgtaatcccagctacttgggaggctgaggcaggagaatcactggaacacggaaggaggttgcagtgagtcgaaatcatgcccctgcactccagcctcggcaactgagtgagactctacctcaaaaacaaaacaaaacaaacacgttttaaaagtccgagaaatatgcgagtttgtagaaatatgtcacttattaataatcctgatttattttgcaacatgagtgctcattgaagctatcttcagaatagggaaaaggttaaaacaacttaattatacaataataagggactagaaagatcaatattggtagattcaaacaaatagatactagagagtggcatcagtggtgtagttgtgccttctaaaaagatttagtcactaaaaacgagtagaaaatacatagtaacacaaaatatacacaccatgtactggtaagtaaaaagtgcaatttacgaaacagtcaagcaggatgttgtcattttaaaacttttttcttttttttttttttgagacagagtctcactctgttgcacaggctggagtgcagtggtgcgatcttggctcactgcaacttctagctcctgggttcaagtgattctcgtgcctcagcctcccaagtagctgggatcacaggcatgcaccaccacccctggccaatgtttgtatttttagtagagatagggtttcaccatgttgcccaggctggtctcaaactcctgatgtcaagtgatctgcccgccttggcctcctaaagtgctgggattacaggtgtgagccaccacacccagactaaaacattttaaaatggattacatatacataattatgaaatcatttataaatgtctatattaattgtaattgtctccaggtaaaaagatgacaacttttttctcctctttgatttaattatagtttataaaatgtcttcagtaaaatgtattaccctttaatatgaaaaaaggtaaaaaaattaaaaagtgttttgaatctttgaaacagaatttacatgagtgctaattataattaactcatgccctaatgggcaagcttcttacagaggacataaacctcattcctaaaaaacagaaaattacaaagtaataaaaatataatgttaacttatttccaattatatattttccatttttctgttacataacacctacgcatgtaggcgggtctggttgccaaaataattgattattcatctgcctgcaagtgatttcagcttgtccttgaagctgacattcaaggtagagacaggggtatttatttaccttttggtgcgtattggactacctagtggctggtcaaaataaagtaactaagagatgatctaacagaagatcgatttgtttatagattcattaggagatggccaacttttataattacatgttcaaattaatataaattaataaattacttttaagggattaactcgtagttatattgctttttaatgtattcctccacgagcctaaaaacatgcaaaatggaaggaaaaaaaaaaaccctttcctactgtaaaagtaggccattggtttaaaatgatcgccacattgataggcaatcactccactttaaaaaagaaacacgccgaaatctctgcagtctcccggtgactcagcttgagtaaaacgcgtgactgtgctcacagacgctatgaaaagtaaacgcagcaccagacattaaacacacatacattgctccccgacaaggctgagaaggctgataaggacagctatccaacctcatctgtcttcagacaactgggataagtggtttgtcataagtaggagcgccgtatcacagctccccaagaccactgagaatttcaccaccgctgtgtacacgacaataaaaaccagttcaaaccacaaaccccctcaaggtcatcctatgcaaaatggcctatccatttcatgatcactttctctcttcacacatcaattaaattttacatttttcagacagattataaagaagtactaattaaactgtgacagttacttaaaataataaagttcagtagtttctttttaagacttagatgatatactctaagtacgaattttattagtagaatattttattgaatgaagagacaatctacctgcaattactattttacataaaatatatattagcctacaaacatatttgtgataaattgtctcaggtggctattcaagccaaagtctgcaaaatcatttgttatccttttaataaggtcaaactataaaatgtcaataaatttcagaaacaaacctccttttatcttcattttaacacaaacagtataatttctagttttcagaattctattttaaatgtactaatatcatagggggaaaaacatctaaaaagagaaagtacttttagtgagtaggttttgcttaagggcatgtttctatattaaaaatcagaatagcaatggtaggtttataaattttgaggcaactagaattttaaattacagacatttgattgatccatgtttatgtaacatttgttaagggtaggaaatatacggtaaatgtcaattactgtaccttaaggggatgacttcctttattctacctcataaaataaagtttaaaggtttacaataaaatttcaggagtctcagagagccagagaacatgaaagaaactcttgagaaatatttctgaagaaataatacatttacggagcgcttttaacgacaacatgcatccattcctgaatataaaatttctaagttctgttgtctgatacctatgcatgtaggagggtctggttgccaaaagaaccggttattcagctgcacacaggtgattttggcttgtccttggagctgatagccagggtcacactggaatgtgacggtgtctccagcctctctgctgtctccatagcgggtgccattttggggcatacctggatcgttacaggtggctgcaattgaggctgcaaacaaaagagaaggcaaggtcacaggctggaaaacatggtttccacattcttgtcggtgtggttgttcttgtgggttgaagcactcttcattggcctaataagtcatttgtctacacatgaacatacgaaaatagtttcttttcccaggggtacattcaataacatacatcttcattgtgcttgcattgcataaactctagcaagattctgttgaaaatgcaaccaatgatgaaatatatcaagggtttttttaaaacaaaaattacattatccttagaataaatacatacatacacacagactgattttctcttcagcaatattttaatgaaaccccatactgcaaattacataaactagttaaagtacaccaacctcaaggaaaacaaaataggaagaatttccttaaggtctgtgccttcaaaggtgatccaataacctttgttgagatgccaagggtggaaggtctagaggagatgaccagtgagttatacccaggatcccataggtgacattgccacggcaaaattattaataaccccctttcactcacccaaaaaattccaagttggacaatatattatatggccaccctaatattaacaaaagctctgaaaataatatcctgcctttctgcatatatataaagaatctcaaatctgctgagtagaggccagactctgcaaagccggctggtgcctgtgctttcaggggccactggagccttatcatatcagtttctggtaatcatgtgtaaagtgcattgcaaacggcgagcctaaaatcacctcccatatgcagccatcgactctgcctgcgcctaatcacagaaggctaccgcaagcccagagttttcaccagagtatcccccatcactctaaaatacagcagcctcaagaaatagcagttgttttctccagtttctataactgctgtgtattatgtgtcgcactgaaaattagaaagataggtactcctgaaaaatccaaagcttagattttttctcatttttactttcagttagaataacgagctctttcttccactccactgcataagagatgacaattaaaagctgactttttctctgcaaagtacttcactgttttcaacaccaagttttatgaaagagcaaaaaaaaagagattagtgtattgttctatatacataccatcacactgtccattttaatatttgaagccttaaagtaatgagtaggctttgcgttttgttttgtaaattctgaagcatttgtgtgtgtgcgtgtgtgtgcatatacatatgtctacatatggatagataaatggaataataaaatccatttaaataaaaagttagaagatatataaaaaagaataagacctgctctgtgttattcagacatttttaacctaataggggtggcaatgaacaaataattcaggacaagagaaaatgttaaactgtgcagattaaaagaccaaagctctatccaatagtgtcatatgatacagacatcaaggatcctatagttggtcagacctgcttcaaatcccatcaggacttaattagtacctaattagtacttaatgatcacttaagcacacttatcatcagctaacaaatcagtaaaaattagactaatatctaagtcattaagtctgctatgaagatgaagtgtgaaaatttgctaacttgtctttctccttgctattctctaagctaattgaggcaagaagctgtcttcaccactctctttctctcaaattgattgttattacattgaaatatatacatgtgtgtatctataacacaatgagaacaatgaaatgaacatctgtgctaccaactctaagcaatagagtatttaccaatacatcagtatgatcaatgcgtagaacatacccttccccatatcaccttcttcctccacttcaggggaagtcactttctgaattttatgtttatcattcccttgcttttcttcacagtgactataaatgtatgcattccacttttagccacatatatcagtttcctgaaatcaaatgcttaactggaattatatgttgcaagttctgtgactctctctgtcttaaatgcttaactggaatacatattgcaagttctgtgactctctgtctctctcccccttgcttgtattatgtttttgggagtcatctacatttaggcatgatgctctggtctactcatttttattgctgtatagttttccattgcaggaatgcaccatgatttttccatcctcttcttgatggatctttgggtcatttttctttttacccttatataaaatgctgctgcgaaaactcttgtacatgctgctggtacacatttgctctttcaaatgacatgggctgctatgttttggattttcacttccaaacagcatgcagttagattgtcctttaaattcaatcccagaattgtcttttaattggatagtttagtctccttatgtgccctgaagttcctgctctatttggatttctctcgaccatcttagcttgtgttttctatgtgcacccccatatgctctacctttttgcttgctttcatactaattaattttttctcgtgcttttattttagtagactttctagaaatttcagtatgtatttagttgtaatagtcttaccttcttctttaatatttattattctcttcctaattacatgcattgctaggtatttcagttatttaaaaaaaaaatcttaaattagacattgtcattgtccatttgtttttataaacctcatacattaaatattattgtttgacatagttgactgatgattgtttaaattttcatacatacttatcaatttgtttgcttattatgttttcttttcattttttttttctgagtttttatttggcctaatttttctacttcataaatactatggcttgactatttgtctcctcaaaaacttacgttgaaatgtaatcaatatggtcatattgggaggtgaggcctttaagaggtgattgtattaatcatttgtaaattagtggattaacggatttatgggctatcacaggaggggaattggtgactttataggaagagtgacctgagctggcatgctcagcccctcgccaggcgatgcctgcacacgttaggactccagaatccccaccagcaagagggccagatgtggtccctcgaccttggacttctcagccagcatatttgtgagaagtatatttattttctttataaattacccagtttcagatattctgttataagcagtagaaaacagactaatacactaaaatggtttgttcgttttgttttgtttggttggtttttgcaagttatgtttagtaaggacatgtgatggcttggattagtttcacatttacttggccgttcatatagtatttggtttcctattcatatttttattctcttttttttcatgattacagtctgaatccgataagaattccaatttctcatgtaaactaagttgtttgtaagttttcacatttgtacttctgttctggggaacttgacttatggtaattctttgcattctgctttgaaggtacacccatccagaggagagtcacattagattacaggatctgcctggaacaacagaaaacctccttttttcaaaaataaattaacagcttgaggcattttggatcccagggatggtagaaattcacctacagactagtgtgaatcccgccggcggttgtgagttgcatgcatctatgtctctgtcaacatcgatgtctgtgtattctccccactctgtgagtagaacaccctttggtgttccagctatacatgagggtctcctatgatattttcaacctcagaaagaccttagatttgctttctattccctgagccaagggactctgagagtggaagctccacatcacagaggatcagcagaggcaatcagggcagggctggcttcctagcttcacaatctctctccatttctgcatttcatatcaaccgggattccttattttgttgcaggttcaatgacacaatttgaaaatccaaaaccaattttatccagcacttttactgtattttcagcatataaattttcagagtcctcactgtaatactgcaaacggaagccactcaatcacacttatttcttaaacactggccatgatttctgagacatcattcttctcgtcattatcagtattattatcattactcgtgttttgaacaggggaatctcacttgaaaacagcactctcagtggagatctagaagagagtgcttgggtttcggagtaggtttttcaatggaaagagagcgggaatgacaataggagttaccggaaggccattgctgtactttcccactttcctcccatcagctgcaaagactggaacacagggaaatccaagcatattactccaagagaagcctgggagagcagaggaaggcaggatagatgtgaagatgcaacacttacagttagaaagtcacgaaggtctcacccataagccacacatttttctaacgtagaacactaatcatagaatacaatcaccagaatcacaaggcaattggccatcatcttggtaccaaaggggtacccttcctgaaccagcattttacacaaattcttgaatttactctttgagtgatattcctatagaatctatgatcaactgttgttgagatttctctggttttcagaaaataatcaaaagcaaatcctactgtacatgcacaatcttgttcatctgaatgaacttcccatcttcaaaggaaaattcttcctttcctcaagcaagtggtgacatgtataattaagcactcatttgcaagtgataatttctgtcacagtttatataggttaaaaaattaacaataagtgtataatattaaaataattgtcatacagtgatagtcactgtaaatatcgcaacatttatacaatgaaatgaatgttatataatagtacaagaatttaaaaacaaaagtttaggaggtgagccaaggacatcagggataacagtttcattataatttttaaaaccaagatgttttcatttctcattcccatatttttatttaatgtttatcaaaagaaaagatatataatactcactactaggaaagttttacacaaaggtgcacagattttatacatgaataagaattttaacggatatatcagccttgcaaaaaataagtgctctgttgaacacttttctgggagttaataggatctggtcaaatgagattggcaaatactgcacaccccagtttccccttagacattcccattgcacattaaggattaaaggctcagagctgtaccacagtaaaaaacttctaaaaatcattgtttaatccagcgtatcccacattgtcatcatagagcacagttttcctagaaaatctcttaagatccttccaaatagaagtccacagaatatcagtagaaacagtgccttgcactagtggttacatgtcctttcatggtataatattctattcatttttgaaagtaccttttgtagttctcaacccaatttttatttggaatacgtataacaataataatgcagcatgcaattaaaagttttaaacttgtgaagttcatgttgtctaataaacagaaatactgcatctacataattagctcgagtttatgccagttatatgaagatgtaagtttttttttttttttttttgagacagagtcttgatctgtcgcccaggctggagtgcagtggcacaatctcggctcactgcaagctccgccttccgggttcacgccattctccttcctcagtctccggagtagctgggactacaggcgcctaccaccacaccaggctaatttttttgtatttttagtagagacagggtttcaccatgttagccaggagagtctcgatctcttaaccttgtgatctgcctgcctcggactccgaaagtgctgggaatacaggtgtgagccaccgcgcctcgccgaaaatgtgagtttcaataaaataattatatatacatttagagctaatgtatatatctgcttgtatattttcaaaggttatttaaaattgccataaactactaaggcttacttaagtttaaacaaacccccaaacactttgtatttagaattatgaaataaagatgaaaagttcctagagttagccagattggactaaaaaaccaataagaaggcttgaggaaggagaaagagaacaattttaaacaatgtagtgcagaatacatcggttgggtctttgaaacaaatttcattttattttcctctagttatgaatgatgcaaagatgttttctgttaaaggcaagaaagcttattctagactaatacaaacccccacccaggggcactccattaggggcagaaactgcttttccacttcaggctcttcacaaagtgattggcagagcacgctgtcattcctcttccagggctgtattcttttatgtgccacatcatacacttcactcatttttctcttaaatatgttttctgcaaattggattttttgctgactctgaaggtttctagtttcttgccataaaaaagaaaacattttcagttgcatccatcttatccctcaacgaccctagaaaaaggcagcgctgttcctgagattatgagtgccctgttttccagtttcccacaggcgttccctggaaaatctcaagtcacagaggcactttccacaggcccattggcctctgaggggacatctctgccacctgtcaggctgcatccagagccatgccagtcagcttgagcaacaaagaacctgcgctgcccttcacaaaacagcagtgggtctgactgtttccaacagcaggattgacaacgtgcggctactgcactgcagaactggacgctgcaataacgccaatctttttgcaactagataagagagatatatatatagtctcacaactttgcaggccgggtgcggtagctcacacctgcaatcctagcactttgggaggccgaggcgagtggatcaaaaggtcagcagttcgagaccagtctgaccaacatggtgaaaccctgtctgtactaaagatacaaaatattagctggtcatggtggtgtgtgtctgtaatctcagctactcgggaggctgaggcaggagactcaggaggtggaggttacagtgagctgagatggcaccattgtactccagcatgggcaacagggcgagactccatctcaaaacaaaaaaccaaaaaaccacaactttgcatataaataaaagtatataatatttttatattaaatattatatatttatatattatataaataacacaactttgcatataaatataatttttatacttatactataaatataattttatacttatactataaatatattttttatacttatactataattttttaaattatactataaatataatttttataattatacttatactacaaatataatttttataattatacttatactacaaatataatttttataattatacttatactacaaatataatttttataattatacttatactacaagtataatttttataattatacttatactacaagtataatttttataattatacttatactataaatataatttttataattatactataaatataatttttataattatacttatatatttttgtatatttattttatgatatgctatatattatatatttattttataatatataatacagatttaaataataaatttcactcgcgtccgtgtgaagagaccaccaaacaggctttgtgtgagcaataaagctgtttatttcacctgggtgcagacgggctgagtccgaaaagagagtcaccgaagggagatacgggtggggccgttttataagatttgggtacgtaaaggaaaattacagtcaaaggggggttgttctctggtgggcaggtgtgggggtgtcacaaggtgctcagcaggggagcttttgagccaggatgagccaggagaaggaatttcacaagataatgtcatcagttaaggcaggaacaggccattttcacttcttttgtggtggaatgtcatcagttaaggcaggaactggccatctggatgtgtacatgcaggtcacaggggatatgatggcttagtttgggttcagaggcctgaaagtcctgttttcttatattaataagaaaaataaaatgaaatagttgtaaagtgctgggacggcaaaaatttttgggggtggtatggagacataatgggcgatgtttctcagggctgcttggagcgagactacgggcagcatgggaacttagagtgggagagatgaagctgaaggaagattttgtggtaaggggtgatattgtggggttgttagaagaaacatttgtcatttagaattattgatgatggcctggatacagttttgtatgaattgaaaaactaaacggaataagaggagaaaaacaggtattaagggactaagaattgggaccacccaggacatctaattagagagtgcctgacgaggttcagcatagccttgccagcaaagattatttatttactttaagtgttaagagtggcaggttggggatggcaccaagagatatcagctgtaatggcttggagaaatagtgtaaaccagcagtgtaatcaagagcagggcatgtataagtagttgagaatggtgaataggagtatgactagacagaagatagtagggatgacaagttttttggggcacagtcaaagttggtgtggtgtctggaatgagactggggcctaagaaaaaggaacatctatacaggagtttaaatgggctataccctgtagcattctgaggacagacctgaattctgagaagggaaagtggtaaaagcactttctattcctttttaagtggtggctgagcttggtaaggttttaaaagaccattagtccgttttacctttcctaaatactgaggagcgtaagggatataaaggtttcactgaataccaagagcctgaaaaaatgcttggctgatttgactaataaaggccggtctgctattggactgtatagaggtgggaaggccaaaccgagaaattatgtctgacagaaggaaagaaatgacaaggctaaactgaagaattatgtctgacagaagggaagaaatgactatggtggccttcttagaccctgtgggaaaggcctctacttatccagtgaaagtgtctacctagaccaagaggtattttagtttgctgactcggggcatgttgagtaaagctaatttgccagtcttgggcaggggcaaatcctggagcttgatgtgtagggaagggtgggggcctgaataatctctgagaagtagtagaatagcagatggaatactgagaagttatttccttgaggatagatttctatgatggaaaggaaatgagaggttctaagaggcgggctagtggctagtactatagcatagcctgcctttgctggcgtggggcgattaggcctggtggaactgccctcaataaaccaagcgtgatgagggcgaggaacaggaaagaaggaaacatggggaaatggggtgaatgtcagatggatcagagagttatagtcataggggtcaggtgtggtatccagaataatgtgggaggctggattgaagtccgggccaggaacaatggtaattgtgggagactcaacaaagagtgaatacagctgaaggagccggggagcagaaagtatatgtgtcaagtgtgaggaagaaaatagattttggaagttatgagaactgtagagagtgagttgagcatagtttgtgattttaagggcctctaaaaggattagggtggtggcggctgccacaagaagacttgagggctaggcaaaacagtaaggtcaagtaatttgggtaaaaaggctactcggtgcggtcccggttcttgtgtaagaattctgactgcgcagcccacacttcagctgtgggtaatgaaaaaggttgggatgagacagggagagctaggatgggggcagtctctaaagctgtcttcaaggaacggaaagaggagtggggaaaggacttaggatctatggggtcagcaaggtttccttttgtgagtttatataatggttttgttaggatggcaaaaccaggtatctaaagtcgaaagtatccaaccatgcctaggaaggaaaggagttgttgttttataggtgttggggtttgagagatcagctgaacacgattggcagggagagcacgtgtgtttttatgagaattacgccgagataggtaacagatgaggaagaaatttgggcttgactgaaataatgggggctgtctgtgaagctttgcggcagtacagcccgggtaatctgctgagcctgatgggtgtcagggtcagtccaagagaaagtgaagagaggctggaatgaaaggcgcaaaggaatagtaaagaaagcaggtttgagatctagaacagaataatgggttgtggagggaggtatcgaggttaggagagtatatgggtttggcaccactgggtggataggcaaaacaatctggttgataaggcgcagatcctgaactaacctgtaaggcttgtctggttctagaacaggtaaaacgggggaattgtaaggagagtttataggctttaagaggtcatgctgtagcaggcaagtgataacaggctttaatccttttaaagcatgctgtgggatgggatattggcattgagcagggtaagggtgattagtttttaatgagatgataaggggtgcatgatcggtcaccaaggagggagtagaggtatctcatacttgtgggttaaggtgaggggatacaagaggaggacgcaacggaggctttggattgggaagaagggcggcaatgagatgtagctgtagtccaggaatagttagggaagcagataatttagttaaagtgtctcggcctaataagggaactgggcaggtggggataactaaaaaggagtgcttaaaagagtattgtctaagctggcaccagagttggggagttttaagaggtttagaagcctggccgtcaatacccacaacagttatggaggcaagggaaacaggtccttgaaaagaaggtaatgtggagtgggtagcctccatattgattaagaaggggacggtcttaccctccactgtgagagttacctaaagctcggcatctgtgttggtctacagggcttccgaggtgatctggcagtgtcagtcttcagccactaagccgagaagatctgggaaggagtgagtcagagagtcttgggccagagttccaggggctctgggagtggctgccaggtgagttgaacagtctgattttcagtggggtcctgcacagacgggacacggtttaggaggaatcctgggctgcaggcattccttggcctggtggccagatttctggcacttgtagcaagctcctgggggaggtgtttctggaggaacgcctggccgctgcggttcaggcatttggaagttcttgtgtgctggagatgtggctggggtttgtctcacagtggaggcaaggaactgcaacttagaaatatgttgcttcttggctgcctctattctattattgtacaccttgaaggcgacgttaattaagtcctgttgtggggtttgagggctggaatttaatttttggagttttatttaatgccgggagcagattgggtaataaaatgtatattgagaataagacggccttttgaccttttagggtctagggctgtaaagcgtctcaggtttgctgccaaacgagccatgaactgggctggatttttatatttgatgaaaaagagcctaaacactatctgatttgggataaagaaaaaggagcattaaccttgactatgcctttagctccagccaccttttaagagtaaattgctgggcaggtgggggagggctagtcccagaatgaaacagtaagctggaccaggtgtgaggaggggaggtgataaaaggattatagagtggaggaacggaggctgaggaagatttgggacctagctcggcctggggaggaagggagaggtcagatggggctgtagaaaaggaagactagaaagactcagcgacgcttggggttgggactgaggggacaggtaggagggaaagaaggaagatttgggatgagttgcatgggaacagagactaggtagggactgatgtgtaaaagaatgcctggacgtcaggcacctcagaccatttgcccattctatgccaagaattatttagatcttgcagggtggaaaaattgaaagtgccattttctgactatttggaaccactgtcgagtttgtactggggtcaagcggcattgcagaggaatataaggcatttaggttttaggtcaggtgacagttgaagaggttttaggtttttaagaacacaggctaagggagaagagaggggaatggagggcggaaggttgcccatagtgaaggaagcaagcccagagaaaagagagagtagagacatggagggaaggggttcggggtttcttaccctccagacaagcgggaaaggggttggggcgcagaaataaggggttggggcgcagatataagaggtcagggcgcagaaataagggatcggggtacagagataagaggttggggcgtggaaataaggcaggcgtccctgagtggtcagacacctctgaaacgtgggtgaacaatcagagagatgtccctgcaatggggaggctgccttccgtagtccgtgaccagcgccggagttttgagtccacggataaaacgtgtctcctttgtctctaccagaaaatgaaaggaattgaaattaacagaagggagagattgaagggtggcgacaagattgaaaggagaaagtggttgagggatagtgagggaggttggagaagagagtaagaggccgcttacccgatttaaaattggtgagatgttccttggggtggtgggtctgaggacccgtggtggtaggtggatctttttcacggagcaaagagcaggagaacaggggattgatctcccaagggaggtcccccgatccgagtcacagcaccacatttcactcgcgtccatgtgaagacaccaccaaacaggctttgtgtgagcaataaagctgtttatttcacctgggtgcaggtgggctgagtccgaaaagagagtcactgaagggagactttgagtaggtaaaggaaaattacagtcaaagggggttgttttctggggggcaggtgtggagggggtcacaagatgctcagcaggggagtttttgagccaggatgagccaggagaaggaattgcacaagataatgtcatcagttaaggcaggaacaggccattttcacttcttttgtggtggaatgtcatcagttaaggcaggaactggccatctggatgtgtacatgcaggtcacaggggatatgatggcttagcttgggctcacaggcctgacaataaatataattatttatgaaaattacaaatattatttatgtatttatataaacaatatcatttatatataatattgtcatttatatataattatatgatgaatattatatttatatgtatatgcaaagttttgttattttccttttttgctaaaacaaagttggggccacagtctattaaatgcatgaactacatacatgttttttaaacgttatgtaaaattttatttgttgaccgaggtattagttcatagaagtacgtttgcttagcatacgcatcatttaaaacatccctgcgtacctcgatagataaaatgcttctcacatctgtagaaaaatacataaagcaataccaatatacagaagcagtcgcatctagtacacagatcacaacgtgcgcattacatagaccctctgtcgttcaacacgtgaaggaaagctgttgggttcgaaatcaggtttataaagtagaattggctcctggctaggcagagatgctattgcgaggctggtggaacactttttattctttcttttcctgtattttggagggtcagtagcctgcgaagctccttgtttctgttcactggagtcaggctgcggcaatttaggaatcaggcagtcactccggaggtcctcttagttatgcaaacctaggacgtgtcctcccccattaccctggagagcaatctgcttttgtttaacagagaccatccctttttaatggccaggtggagcagggttagtttgcataagcagtctttccaggaagaaaggaataaggtcccagccaagtacaccagcttttacactgtacatacatctgggtcgcctctaacctaggtcgctgcagacatcagctcttcaaagggggaaatcatagacacacgttgaacccaaggcaggacagccagggtgaaacattttgggggcagctttgattcagccttgaatgtggctgacaatctgagccctttatcaccctggacggtgaatggaaaagtgaatgctatttgggaaacaagggttgaatgggagggatataaagtaataagcggaaatccagtatctgcacaccctccaagcatcatagtcacagatgggtgcgggatccgtcttcagcagggacactgcttggcagcaagcagcctcagatttttaggacctgactctcagcccagtcctccaccccaagggcgctgagaagtaaaactgactcccttcgggaacatgtgatcctgaagttattttttggctatttccaagaagaactgtgattcctcaagagggagattctgaatttggtgctcaaaaggacaggagggtattttagaaggtcaactgtggaggaaaggggacgtgttagcattgtgaatttgtaaagcagatcatgaatttcgttaatttctgcattaatgcattaattgagtttgtatttactattttgccctctctgtaaatggcactcctgtcttctgagttgctcaaatcaaaaccttagtagttgtccttgagtcctccctgtccacagcaaacattcattccagggcacatcctgccaccctgagaagcacctccagttccttccggtacctgggtcccagtcactaggagcctgtgtaagggcatttgcaaaacaaaagtgagaggctgaattctccctgcaggagataaaggaccagacttttccccctctctttcttagagcattttgtttagaaaacctacaactggaagtactttctcagttcctttgaaatgtatgtggatgtttacaaaagctaaataagcctcctgtcagctttaagacctaggaatgtctttccttaggatctgaggccatctctttgaaatgcatcatcaaggaaggtagcgcccatgcctaccccttccaggaaaggacaggagcctaaatcttccgcaggcacctgactccaagttgcaaaacggcctcctttcataaggatgtacaaagtttattttttcttcatataaaaccacagctaccacagatgatcaccccaatttctgggtggatctagaacggactatgtgttgaccaagggttgtgttaagccctcttgctaggggactagttactgtttatcttgagaacaagtctgtaatgacttttatctgcttgataatgaaagagatttctttgcaatttcttagcagattgccagtgacatgaatcgcattctacttgaaagcctattcaacaataatagtgtttttatttttttctctattacttttgtggagaggtttttctgggtaggcagaagttttggttttaattatttatttcccccaacgcacttgcccgaacttccttcttgtctacccccagtgcaatccattctctgcactgcatctaggaagatctgctaagaaggcacatcggttcatgtcacttctttatttaaaaacccttgagtggattcccatcactctagctccacacctggatctgctggtcccgtgggatcagggccctgcctgccacacatccactgtgcctcacccacaccagcccctcattcttccttggaatccatgatctcattcctcacatgggacttctcactggctacacggttccctgaaatgctcctttatctggtctttgcaaaaatccttatttgggtcaccctgaaatgccagtttctcctccaggaagccagttcctcagtcacgctctcacatattaaactcttctattctctgttcacccccattctctttattttatttttttaaatttgtattttttttgtgacagagtctcactctgtcacccaggctggtgtgcagtgactcagtctgggctcactgcaaccgccacctcccgtgttcaagggattctcctgcctcagcctcctgagtagctgggattacaggcatgtgctgccctacccagctaatttttgaatttttgaaagagacggggttttgccatgttggccatgctggcctcgaactcctgacctcaggtgatcttgcccgccttggcatcccaaagtgctgcgattacaggtgtgaaccaccgggcctggactttttattttcttaatcatcaatatttacatggatttctcattcccctgacacactgagagctctgtctttcatggtgccattttagcggttgattaaaaatttttggaattagagttccaattctttctctctttttttgctgtagaaaaaagtgttttagaaagcttacaatttattgcttatagaacttttgtaagtgaattatgttaaggcaagagttattacctttgtggatgcaagtgaaccatgtattcatttttgtattggtgtaagtgaagatctaagggcagaagtgacttcaaaacagcacaaatatggtgagaagctgcctgggtgaggtgtcaggtgtgatgtctcatttgcccctaaatgtttgtgggatgcagggcaagggcagaaagaggctcacagaccatgtgatttgatatgtaaaagtcctcatgccttccttgacaaatgtacattcacagcgatgtgggtggtagctgtggtttgtagtcctcaggctccctggagagcatagctgaaattctgctacctggacgcagactcctcctgctcctggccccctccccgcctgcttgctcgtgaaccgctagcagtgaacccatgacattgtgacccctctgctgacttctcttatttccatgctccttgtatctctgacaaaccatttcagatacaagccaagctgtctaccctcaggaggagaggcccaaagaaaaggcccatccaaccctacgaggcaagctcaggtccatctgggccaggatgccagggtcttgaatacgcagaggatggcccaggacattctcccttccctgtggggagaacatcagccagaggtggcctctgagcctgggtcagcaggcaaggcccccgcccccagttctaaaatagaactgtggcaaacagttaaaccacatctcccaacagttgagattaacatgtgcaggcacagaatgaaatgttacactaaaaaaacaaaaccaacaacaaaaaaccaaattacacatagattcactaagaatcacaatgaaacctccaatctactgtacaaaattaggcaatgtcaataattcacaaggggggagcaggatctccatggaatccatgcattttcatagttccagaagggaagcatgtgctgatgacttaggaattctcaaccccattacaaccacctcccgaaatctgcaggtcgccaattgtttactttctacatcaacatcatcaaaccacacagacaacactcaagcatgaacaacaccggctgtgcaaagtggctcatgtctgtaatcccattgctttgggagcccgaggcaggaggatgacttgaggccaggagtttgagaccagcctgggcaaaatagtgagatgtagcggtgtgacaaacagaaattaaagaatgaagtatgaaaacaggagaagattttcattaaaacctttactgtaataggaagaatgaaattttaacttgcaattagggtgatgacacgttcagccttatccaggacagtactggcttgcacctgttgtctcagatagtgatgaacagcacccatgtttactcttaaaatatcccaatttgaataaaaattacataatcttcccacctatgaagtcctttaaaactggagtttcagaagaataagggaaatggctggaagtgtgagacagacaacagggaaaatccagtgacatcagtgaagcccctctgccaggtacgcctgtaatcaattccctcccttttttttttttttttttttttttgagacgtagtctcgctctgtcgcccagcctggagtacagtggcgcgatctcagctcactgcaagttccacctcctgggttcacgctccctcactctttttactcatgtcagcaatacttgatttgtttttatttcttaagataattttggtaaatttctattatttactgccaaacagctttgactaacacgttctctcccatctctgggccttttgcaaacgtgtccatagctagggacaattttaccctattctcttgttcacttggctaaattctacttactctgttaatcttaggttaaataccacattttcaagactgaggtccttgattcccgcagctctatgataaatgctgtttagaggctccctgaccttttctagtcagaaaaattgttccccgcactccacctcggtctgcttttaccttctctagaaggtgcacttgctgagctcagatgctgtaattgtcctgctcgttgataaaccaagtagcttcacagtgtgcagcgtacagtgggttctcaaaaaatgtttgtcgaatgaagtgtttaaagcacttagcccgagaattggcccctagcaggtattaaatagtaactattataagctgtatcatgatgtaacaaacgatatgaagaatcaagatgcactgtgagttctttttgttgctgctgctgctgttgttattgagatagagactcactctgttgcccagtctggagtgcagcggcgtgatctcagttcactgcaacctctgcctcctgggttcatgtgattctcaatgcctcagccacccgaggagctgcgactacaggcgcccaccaccacgctcggctatttttttgtatttttagtagtgatggcgtttcaccatgttggccaggctggccttgaactcctgaccttgggtgatccgcccaccttggcctcccaaaatgctgggattacagacatgagccatggcacccggcctgtgagatttaagaaaataaaagcaagtaactcaaatgatcaagtctcaaaaaaataagtttacaatcgtataaatacacacacacacatatatacatataggagataatgtaaacatgtaattaaaacattgatgtattaacttcaaacatgtaatgtaaattttgagtgaaaaagaaataatagacatttataataagctccaagaagcaagagaatgtgtttatttccgttttttttaaatctaatcaatttccatgtctaaacttcattagggaaaactttgtttgcaatttagtgatgtttattttgcaaatggctaatggcactgtgtttctatgaaatgtttagaaatggatcgaaaatgctattgcaaagccaactaaattatagacatgaaataaatgtcaaggacaaaattattatattttgcatgtcaggttaaaaactagtgaacagtatttcaaaaatgtaggttattataaaaggtagcatggtataaagcagactccatgtgaccaagtacatatttttgtttatttatttttaattatactttgttttagggtacatgtgcacaacgtgcaggtttgttacatatatatacatgtgccgtgttggtgtggtacacccattaagtcgtcatttaacattaggtatgtctccaaatactatccctccctgatccccccaccccacaacaggccccagtgtgtgatgtttcccttcctgtgtccatgtgtactcattgttcaattcccacctatgagtgagaacatgtggtgtttggttttttatccttgtgatagtttgctgagaatgatggtttccagcttcatccctgtccctacaaaggacatgaactcattattttttatggctggatagtattccatggtatatatgtgccacattttcttaatccagtctgtcattgttgggcatttgggttggttccaagtctttgctattgtgaatagtgccgcaataaacatacgtatgaatgggtctttatagcagcatgatttatagtcctttgtgtatatacccagtaatgggatggctgggtcaaatggtatttctagttctaggtccctgaggaatcgccacactgtcttccacaatcattgaactagtttatggtcccaccaacagtgtaaaagtgttcctatttctccacatcctctccagcacctgttgtttcctgactttttaatggttgattgccattctaactggtgtgagacgatatctcattgtggttttgatttgcatttctctgatggccagtgatgatgagcattttttcatgtgtctgttggctgcataaatgtcttcttttgagaagtgtctgttcatacccctcacccacttgttgatggggttatttgtttttttcttgtaaatttgtttgagttcattgtagattctggatattagccctttgtcagatgagtagattgtgaaaattttctcccattttgtaggttgcctgttcactctgatggtagtttcttttgctgtgcagaagctctttagtttaattagatcccgtttgtcaattttgggttttgttgccattgcttttggtgttttagacatgaagtccttgcccgtgcctatgtcctgaatggtattgcctaggttttcttctagggtttttatggttttaggtctaacatttaagtctttaacccatcttgaattaatttttgtataaggtgtaaggaaggaatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttgcattggtctatatctctgttttggtaccagtatcatgctgttttggttactgtagccttgtagtatagtttgaagtcaggtagcatgatgcctccagctttgttctcttggcttaggattgacttggcgatgcgggctcttttttggttccatatgaactttaaagtagttttttccaattctgtgaagaaagtcattggtagcttgatggggatggctttgaatctatcaattaccttgggcagcatgggcattttcacaatattgattcttcctacccatgagcatggaatgttcttccatttgtttgtctccttttttatttcattgagcagtggattgtagttctccttgaagaggtccttcacatcccttgtcagttggattcatatgtattttattctctttgaagcagttgtgaatggcagttcactcatgatttggctctttctttgtctgttgttggtgtataagaatgcttgtgatttttgcacattgattttgtatcctgagactttgctgaagttgcttatcagcttaaggatattttgggctgagacaatgcggttttctagatatagaatcatgtcatctgcaaacagggacaatttgacttcctcttttcctaattgaataccttttatttccttctgcctgattgccctggccagaacttccaacactatgttgaatagtagtggtgagagagcgcatccctgtcttgtgacagtttgcaaagggaatgcttccagtttttgcccattcagtatgatattggctgtgggtttgtcatagatagctcttattattttgaaatacgtcccatcaatacctgatttattgagagtttttagaatgaagggctgttgaattttgtcaaaggccatttctgcatctattgggattatcacgtggtttttgtctttggttctgtttatatgctggattacatttattgatttgcatatgttgaaccagccttgcatcccagggatgaagctcacttgatcatggtggataagctttttgatatattgttggattcactttgccagtattttattgaggatttttgctttgatgttcatcagggatattggtctaaaattctctttttttgttgtgtgtctgccaggctttggtatcaggatgatgctggcctcataaaatgagttagggaggattccctctttttctattgattgaatagtttcagaaggaatggtagcagttcctccttatacctctggtagaatttggctgtgaatccatctggtcctggactttttttaggttggtaagctattaattattgcctcaatttcagagcctgttattcgtctcttcagagattcaacttcttcctcgtttagtcttgggagggtgtatgtgtccagaaatttatccatttcttctagattttctagtttatttgcatagaggtgtttatagtattctctgatggtagtttgtatttctgtgggatcggtggtgatattacctttatcattttttattgtgtctatttgattattctctcttttcttctttattagttttgctagcagtctatcaattttgttgatcttttcaaaaaaccagctcctggattcattgattttttgaagggtattttagttatttctttccttctgctagcttttgagtatgtttgctcttggttctccagttcttttaattgtgatgctagggtgtcaattttagatctttcctgctttctcttgtgggcatttagtgctataaatttccctctacacactgctttgtatgtgtcccagagattctggtatgttgtgtctttgctctcgttggtttcaaagaacatctttatttctgccttcatttcgttatttacccagtagtcactcaggagcaggtcgttcagtttccatgtagttgagtggttttgagtgagtttcttatttctgagttctggtttgattgcactgtggtctgagagacagtttgttataatttctgttcttttacatttgctgaggagtgctttacttccaactatgtggtcaattttggactaggtgtggtgtggtgctgaaaagaatgtatattctgttgatttggggtggagagttctgtagatgtctattaggtccacttggagcagtgctgagttcaattcctggatatcctttttaacttcctgtctcattgatctgtctaaagttgagagtgggttgttaaagtctgccattattattgtgtgggagtctaagtctctttgtaggtctctaaggacttgctttatgaatctttttttgttttctgtttgcttggtagatcttcctccatccttttattttgagcctatgtgtgtctctgcaggtgagatgggtttcctgaatacagcacactgtagggtcttgactctttatccaatttgccagtctgtgtcttttagttggagcatttagcccatttacatttaaggtttatattgttatgtgtgaatttgatcctgtcattatgatgttagctggttattttgctcattagttgatgctgtttcttcctagccttgatggtctttacaattttgcatgtttttgcagtggctggtactagttgttcctttccatgtttagtgcttccttcaggagctcttgtagggcaggcctggtggtgacagaatctctcagcatttgcttgtctgtaaaggattttatttctccttcacttaggaagcttagtttggccggatatgaaattctgggttgaaagttcttttctttaagaatgtggaatattggcccccactctcttctggcttgtagagtttctgtcgagagatcagctgttagtctgatgggcttccctttgtgggtaacccgacctttctctctggctgcccttaacattttttccttcattttaactttggtgaatctgacaattatgtgtcttagagttactcttctcgaggggtatatttgtggcattctctgtatttcctgaatgtgaatgttggcctgccttgctagattggggaagttctcctggtttatatcctgcagagtgttttccaacttggttccattctccctgtcactttcaggtacaccaatcagacgtagatttggtcttttcacatagtcccatatttcttggaggctttgttccttttcattcttttttctctaaacttctcttctcacttcatttcattcatttgatcttccatcactgataccctttcttctagttgaccgaattggctattgagacttgtgcatttgtcacttagttctcgagccttggttttcagctccgtcaggtcctttaaggacttctgtgcattggttattctagttagccattcatgtaattttttttcaaggtttttaacttctttgccatgggttcaaacttcctcctttagctcggggtcgtttgctagtctgaagccttcttctctcaacttgtcaaagtcattctccatccagctttgttccattgttggtgaggagctgatttcctttggaggaggagaggtgctctgatttttagagtttacagtttttctgctctgttttttccccatctttgtggttttatctacctttggtctttgatgatggtgatgtacagatggggttttggtgtggatgtccttcctgtttgttagttttcattgtaacagtcaggaccctcagctgccggtctcttggagtttgcggaggtccactccagaacctatttgcctgggtatcagtagcagaggctgcagagcagtggatattggtgaacagcgaatgttgctgcctgaccattcctctggaagtttttctcaggggtgtacccagccgtgtgaggtgtcagtctgcccctactgggggatgcatcccagttaggcttctcgggggacagggacccacttgaggaggcagtctgtccattctcagatctcaagctgtgtgctgggagaaccactactctatgtaaagctgtcagacagggacatttcagtctgcacaggtttctgctgccttttgttgtctgtgccctgcccccagaggtggagcctacagaggcaggcaggcctccttgagctgtggtgggctccacccagttcgagcttcccacctgctttgtttacctactcaagcctgtgcaatggtggacgcccctctcccagccttgctgcagccctgcagtttgatctcagactgctgttctagcaatgagcaaggctctgtgggcgtaggaccctctgagccatgcacgggatataatctcctggtgtgccgtttgctaagcccattgggaaagtgcagtattagggtgggagtgaccggattttccaggtgctgtctgtcaacactttctttgactagaaagggaattccctgacctcttgtgcttcccgggtgatgtgatgcctcatcctgctttggctcacacttggtgtgctgcacccactgtcctgcacccactttccgacactcgccagtgagatgaacctggtacctcagttggaaatgcagaaatcacccatcttctgcatcgttcatgctgggagctgtagactggagctgttcctattcggccatcttggctcccatccaagtacacatttttatagaagacaatgactgagccgggtgaggtggctcacacctgtaatcccaggactttggggggctgaggcagaccaatcacctgaggtcaggagttccagaccagcctggccaacatggtgaaacctcctctgtactaaaaatataaaaattagctgggcgtggtggtggcacctgtaatcccaactactcagggggctgaggcaggagaattgcttgaacctgggaggcagaggtttcagtgggctgatattgtttgacagagcaagactaagtctcaagaaaaaaaaaaaaaaaagagaagaaaggaaggaaagaaaggaaggaaacaaaccacaactgttgtaacaatggcagtaggcagacactgtgccccagcagtacatgttgcagccatcccgaaataagttcattgtccccttctcctaactttttattgatgcttcagatctagctactatatctatagatatataaaagacatctcctttaggatttattgcatgcactaaaaaagctataatcttgccccttttgctttatgtctcctgacaaatgaaccaacaacactggctgtttcttacttttgactctgaatcccacttccaacatgtgtgccttgcaagaacacccacacttccagaactggatcctgcagccacccatatgcctgtcaacacccagaaagtccacctttgatgtctgcatgtttaaatcctgactcagaaaagggacatcttgtgtatgttatttaaccaaaggcatcttttcttgtaagaacactctgagtcacaggattcttattttaatttttcctttccaaggtagttatgttaggaggagatttttcaactcttagccaaaaaaattcacaatgcaaaaatagaatgttaactaacaaaattttacattatctaaaactcagtaaattgagaagagaaaataaaatatttgtaagagaattttcattactattcattcatttattccttcattcagaaatacttctgagggccaggtacagtggctcatgcctgtaatcccagcactttgggaggccaaggtgggtggatcacttgaggtcaggagtttgagaccagcctggccaacatggtgaaaccccatctccgctaaaaacacaaaaatttgctgggtttggtggtgcatccatctgtaatcccagctactcaggaggctgaggcaggagaatcgcttcaacctgggaggcagagttcgcagcaagccaaaaccgtgccactgcactccagcccgcgctataagagtgaaactccatctcaaaacaaacagaaaacttctgagtgcctactgcatgtcagttctactcacttgggacacatcaatcaacaaattaggatctctttccttgtggaggttagattctcaagggaggagataacaatacaaaatacaaccaagtaataaatgaaatattatggatatggacagtgacagtgcgttgggataaagaagacaggagtgtcgatggcactgagagtgctggggggcagttggtggtgatttcaggtgggctggtcatggaagttcccctgagatgatgacacatattttaagatagagacagaatcagccttgcgggtacctggggccaaggctactgagaaggagaactgaagtttctatcaaagaccctaaacggtgggcctagagccttgttggagaagcatggacatttctggggctggagctgagaagggggtggatgatgaggcttccaagggaggtgtgagggcgatcggtgggtggggtgaggggagaattgcaggcagctgcaagggacttggggcttgactcagtgatccaggggccattgctgggttctgaaaatgttacaagggcgtgaagcttatattttaaagaattaatgtagccactgtgttcaggacagaccatggagaggccgtgagaccaggtggaaggctattgcaggggcacggcaggagattggaggagactcagccatgggagatggtgtcgagtagacagacagggccccattctcataaattttataggtatgtccaataaggtttctggatgggctgcatgtgggatatgaaagacagaatatgagaatgaacagggtaaacagacaacctaaagaaagggagaaaatttttccaaaatatgcatctgaaaaatgtctaatatccagcatctataaggaacttggacaaatttacacgacaaaaacaaccccattaaaacatggacaaaggacatgaacagacactttttaaaagaagacatacatgttgccaacaatcgtggaaaaaagctcaccatcactgatcgttagagaaatgcaaattaaaaccaaaatgagataccatctcacaccagttacaatggctattactgaaaaaccgagatataaaagatgctggtgaggttgtggagagaaaggaacacttaaatactgtttgtgcaaatgtaaattagttcaaccattatggaagacagtgtggtgattcctcaaagacctaaagacagaaatatcattggacctagcaatccattattgggtatatgcccaagggaataaaatcattctattataaagacacatgcatgcatatgttcagtgcagcactattcaccacagcaaagccatggaagcaacctaaatgcccatcagtgatagactggataaagaaaacatggtacatatacaccatggaatactatgcagctttaaaaaagaatgagatcatgtcctttacaggaacatggatggagctggaggccattattcttagcaaacaaatgcaggaagagaaaaccaaatactgcatgttttcatttataactgggagctaaacgatgagaacacatggacacataaaggggaacaatagacactgcggtctcccggatggtggaaagtgagaaaagggagaggatcaggaaaaataactaatgggtactaggcttaatagctgggtgatgaatctaggttaggcacaaaggtactccagagctctagggaagccaagggcacctgctacttatatataaagcaggtatcttaaccacagcttttatgacaagacaaattattattccaagggctagggccatattgagctgaaaacattcttattagtatggactcatattccaggtattaacaaagacacctaaataatctgaaaggcgttttctaaaattaataacctgattacagaatggaagacgtatgcatttatgagtttctttgaaaactcatggatttctagttagcatgtgagctctgcaaagcaggaatcttgacttcgttcactcagtcctgcttagctctcagcatggaggctgcaggtttacggacactcagtaatcctgatggcctgaatgaatgagtgaatgaatgaatgaatgagaacccaggatgcatatcattcttaagtattcaaaagaattgaaattttcagtctgatattagcttttctttgtctgtaaggggtaggttattttatttaaaatgacattacaactccattacaatgattagttgttaaacatgatgtgtcttttctcatttgacatgacaaattcctcctcgagattttaatatgtatacaagtgaaatactggagtttctaccccatcctgaaatttactaaattggtgagtctaatgcaaatactaaagcactcactgattgattttgtgttaaatggtctaaaacatgagttggcaaactgtatactggaaatcaaatctggcccatcagctagtattgtagcttgaaagctaagaatggttttacattttttaaatggttaaaaaatatcaaaataaaatattaatttatgacacatgaaattcaaacacatctctgaccactcatacatgcgttgtctgtagctgcctttgggctacacagccacagagctgaggacctgccttggagaccacaggacctgcaaagcctaaaatagctactctctgactcttcagggaaaaggtttgctcctccccggtacagaactataattatgaaataatttttttgcatttatatggcatttttctttgcatgtatatggcatttcccttaccttgctctttcccattaattctcatgtctttgagttaagcaaattgaaaaagtgctttattatctgcttcctcaccctgaattgaactctttatgcatataactaggttatcattttctcaaagttgctcttcagggtgagatcctcgcccagaatagaaacgccacctctgtgaggctccctggctttgggtgttgcaggatcaatgggaaccagcagctggagttttgtgtcgggtgcctccgtgtttcagtggccgaacaggtttggaaaacacatagaaggagtatatcctccagccccatcggggtgcatcaactcagcccagactccagaggaaagacagtggcatggatacaagaacgttccacctaattaaggataaacattcctcatttcatttctgaaaatgtcagagtgcttcaataactacagagagggtccaccgagaacaaacccccctcgaagagcagaggctgaggatggctccagtgcttagggagagaaacatttttgacaatccctttctttatattttccaaagtaatacgtggttcttgagtattacacaaaacaaaatgagaacctcgacctacctcaagagttaggcaaggggctcttcgacttgacaacagaagcacaatccataaaagccaaaatgaataaatgagacttcatcaaaacagaaaagcttttgctctaaaaaagaccctgtgaagaggatggaaagacaagctacagactgggagaaaatgcttgaaagccacgtatctgacaacagactagtgtcttaaaaatataaagaatgctcaagactgaagagtaaagaaaaataaaatcccattagaaaatgggaaaaggaacaacaacaacaacaaacaaataccaaaaaaaacctttcactgtagaggaaacacaggtgagaactataaaacatgaaaagatgctctaaattagtagccattaagcaaataaatgcagagatatcactgcatccttataagcacacttaaatttaaaatttctactatatatgttttctaaatgatgtaaataccatagacaattttatatcgtctgtaaaatatcaaatgttgcataggaggcagaaaaacagaatcacgtacgcgttgctggtgagaatgtaaaatggtacagccattctggaaaattatttggcagttaaaagcaaaacattcaattctgcaattgcattcttgggcatttatctcagagaaatagaaacttacgttcccatgataaagataacaaatatggtgcagtatatacggcttgggtgatgggtgcgccaaaatcctacaaatcaccactgaagaacttactcgtgtaaccaaataccacctgaaccccaaaaacttacagaaaaataaaataattttgaaaagaaaacctgcgcgtgaatgttcatcacagctgtactcataggagtcccaatctggaaattacccaggtgtccttcggcggtgagtgattaaaccaactgctgcctccattccctggagttctctgcaggaatctaaaggaatatgccctggattcatgcaacaagccggccccatcagcacccacagaaaggtactgaatgaagaggccagtccgagagacgacacactgcctgattccctccacagcacatttgtgaaatgatcaaaagtctggaagtacagaatagatgaatggctgccagggattacgaaggcatgcgggccgaggtcaatgggtacggctatcaaagagcagcctgtgggatcctattcctgggggaaatgtcctacttattgatagtatcaatgtcaacgcgtgggctgtgatagtgaactctagttctacaggatgttactcttgggggaaactgggtaaagtgtgcacagggtctctgttttatttgttgccactctaagtggatctatgattaccccaaagtaaaacaagttcaattaaaaaagtaaaggttatgtatgtctgagttgcagtattcatttgaattatggacagtgaatgcaaaccattttatttctaaaattatgctcatatgaatatatatatatatatatatatatatatatatatatatatatatatacacacacatagttaatttcaaaattccgagaggttaaaacattgccaataagcgtcacagaagtcatgtatttctgaatgtacctttgtgatagaaggcaatatgaatctcatgattgtgaaactcctgacaaatattggtaaatctgaagatgacagtatccattttcagcatcacccattgctggggataatgaccattctcttggaataataataaatactaaaccaaagaaagtgtcctttccagttaacataattactgtttatccaagaggcgctataaatgctattacttcgggccaaatgaaaaaaaaaagaaaaagaaaaaatcaaaggacaaagattccctgttaaaacctctgaaaatgtgaaagattatagtcagtggaagcacaggtattaaagtagaggtatagacagaataagtgacattattcaagcaaacatggaatacctggtgtaatctgcccctcgagagttcattgtaatgtctcatagtggaaaatgtcctttaataagcttagtgtttaacaagtacttaatagttataaaaacatgccataatgtatacctattaaacataagtaaatgaattctacaatctacaaaaatgtatgtaatagaaataagtaaattacttttattttgtacaagagggaatgtgaacttcattgcaagagaaaactcagtaggaatcctatgaaaaagtttgttgttaattaaaagacgtaatattcaagaagtattatggacattacagttattaagctaggcaataaatctccttgacccataaattctcatttttgaattcatatgtcacctactttgtgtaataattgtccttatatgttttctcttgcatcatcaactgttattttttttcagagagtttcactttgttgtccaggctggagtgcagtggcatgatcgcagctcactgcaacccctgcctcctgggttcaagcgattctcctgcctcagcctcccgagtacctgggattacaggtgtgtgccaccacatctggctaatttttgtgtttttagataaaatggggtttcaccatgttggccaggctagtctcgaactcctggcctcaagtgatctgcctgccttgacctgccaaagtgctggaattacaggcatgagccaccgtgccaggccttgcttcatccactgttacagttgtattctaattcccctatgtatatatggatacattgggtctttgtttatctcagatgaattcaaagagccttataatcagttattggaaagagaatattactggtctatagtaaatgttcatttttggtaatacattcaagtaatttttgaaatttcttacaaataaatgttttaatatttttagtatgaaattatatttttgagagattgataacatatagttacccaaattagaaaatgtaaaacataaaaataggataagtgaatactgttcacaatagtatttgaatcacttatcccaattaagttcttaagatggcattgtaaagtcaactaactttctttaataaatgaattgtgacttctctgacacaaagacactaatagttttgctttcatcatgtgaagattagacatctgtgggaaaaccaagtatgtctcttctttgatgtgtaaaaatagtacactgtttaaagttattttaaaaacactttttacctaatggtaacgctaacatttaaactttgaatgcagcataaaattctattttttgcatcctcatgaaactgaaagatccttaatttgtttatttaaagagacttcagtttttttcatagtaacaatgaaacgaaatttgaaaattcaaactttatttcccagagatccttttctaaacatttattcacctcaataatatgattaaactgattcccagctttctagcaggtatgaacaataaaaatctgtatattgacacaaggcagacttgaggtgaggaagtaattattagatttcttaggaaacattctctgcgaattcaccagttctttattaacaataagtacctggtttggaatttcattatgttatggaaacctcaggtggcgtagtaatgtgaagatctggtattataacattagtgtgatacagtgctatttacttgtgttctatcttttcctgtttctaagtcaaaattccactcgctatgtgcctttttgccacacaagtgtcaggagaatcttatttctgtcagtttgaatcgagtgaggtgatcaggaggccaaagagagggaaaaatctaatttgagaactgcacactgaatcatttaccacgtaatgcttccctggagtggatatgcctctagaacagagaataaatattaacaatcatttatatttgcagaaaacgtataaatcgaactgcttttgtgtttctttcttctaagggaagtactcatcaaaactgtggggtcgtaaaaagagtattgtgtcctaatttaacttaattaactaggaaatgattgctaatagagtttaatctacatgattaagggtacatagctagtaaagatgaggctaaacccaggccagaaacagtgcctctgttttgcctactgtaaaaactatactgatactatatgtgtgggtgggctgtgtgtgggtgtgtgtggcctgtgtgtgtatacatttttcttgtactcagtgtcagaattgctaacatcggtatagcttatatattctttaataacgatgaatgctgctaagtatattaccagggtctgcaccccagctgtattttaaccacctctgtgagaatttaaattatatgggaaaagcatctttagggcacttcagaaggcaattcaacacaaatctgttgaatagctgctcttgtagctggcaccatgttaaggattgtcactattagagcagagatattaaaaatatttaaggaatttacactctcactagaaccaataactaaaaaataagaatcagaaaataagcacagacacataacgaagaaataatgaaaaaacaagggaagacaaaatgctactaagtgtcaaatgtgaggcagaggaggaagaaatggtaaacgcagaaatcagtgcgaagtatgtatgacctgtgcacgcacgatattcagcaacagccaagcgtgataaagataatttctatgaatcttgtgaaggggggagtgtaagaatcatattaaatgggtcgttatttactctcagggatcagagacgtttcctaaacagagtggtgtttaaccgcaacctgtcatgagaacagaaggggctggagaagggagtgagtcttagagagagggagtagcacactcctgttacctgggaatttgaaggctcaaaaacagcaaagaaataatctgtcaggaaccaagagtgaaggagaggagtgaaggtggagaagcccagtgctggccaacatgaggtcgtgctaggattttattctaatataagtgagaatctgaagaggtttttttctcaaagcagggccctagcttttacctttccttctgccagcatggcctttcttcagcatgactttgatgcagttgcaccctccacacagtccttcagactagggttttgcttggtggagacctgggtgatgcagtagctcaggtggggaagagaaaagcggactgagatcagcttctccatctccttggaggccacaagcaggaaattcagcacttggccagggaaaggggtccagttttggatgcgttatttttagatgtctgcaagatgttcaaatgaacttatctaattggcatcttacaggttcatgaggtagacatgagctggaaatagagagctttgaagttattaccttatgaatccatgtccatgcctgggggaaaaattaatttgcaaagagagagtatgtgcagaaagcagacctgatgtcctgagaccaaccctccaggacacctgcctctcaagggcaagcagaagacaagaggcaaaatagtggccagggagtcagggggctcccgggatgatcatgaaaacctagacgaaagagggttgtaaggcggaaaggcagtagcaccacagttctgcaaggggccgtttaagagaaccacccggccgggcacagtggctcacacctgtaatcccagcactgtgggaggctgaggcgggtggatcacctgagactaggagattgagaccagcctggctaacatggcaaaaccccatttctatgaaaaatacaaaaattagccgggcatggtggtaggcacctgtaatcccagctacttgggaggctgaggcaggagaatcacttgaacccaggaggcagaggttgcagtgagccgagatcatgccattgcattccagcctggtggcagagtgagactccctctcaaaaaaaaaaaaaaaaaaaaaaaagccaggcatggtggcaagcatctgtaatcccagctactcaggaggctaaggcaggagaaccgcttgaacccaggaggcagagtttgcagtgagctgagattataccactgcactccagcctgggcgaaagagtgagacactgtcttaaaaaaaatcaaaaaaaaaaaaaaaggaccaccctcagatgaattggttgaggtgcatggtatttatgacagtgacaagagcagtaatcacagagtgatgagtgtagaaacacaaaaccagctgggttgtggaataacttagaggtcaagaaatgcagacagccaacatagactaaggtataaaattttgctctaaaaggagaagacaaacaagctgacactcatatgtgaacgatggtagttttaggtattatttttaaatgtcagagacttgagcatatttacatacaagaagcaagaagccagagagagggaagggtgaaaatcaggagagaaagaggcttccacccagaggtcgtcccgcggcagccagcgggaatgtctgctggaggaccaccactgcctgggagaggggtcagaattcccaggtaacaggagtgagaaacagtggctcactgctagcttgcatgaccgttggaaggaagtgaagggaaaccccctgatagctttgcgtctcacaaggcgtgatatcccactgggtcatatcccacaagatcatctatcgcgtacgaaaggggtgttgatgcattggaagatttgaaatacaaaggtgcgttggagcaaggcttcgctgcaacaatagatgatggcagttgagcagttgcgtggttggtggccgtgcatgtacactggtaaacaagctgccaggcgtgaggtttcctcaggagctctccggagtccagaggagagaatccaggcagatgctgggccagggagcttccagcacaagggaatgtaacacactggtaagagactttgaggatggcatcgctgctgataggaaagaaatgtgtcccggcaaaagcaaagagccaacatacagtgaggaagcagggatggaaagagaagcagcagtatagagtaacgggctgacatctgatgttttgggttacccggtgggtggggcacactacatgcctcccacagcagctgatgggagtggagcggggagaccaaggggtgcagaggccggggctgatgtcacccagctgggccaaccattgacgggatgtgcaggaccctggcagggccatagggacctgcatagagtcctaactcactggggtgggagatcaaagggcagcagagggcagagcctcagaaatgaggattatgccagaggggaacaggattccatgaagacagggtcattgccctgtgtgggctcagttgcctctgtctgcccttcctggtagttttatgagggacgggccaatctttgccttccacagcattgatctccaatgcccatggggtactcagggcacaataggaagagacgggatatttgtaggtgaatgtatgaactgatatctgaatgaatgaatgaatgaatgagtgaatatcgaatggtaagtttgttgcttcagaatgattacactagtgccatcatgcacacaatgaggccagggcgactttctcccatcagggtgtggtcagatggttcatttcctatttttttttttttttttttttttttgagacggagttttgctctgtcacccaggctggagcgtgatctcagctcactgcaagctccgcctccgaggttcacaccattctcctgcctcaacctcccgagtaactgggactacaggtgcccgccaccacgcccagctgatttttttgtatttttagtagagacagggtttcaccgtgttagccaggatggtctcaatttcctgacctcatccgcccacctcggcctcctaaagtgctgggattacaggcgtgagccaccgtgccaggcccagatggttcattttaatgtttgtcttggtgactggcattttttgtgttctcattactgaaacaatttatttccgaataacatgtttttaaagacattgtgataatccagtgaattaaatgtggaccatttctttctccatggggtactgttgtctacctctgcctacctactcctgtgttgattgggagtttgagacttatcagaaaattttatgcccagggtcctgggggacagtggggcctgaaatgactgttgcctgaggtatggacaaacacccttccaacatgagctggattcatattagcagaaaggtggccataagtgatattccagctagtattttttatagaaagaagctgatattctattgagtaataagtattaaacctccatcctcaagaataggagaagtgccattttacatgtcttgattctctccttcgatttgtaatcaatctcgctaatgttagagaaaatgaatcagagctaaaatcctgtcatcccccagtatacaagacttagaacttcagctaaaccagcatcttactttcaatcaattcaacacgcattcttcgtatctgtgtcatggaccaggtgtccacgggacggaaagctgaatgcagctgtctttgggcctatgctgttcacaatctatgatcctaagtggtcaatcataaaaatgtgcggccagttctctgccagtcccatgaggaagatgccgagagcagaggggagcgatggctccagctacgcttgtcttgtgctgcccttcataggcagagaaacttggaccatcaaccacacaggcttacggctggttttctcccataaaacagtcccagcctgttctgccatgggcagcaccaaaggcctctcctgtaataaacaacaaatgatgttttaaaatgaaaatgcacctattaagttatctttcaataaagtagggagaggtgtcatgtagctgttacattactaccactatttacggagaaatcaatctcgcaaaacctgagaatgaaacatggttgcagagccatttttccctgggactgggggagctgacagtgccacactgagcgtttatttaacccccagagtaaaggtcagctttgtgtgctgaactccattttcgtgagttttatgcatgattaaatggtaattaagctttaatgaaaagtgtcaggctgattacaattaacataattgcagtagtcagttcatgtccttctgttttacatgctgtgcagagctggcaggacagtggacctttaatggggtttggatatctcatgagcctctaaagctcctttttctagtggagaaaatttagtcttccataaagtgaaggtaaacgcacataaagcaaagtttaggtcacaaccctactccattgatggccatcaacatgcacgtagacatgaagcatggaagatgagcaaggactttctctaacctcttctttttttttttttttttttttgagatggagtcttgctctgttgcccagggcgaagtacagtggcactgtcttggcccactgcaacctctgcctcccgggttcaagcgattctcctacctcagactcccaagtagctgggattacaggcacatgccaccatgccttgctaatttttttatctttttatttttagtagagatggggtatcaccatgttggccaggctggccttgaactcctgaccttgtgatccgtctgccttggcctcccaaagtcctgggattacaggcatgagccactgcacctggcctttccatcctcttactagacagttgttgctgcctcaagattattttaaagcagtgaaaaaaaatgatcagttttaatgaagaaaatttaccaggtgatagattaaaaactatggttacttaaaaaatgaccattgaacttcataaaactattctgcctgatttccaactggtatcaaaattttaagtgatcaagagtaaaagaactttatcaagaattataacacttaacaggtcgacacagatgcagcccttttattatataggtataatgtgttctttactcatcaaagcaagtctacagtatcaagtacttctgataataaacatacaaaaccatttactttaaactatttatcaacagtggatgtaaaataatccagaggggaaggaactttgctatttgtattagtctgttttcatgctgctgataaagacatacccaagactgggtaatttataaagaaaagagttttaattgactcacagtttcacatggctggggaggcctcacaattatggcagaaggtaagcaggagcaagtcacatctttttttctttttttttttaattttttatttattattattatactgtaagttttagggtacatgtgcacaacgtacaggttagttacatatgtatacatgtgccatgctggtgcgctgcacccactaacttgtcatctagcaataggtatatctcccaatgctgtccttcccccctccccccaccccacaacagtccccagagtgtgatgttccccttcctgtgttcacgtgttctcattgttcagttcccacctttgagtgagaatatgcggtgtttggttttttgttcttgcgatagtttactgagaatgatgatttccaatttcttccatgtccctacaaagcacatgaactcatcattttttaaggctgcatagtattccatggtgtatatgtgccacattttcttaatccagtctatcattgttggacatttgggttggttccaagtctttgctattgtgaataatgccacaataaacatacgtgtacatgtgtctttatagcagcatgatttatattcctttgggtatatacccagtaatgggatggctgggtcaaatggtatttctagttctagatccctgacgaatgtccacactgacttccacaatggttgaactagtttatagtcccagcaacagtgtaaaagtgttcctatttctccacatcctctccagcacctgttgtttcctcactttttaatgattgccattccaactggtgtgagatggtatctcattgtggttttcaatttgcatttctctgatagccagtgatgatgagcattttttcatgtgttttttggctgcataaatgtcttcttttgagaagtgtctgttcatgtcctttgcccactttttgatggggttgtttgtttttttcttgtaaatttgtttgagttcattatagattgtggatattagccctttgtcagatgagtaggttgtgaaaattttctcccattttgtaggttgcctgttcactctgatggtagtttcttttgctgtgcagaagctcttcagtttaattagatcccatttgtcaattttggcttttgttgcctttgctttttgtgtttgagacatgcagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctgcatatggttagccagttttcccagcaccatttattaaatagggaatgctttccccattgcttgttttactcaggtttgtcaaagatcagatagttgtagatatgcggcgttatttctgagggctctgttctattccattgatctatatctctgttttggtaccagtaccatgctgttttggttacggtagccttgtagcatagtttgaagtcaggtagtctgatgcctccagctttgttcttttggctcaggactgacttggcaatgtgggctcctttttggttccatatgaactttaaagtagttttttccaattctgggaagaaagtcattggtaacttgaaggggatggcattgaatctgtaaattactttgggcagtatggccattttcacgatattgattcttcctacccatgagcatggaatgttcttccatttgtttgtatcttcttttatttccttgagcagtggtttgtagttctccttgaagaggtccttcacatcccttgtaagttggattcctaggtattttattctcttcgaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacagtggggttttccagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagtcttcaaagggaatgcttctagtttttgcccattcggtatgatattggctgtgggtttgttatagatagctcttattattttgagatacgtcccatcaataccttatttattgagagtttttagtatgaaaggttgttgaattttgtcaaaggccttttctgcgtctattgagataatcatgtggtttttgtctttggttctgtttatatgctggattacatttatagatttgcgtatattgaactagccttgcatcccagggatgaagcccacttgatcatggtggataagctttttgatgtgctgctggattcggtttgccagtattttattgaggatttttacatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtacaaattcctccttgtacctctggtagaattcggttgtgagtccatctggtcctgcactctttttcgttggtaagctattgattattgccacaatttcagctcctgtttttggtctattcagagattcaacttcttcctggtttagtcttgggagagtgtatgtgtccaggaatttatccatttcttctagattttctagtttatttgcatagaggtgtttgtagtattctctgatggcagttcgtatttctgtgggattggtggtgatatcccctttatcatttttattgtatctatttgattcctctctgtttttttcttagtcttgctagtggtctaccaattttgtggatcctttcaaaaaaccagctcctggattcgttaattttttgaagggttttttgtgtctctatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagactctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttacaatttctgttcttttatatttgctgaggagtgctttacttccaactatgtggtcaattttggagtaggtgtggtgtggtgctgaaaaaaatgtatattctgttgatttggggtggagagttctgtagatgtctattaggtccgcttggtgcagagctgagttaagttcctgggtatgcttgttgactttctgtcttgttgatctgtctaaagttgacagtggggtgttaaagtctcccattattaatgtgtgggagtctaagtctctttgtaggtcactcaggacttgctttatgaatctgggtgctcctgtattgggtgcatatatatttaggatagttagcccttcttgttgaattgatccctttaccattatgtaatggccttctttgtctcttttgatctttgttggtttaaagtctgttttatgagagactaggattgcaacccctgcctttttttgttttccatttgcttggtagatcttcctccatcctttcattttgagcctatgtgtgtctgtacccgtgagatgtgtttcctgaatagtgcacactgatgggtcttgactctgtgtccagtttgccagtctgtgtcttttaattggtgcatttagtccatttacatttaaagttaatattgttatgtgtgaatttgatcctgtcattatgatgttagctggttattttgctcgttagttgatgcagtttcttcctagccttgatggtctttacaatttggcatgattttgccgtgcctggtaccttttgttcctttccatgtttagcgcttccttcaggagctctgttagtgaaggcctggtagtgacaaaatctctcagcatttgcttgtctgtaaagtattttatttctccttcacttatgaagcttagtttggctggatatgaaattctgggttgaaaattcttttctttaagaatgttgaatattggccaccgctctcttctggcttgtagagtttctgtcaagagatctgctgttagtctgatgggcttccctttgagggtaacccaacctttctctctggctgcccttaacattttttccttcatttcacctttggtgaatctgacaattatgtgtcttggtgttgctcttctcgaggagtatctttgtggcattctctgtatttcctgaatgtgaatgttgacctgccttgctagattggggaagttctcctggataatatcctgcagagtgttttcctacttggttccattgtccctgtctctttcaggtacgacaatcagacgtagattcagtcttttcacatagtcccatatttcttggaggctttgctcgtttctttttattcttttttctctaaacttcccttctcgcttcatttcattcatttcatcttccatcactgataccatttcttccagttgatcgcatcggctcctgaggcttctgcattcttcacgtagttctggagctttggttttcagctccatcagctcctttaagcacttctctgtattggttattctagttatacattcttctaaacttttttcatagttttcaacttctttgcctttggtttgaatgtcctcctgtagctcagagtaatttgattgtctgaagccttcttctctcagcttgtcaaactctttctctgttcagctttgttccgttgctggtgaggaactgtgttcctttggaggaggagaggcactctgctttttagagtttccagtttttctgctctgttttttccccatctttgtggttttatctacttttggtctttgatgctgttgatgtacagatgggtttttggtgtggatgtcatttctgtttgttagttttccttctaacagtcaggaccttcagatgcaggtctgttggagtactcggccgtgtgaggtgtcagtctacccctgctgggaggtgcctctcagttaggcttcttgggggtcagggacccacttgaggaggcagtcttcctgttgtcagatctccagctgcatgctgggagaaccactgctctcttcaaagctcagatggaaatgcagaaatcacccatcttctgtgtcgttcacgctgggagctgtagaccggagctgttcctattcgttcatcttggcttctccgactgcaagtcacatcttacatggtggcagagaagagagagcttgtgcagggaaactcccatttataaaaccatgagatctcatgagtcttattcactatcatgagaacagcagaagaaagacctgctcccatgattcgattacctcccactgggtccctcccatgatacgtgggaattgtgggagctacaattcaagataagttttgggtggggacacagccaaaccgtatcattattaaaatagcagttacatatttattaaaggctttactatgaaaattttgaattaagctcagctcaattacaaagcatattgtttacagtagatgaagaggtattcattatgcaaagtcatactaatattttcaacatttatgcacgtggaaaattttcacgcatatctaattagcagacacttgttggatattgattatatgtcatgttctaggaaaacaaagaccatctgccctcaagtaacttaatccactgtattaataaaatggtaacccacaatgggctaagcactattatagaagtataaacattgtgtttggggactggaagtgacaatgtgattgtcttcgctaaagaaacctttgaatgtgagataggcacactggaatttcttgtgcaacaaggcggggaaggtcagtccagtgtgtaacaggaacacacatccaagctgagagaggctagcatctgagtagaggtttctgtaggctttgccagagtggaggatggtgattgaggatgatgttgaaaattgcttaggggaagttttcagagggttttgtggccttatttttggcagtggggagaatgagaagtcaccctggctgagatgagaagataggggagagttctaagcagaagtgaggcgttgcccacgttgctgcggaaaaggttcacctgggtgcctgtgcgcaggtgggccagaaagtacgcaggtgcatgaagaaggaagcccgtgagcaaggcagggcagctcagacccccagcggcgtagaccaaggcggcagggcacaggttgggagaattggattttggatctattttgaatagggactccactgaatgcattgttggattctctgtgtggtgtgagatctacagaggtctaaaaatggctccaaaagtttcatcctgacagcctgagccactggcaggatggagttgactttaccaaaaccgggaagatgtcaaggggcccaggattgggaaaagcatgaacaaggactgtggttgagtttcaggtgttgagttgcctctctgcatctctgcagcaaagcagagacatcaagaaggcaggtggacactcaggggagaagcctgggaggctggctggtgtttccttaggagtaccagaattggacatttattaactagtaatgggattggggggatgaattatgtccaagggttacattaaaccacatggaattgccaacattccatcatttcttccctacaaaagtgacaattttatacagttcaaattggtacacatgaaaagctgagtaaaagaaaagtaagcaagcgtcatttctgcagaaaccttcgtgggtatcttaatgtttgttgcttcttaaaaaatatatggatagagaagaaagggagacccaaggacaagccctcctggcatctgatctttagagtttcaagggaaaaaatatatgaatcagccaaagagccaatgatagagtgacccttggaataaggaggaacaagagagaataataagatgaaaaacaactgaagaaagagtttccagaagagagagtcaaataagtgtttaaaaagctccaatgtaacatggaattacaagatagagaggtagtgcaaccctgatgttaaattattttttaaaatgtacttcaaagtgtgcttgggaaaaatatagtaattcaaatgtgtccaagaaaacaaatattcacataactattttctctccaataatttaatcacacctctaatgcttatttcacatgttactgacatagaatcaagtaaaaatagcctactaagaaatctcatttaatacaattgaataaatgtcatttttgcttggaaacaatggccacacttaaaacatcaatcatatgaggaaaacatttctttttgagttctatttaaaaatttttaaaatcataactaattccaatgttttaaattataaaattagcatggtttatgaatcacaacacaatctaatttataggtaaagttcctcgttttttttttggtcccaggttcataaagacaaaaaaatgagagatttccatcttcccacccatcctcccacctacaaaagagtagtgatggcttcttgggtgtgatggacaggctgttttgcactttgtgaagagtttcccacctttggtttggaaagacaccagcttgatttagtttcatggctggattcgccagtgaggggacgaatgtgggtggagtgagagggacataacagcccagtttcttcctgcagtgaagcagggtaactgggtcagtttcttaattacgactgaggggttataggaaccttcttttctaaaactagaaaaccaggacatgatttattccaggtgtaggagtcaaatgtttatcaggttctcagggagatggagactggtgcccgattctcactggttcccagaagtggcaagctacattttgtggagagtagctgaatgactggctttggggtggtcagaccagcgtcttcgtgttccagcctgagatccttagagagaaacacatgacatgaattactgtggccgcccagaccgttggcccccaaatgagagcacgagggaatataatgactagtggagaggcaggaccatgtccctctctggactcaccacactgaatcatccagcaactccctggccatccaaaattggcagcagattttaaaaatagactggtattggacttcttgtcaactcgaatgcatgggagctagaactggatataatttgtcttaggaaaatgacttttattttacagccctgattgtagtacactcacaggcatttcatatgcttgccaaggtcctttacagaactgtattttttaaaatgccacatggtacgtatgacaatcccagtgggataatttgagagtttcttgcctaaggttgggtttggaaattctaggaagaagggattatattagtctgctctcatgcagctaataaaaacatacctgagactgggtgatttataaaggaaagaggtttaattaactcacagttcagcatggctggggaggcctcaggaaacttacaatcatggaggaaggtgaaggggaagcaaagcaccttctttagagggtgttagaaaggagaagtgcaagcaggagaaatgccagacccttataaaaccaacagatctcatgagacttacttattgtcatgagaacagcatgggggaaactgccctcatgatccaaccacctccacctggtcccacccttgacacatatggattatgagcattacaattcaaggtgagatttgggtggggacgtagaacctaaccgtatcaggaaggttacttggaattagtacagagatccggaaagagatggtcaatgcagcagcttgagcaaagccgtccgtgttgatcttggggcacatcggcccccggggtacctgaagagagaggtactaggcctctgtgccctgacatgccctcctgccccatctcttcacccatgctggggcttcttattggaataacccaatacaggtttgcctcgagagccacagagtagttaaaggaagagaaagtagtagatttggggccaaagggaaaataaatgacatccagcgtggaattatggaagacagaaatgtccttagaaattgatactctatcctcatttcataaataaagtaaaaataacagagacaaaaggtcagtctcaaagcattagaggtcaagatagaaactcacatttccagagttgtagtctagactatgctttttaaatgttgtaccactctaagtttttatatcttgtttttcctttcaataaacttctaaagacaatcttgcagaaaatccttcatttaaatgcctcagagtcaatgttatattctagcccctaaatgagtatttctgaaaatttataccagaatttggatttattaactagtgatagggttggagggatggatcctatccaagtgttacgtgaaaccatgtgaaattgtcaacattcaatcattttttacgtataaaaatgacaatttcatatgattcaaactagtacacatggaaaactgagtaaaaaatagtaattgtcatttctgtagaaactttcatggtgtcttcatgcttatttcttactaaacactaataattaattatatgagaagaaacatttccatgatcctcaaataattataataaagggtcttcttctttttttctacccaagttagaaagatgttctctgaagagagaatcatgaatatatagaaaaaaaagaagtgatggccaggtttcaacagtgattgttaaaacaggaagattttaaaaggccaggagtaaaatgaagtacattctttccacataatccatgaaccctcttcttaggtatctagtcaggtgaactgaaaacttacgtccacacaaaaacctgcacacagatgtttagaggcagctttaggcataattgccaaaattttgaagcaacccgtatgtccttcaataagaaaatgggtaaacaggctgggcgaggtggctcacgcctgtaatcccagcactttgggaggctgaggcaggtggatcacctgaggtaaggagtttgacactagcctggacaggataatgaaaccctgtctaggctaaaaatacaaaaaaatagccaggtgtgttggtgcgtgcttgtaatcccagctactcgggaggctgaggcaggagaattcctggaacccaggaggcagaggctccagtgagccaagatcatgccactgcactccagcctgggcgacaaagcaagactccatctcaaggaaaaaaacgggtaaataaactgtggtacaacaagtcaatagaatattattcgctgctaaaaagaaatgatccgtacagccatgaaaagacctggagcttgaaagtgtcttactaagtgaaagaagacaacatgaaaggccacacactgcgtgattctaactctgtgactttcaggaaaagacaaaactatggagacagtgaaaagagtgattgctaggaattaggaggaaggaagggatgaacaggcagaacacagggaattgttagggcagggaaatgactgttggtgatgttattactacagatgcatttttccaaactcattgatatggtttggatctgcgtccccacccatgttgaattgtaatccccactgttggaggtagtgcctggaggggttgattggatcatgggggtagtttctaatggtttagtaccatcccccagtgctgtcttcatgatagagttctcaggagatctgattgtttaaaagcacgtagcaccttccgcttcactctgtctttccccttccccggtcgtggaagatgtgactgcttcccctttaccttctgccatgactgtaagtttcctgaggccctcccagccatgccttctgtacagcctgctgagttgtgactcaattaaacctcttttcttgataaattacccagtctcagatagttctttacagcaatatgaagatggaataatatacccatggaatgcataacaccaaaagtgaacccggagaaaactgtggatatcggctgataatgatgggtcagtgtaggttcattgattgcaacaaatggaccactctgtggggatgttgacagggaggaggctgtgtgctgtggacagagagcacgtgggaactctgtgccttctactcaatcttactgccagtgcaaaactactctaaaaaaataaaacctgttgaaaaaaatgcctggagaatacagaatggaaagaagaggaaaatgaacataatctcataactttctcaacttttttgttttgctaaataaggccaatgaatcacaattctaccatctgctcttgccaccatttcaaaagattaagaaaattttatatcacaacaaaaaacaagagtgatataattttggagtaaaggactttttttcccccaaggcaggatagttggaacactcttactttcatattttttgtgaaggaccagtgaaaattttaccatgtacaagtactattccacaggcacgtgtttgcaaatcactgttcagagcacagtgaaaccagaggtaagaaattgtgcagactataaccagaggtaagaaattgtgcagactataacctcaattatattagcaaccttttaaagcattaaactgacctaactcaattttcttatgtaaatcctaaatatgacttgtcagtgagctgccaagagataaattgagtctgaatgtgtttgtgtgcaaattccacttgttttatgatgatggctgaccttgtgtgctgcccaataatatggcatctctccacggtgccatccgaagggcactaaaaggctgaactgccacaaaatatctccactccttcctccttcggaaacctttcatcaaaaatgggctagacagcaaaaatggcaactatctttaggagattatagttcacgtgtgcagatgtggtttcacactagtaattcagcagaggttcctctgtcatattagcttcttgaaactttatccctaaggtggaaaaaaaattcacggaccgtcctgaaccgggaagttgcaagcagagaatcaaagcgtgtttgattagcaggttgtttgcagagagacttcattacataaagaaagtgtcagactggggcatgtagggaacctggaatcggggctgggttaggggagccctgaagataggctctacatttatgtagagacccacacctgtcttgcatccaagtctagaaatttactgactaattgaaacctttaaagtcgtacgtttttttttttatgtaactaagtaggtccattgctggtcctgatcttataatgaaaagaattccctaaaacaaaattttcctttgatactgacagtgttcagaaccactccaaaatatgcagttttgaggaaactgcagaagcaggaaagccactccagcctctacttgccccttctgccctgaagcagggcatagaataattctctggccttccttggaagcaggtcatgaaaccttcattccagaaggacactcccaggatgcagaggaaaggaatgaagacatagacacacagggaagaagctgagcaaaggagacttaagttcctccccgtttatcaccactaaattctatcttttcgtcctctaatcatacttctgcacgactatacattaaaacacacaattttctctctttctttgggtcttcatttctgaaggttccagtggcatgcaaaatgcacatcaaatgagtttggttatgcatttctcttaagctggcttctgttatcgtggcctcagccatgaacccagcaatgggggaagagaactcttctctgcaacatgcattttcctaacttcaaattaggctcaataaattgcatctgtgtaaggagacgctggtgaatataaatggagggagatctgtgttcatgacaagactttgatatcaaggtaaagaagaagcacgctgtgccacctactggagaactggatggagaagccagacttgctgatgaagaagtcgctgtcgaactgcagggtgagtgagttgaaggtgctgtggatgtcctccggaagggcggagccactccactccttcagcaggatgtcactgtccaccggcccgtcccagaccttgaggatgtcgtgagccatctccgtgtcgaaaacaatgaaatggaggctgcaagagagaacacagtagcgctacttgccgtgcatcgagcatgtcctgaccccatagctgtaaagtaagcaagctcatttcgctttcacacaacccccaccaacatgtgcctcggtacttactgtctgacaatgaaggatgaggaaaatgaggctcaccgaagataattcaggagtgtaaattaggataaagcacacaggacctcagtctgtcatggacgcagagagataggtgagctagatgctgagctatccattttaggataaaaggattgcttttgagacttccagatctctgtataatttaagctttctacggcacacaaaccaaatataagcttggcattgacagatgtgtttgaagcagatggaaggcagcttcggtgcagtcagtgttgttcacgaaatgccccgctaggtggcagcagccacagcaggagaaaagagcttactccattacgaccttttctacctgtgtctgaatggtctgctcttgtgttgtacttctttctaaaaattatattttaaaacttcatcatttaaaataccaacagaaaggcaaaaatgggtaacataaactcccttctttataaaattttaccatacttctattagacttccaggtatttttcagagtgacttaaaaatctctatgcctaaggactcacattcagaggcagcaggatctatgtagtcctatttagggccattgaagcaagaagggtttagttgaaacaccaacaaaaattagcagccctgaatgggtctgatttacagttttttatttcctgcgtattgcacaccgattacaagggaggtaaagtcacagtggacgacaaacaaaaaaactacccacgagtctcaactgctttgttttgcatatattacatgtttaaagaaaacacttatgtcaccctgtgtaaggtatggaatgtgtggtgtatttttaaaataatcaagataaatccttaaatatagagaaaagtatagcagatagtagatctttattttcctacattttgccctatttttgtcagaactttttttttttttctagagatgggatgtcgctccctctcctaggctggagtgcagtgtcatgatcttggctcactgcaacctctacttcctgggttcaagtgattctcctgcctcagcctcccaagaagctaggactacaagcatgagctgtcatgttcagttattattagtattattatttgtatttatagtagacatggggtttcaccaagttgaccaggctggtcttgaactcctcacctcaggtgatccacctgcctcggcctcccaaagtgctgtgattacaggcatgagccaccacgcccagaccagaactttttataaaacaaaaaatcttatacatgcaacaattttttgcctccactccaccaaatcattggttctttctcttatcacacactctgaagttgtaatgtaatatccccatttgtgtatatatatatatattttattattattatactttaaattttaaggtaaatgtgcacaacgtgcaggtttgttacatgtgtatacatgtgccatgttggtctgctgcacccattaactcaccatttaacattagataaatttcctaatgctatccctccccacttcccacaacaggccccagtgtgtgatgttccccttcctgtgtccatgtgttctcactgttcaactcccacctatgagtgagaacatgaggcgtttggttttttgtccttgagatagtttgctgagaatcatggtttccagcttcatccatgtccctacaaaggacatgaactcatacttctttatggctgcatagcattccatggcgtatatgtgctacaatttcttaatccagtctatcattgttggacatttgggttggttccaagtctttgctattgtgaatagtgccgctataaacatacgtgtgcatgtgtctttatagcagcatgatttataatcctttgggtatatacccagtaatgggatggctgggtcaaatggtatttccagttctagatccctgaggaatggccacactgacttccacaatggttgaactagtttacagtcccaccaagagtgtgaaagtgttcctatttctccacatcctctccagcacctgttttttcctgacttgttaatgatcgccattctaactggtgtgagatggtatctcattgtggttttgatttgcatttctctgatggccggtgataatgagcattttttcatatgttttttggctgcataaatgtcttcttttgagaagtgtctgttcatatccttcacccacttattgaaggggttgtttttttcttgtaaatttgttagagttcattgtagattctggttattagccctttgtcagatgagtagattgcaaaaattttctcccattctgtaggttgagtgttgactctgatggtagtttcttgtgctgtgcagaagctctttagtttatttagatcccatttgtcaattttggcttttgttgccattgcttttggtgttttagacatgaagtccttgcccatgcctatgtcctgaatggtattgcttaggttttcttctagggtttttatggttttagttctaacatttaagtctttaatccatcttgaattaatttttgtataaggtgtaaggaagggatccagtttcagctttctacatatggctagccagttttcccagcaccatttattaaatagggaatgctttccccattgcttgtttttatcaggtttgtcaaagatcagatagttgtagatatgcagcattatttctgagggctctgttctgttccattggtctctatctctgttttggttactgtagccttgtagtacagtttgaagtcaggtagggtgatgcctccagctttgttcttttggcttaggattgacttggtgattcgggctcttttttggttccatatgaactttaaagtagttttttctaattctgtgaagaaagtcattggtaacttgaaggggatggcattgaatctataaattaccttgggcagtatggccattttcacaatattgattcttcctacctatgagcatggaatgttcttccatttgtttgtatcctcttttatttccttgagcagtggtttgtagttctccctgaagaggtccttcacatcccttgtaagttggattcctaggtattttattctctttgaagcaattgtgaatgggagttcactcatgatttggctctctgtttgtctgttattggcatatgagaatgcttgtgatttttgcacattgattttgtatcctgagactttgctgaagttgcccatcagcttaaggagatttggggctgagacgatggggttttctccatatacaatcacgtcatctgccaacagggacaatttgacttcctcttttcctaattgaatactctttatttcctccagctgcctgattgccctggccagaacttccaacactatgttgaataggactggtgagagagggcatccctctcttgtgccagtttgcaaagggaatgcttccagtttttgcctattcagtatgatattggctgtgggtttgtcatagatagctcttattattttgagatacgtcccatcaataccttatttattgagagtttttagcatgaaaggttgttgaattttgtcaaaggccttttctgcatctattgagataatcatgtggtttttgtctttggttctgtttatatgctggattacatttatcgattttcatttgttgaacaagccatgcatcccagggatgaagcccacttgatcattgtggataagctttttgatgtattgctggatttggtttgccagtattttattgaggatttttgcatcgatgttcatcagggatattggtctaaagttctctttttttgttctttttctgccaggctttggtatgaggatgatgttggcctcataaaacgagggaggattccttctttttctattgattggaatagtttcagaaggaatggtaccagctcctccttgtacctctggtagaattcggctgtgaatccatctggtcctggactttttttggttggtaagctactgattattgcctcaatttcagaccctgttattggtctattcagagattcaacttcttcctggtttagtcttggcaggatgtatgtgtcgaagaatttatccatttcttctagattttctagtttatttgcatagaggtgtttatagtattctctgatggtagtttgtatttctgtgggatgggtggtgatatcccttttatcattttttattgtgtctatttgattcttctctcttttcttctttatttttcttgatagcagtttatcaattttgttgatcttttcaaaaaaccagctcctggattcattgattttttgaagggtttttctcttttttatatagactaattcctataattgtatttcttttattttattttattattatactttaagttttagggtacatgtgcacaacctacaggtttgttgcatatgtatacatgtgccatgctggtgtgctacacccattaactcatcatttaacattaggtatatctcctaatgctatccctccccactccccctaccccacaacagtccccggtgtgtgatgttccccttcctgtgtccgtgtgttctcattgttcaattcccacctatgagggagaacatgcggtatttagttttttgtccttgagatagtttgctgagaatgatggtttccagcttcatccatgtccctacaaagcacatgaactcatcattttttatggctgcatagtattccatggtgtatatgtgccacattttcttaatccagtctatcgttgttggacatttaggttggttccacgtctttgctattgtgaatagtgccgctataaacatacgtgtgcatgtgtctttatagcagcatgatttataatcctttgggtatatacccagtaatgggatggctgggtcaaatggtatttctagttctagatccctgaggaatcgccacactgacttcacaatggttgaactagtttacagtcccaccaacagtgtaaaagtgttcctatttctccatatcctctccagcacctgttttttcctgacttgttaatgatcgccattctaactggtgtgagatggtatctcattgtggttttgatttgcatttctctgatggccggtgatgatgagcattttttcatgtgtcttttggctgcataaatgtcttcttttgagaagtgtctgttcatatcctttgcccactttttgatggggttgtttgtttttttcttgaaaatttgttggagttcattgtagattctggatattagccctttgtcagatgaggaggttgcaataattttctcccattctgtaggttgcctgttcactctgatggtagtttcttttgctgtgcagaagctctttagtttaattagataccatttgtcagttttggcttttgttgccattgcttttggcattttagacatgaagtccttacccatgcctgtgtcctgaatggtattgtttaggttttcttctagggtttttatagtattaggtctaacatttaagtctttaatccatcttgaattaatttttgtgtaaggtgtaaggaagggatccagtttcagctttctacatatggctagccagttttcccagcaccatttattaaatagggaatgctttccccattgcttgtttttgtcaggtttgtcaaagatcagatagttgtagatatgcagcattatttctgagggctctgttctgttccattggtctctatctctgttttggtaccagtaccatgctgttttggttactgtagccttgtagtgtagtatgaagtcaggtagcgtgatgcctccagctttgttcttttggcttaggattgacttggtgatttgggctcttttttggttccatatgaactttaaagtagttttttctaattctgtgaagaaagtcattggtaacttgaaggggatggcattgaatctataagttaccttgggcggtatggccattttcacaatattgattcttcctacctatgagcatggaatgttcttccatttgtttgtatccttttatttccttgagcagtggtttgtagttctccttgaagaggtccttcacatcccttgtaagttggattgctaggtattttgttctctttgaagcaattgtgaatgggagttcactcatgatttggctctctgtttgtctgttattggcgtatgagaatagttgtgatttttgcacattgattttgtatcctgagactttgctgaagttgcttatcagcttaaggagattttgggctgagacaatggggttttctagatatacaatcatgtcatctgccaacagggacaatttgacttcctcttttcctaattgaatactctttatttctttctcgtgcctaattgccctggccggaacttccaacactatattgaataggagtggtgagagagggcatcctggtcttgtgcctgttttcaaagggaatgcttccagtttttcccattcagtatgatattggctgtgggtttgtcatagatagctcttattattttgagatacgtcccatcaacacctaattttttgagagtttttagcatgaagggttgttgaattttgtcaaaggccttttctgcatcttttgagataatcatgtggtttttgtcgttggttctgtttatatgctagattacatttattgattttcgtatgttgaagcagccttgcatcccagggatgaaacccacttgatcattgtggataaactttttgatgtattgctggattccatttgccagtattttattgaggatttttgcatcgatgttcataagggatattggtctaaaattctctttttttgttgtgtctctgtcaggctttgctttcagggtgatgctggccccataaaataagttagggaggattcccatctttttcttttgattggaataattgaataaggattggtagcagctcctttttgtacctctggcagaattggactgtgaatccatctggtcctcgactttttttggttggtaagctattgattattgcctcaatttcagaccctgttattggtctattcagagattcaacttcttcctggtttagtcttgggaggatgtatgtgtcgaggaatttatccattttttctagatattctagtttatttgcatagaggtgtttatagtattctctgatggtagtttgtgtttctgtgggatcggtggtgatattacctttatcattttttattatgtctatttgattcttctctcttttcttctttatttgtcttgctagtggtttatcagttttgttgatctgtccaaaaagtcagctcctggattcattgacttttttaagggttttttgcgtctctatttccttcagttctgctccgatcttagttatttcttgccttctgctagcttttgaatgtgtttgttcttgcttttctagttcttttaattgtgatgttagggtgtcaattttagatctttcctgctttctcttgtgggcatttagtgctataaattttcctctacacactgctttgaatgtgtcccagagattctggtatgttgtgtctttgttctcgttggtttcaaagaacatctttatttctgccttcatttcattatttactcagtagtcattcaggagcaggttgttcagtttccatatagttgagcagtgttgaatgagtttctttatcttgagttctagtttgattgcactgtggtctgagagacagtttgttgtaatttctgttcctttacatttgctgaggagtgctttacttccaactatgtggtcagttttggagtaggtgtggtgtggtgctgaaaagaatgtatattttgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggtgtctgagtctctttgtaggtgtctaaggacttgcttcaagaatctgcgtgctcctgtattgggtacatatatatttaggagagctagcttttcttgttgaattgatccctttaccattatgtaatggccttctttgtctcttttgatctttgttggtttaaagtctgttttatcagagactaggatggcaacccctgccttttttgttttccatttgcttggtagatcttcctccatccttttattttgagcctatgtgtgtctctgcaagttagatgggtttcctgaatagagcacactgatgggtcttgactttttatgcaatttgccagtctctgtcttttaattggagcatttagcccatttacatttaaggttaatattgttatgtgtgaatttgatcctgtcattatgatgttagctggttattttgctcgttagttgatgcagtttcttcctagtctcgatggtctttacattttggcatgattttgcagtggctggtaccggttgttcctttccatgtttagtgcttccttcaggaggtcttttagggcaggcctggtggtgacaaaatctctcagcatttgcttgtgtgtaaagtattttatttctccttcacttatgaagcttagtttggctggatatgaaattctgggttgaaaattctttcttttaagaatgttgaatattgcccccactctcttctggcttgtagagtttttgccgagagatccgctgttggtctgatgggcttccttttgtgggtaaccggacctttctctctggctgcctttaacattttttccttcatttcaactttggtgaatctgacaattatgtgtctttgagttgctcttctcgaggagtatctttgtggcgttctctggatttcctgaatttgaatgttggcctgccttgctagattggggaatttctcctggttaatatcctgcagagtgttttccaacttggttccattctccctgtcacttttaggtacaccaatcagacgtagattcggtcttttcacatagtcccatatttcttggaggctttgtttgtttctttttattctttttttctctaaacttctcttcttgcttcatttcattcatttcatcttccatcactgataccttgtcttcctgttgattgtattggctactgaggcttgtgcatttgtcacgtagtcctcgtgccttggttttcagctacatcaggtcctttaaggacttctgtgcattggttattctagttagccattcgtttaattttttttacaaggtttttaacttctttgccatgggttcaaacttcctcctgtagctcagagtagtttgatcatctgaagccttcttctctcaacttgtcaaagtcattctccatccagctttgttccattgctggtgaggagctgtgttcctttggaggaggagaggtgttctgatttttagtttgcagtttttctgctctgttttttccccatctttgtggttttatctacctttggtctttgatgatgatgacgtacagatggggttttggtgtggatgtcctttctgtttgttagttttccttctaacagtcaggaccctcagctgcacatctgttggagtttgctggaggtgcactccggaccctgtttgcctgggtatcagcagcagagactgcagaacagcagatgttggtgaacagcaaatgctgctgtctgatcattcctctggaagttttgtctcagagtaccaggccgtgtgaggtgtctgttggcccctactggggggtgcctcccagttaggctactcaggggtcagggacccccttgaggaggcagtctgtctgttctgagatctcaagctgtgtgctgggagatccactacgctcttcaaagctgtcagacagggacatttaagtctgcagaggtttctgctgccttctgttggtctgtgccctgcctgcagaggtggagtctacagaggcaggcaggcttccttgagctgtggtgggctccacccagttcaagcttctgggccgtttttttagtcattcaagccttggcaatggcgggcgcccctcccccagcctcgctgcagccttgcagtttgatctgactgctgtgctagcaatgagtgaggctccgtgggggtaggaccctctgagtcatgcacgggatataatctcctggtgtgccgtttgctaagaccattggaaaagcaagcccagtattagggtgggagtgacccgattttccaggtgccatctgtcacccctttctttgactaggatagggaattccctgaccccttgcacttcctgggtgagttgatgcctccccctgctttggctcccgcttggtgggctgcacccattgtcctgcacccactttccgacactccccagtgagatgtacccggtaccttagttggaaatggagaaatcgcccgtcttctgcgtcattcatgctgggagctgtagactggagctgttcctatttggccatcttggctccacccatcccatttatatttttagaagcttcatatgtgtgtgtatttgtattcctaaacaatatattgtactactctgtgtgtttaagagtagttacatattaaatattacttgacatgtgtgtgcttgtatcactttcaatttgcttttattttatttatttattttattttatttgagatggagtcttgctttgttgcccaggttggagtgcagtggtgtgatcttggctcactggaagctctgccacccgggttcatgccattctcctgcctcagcctcccgagtagctgggactacaggtgcccaccaccacacatggctaatttttttgtattttttagtagacacggggtttcactgtgttagccaggaaggtctcgatctcctgaccttgtgatccacccgcctcggcctcccaaagtgctgggattagaggtgtgagccactgagcccagcctcaatttgcttttgtactattatgggagagaccgttatactgaaaaaaaggtagaactttgttaatttactttaaaactgtaagtgttttattttcgtagttccttactaaaggtcagtttgtttctacattttaattttgacacgtggtaccgcactgtatattccactgtactgatgcaaggatctttctaggccagcatgataaagcagatttgctaactcgctctcccttgggattctaactgctttggtccagggtaatgtatgtattgcccttgttttattatatctttaggaatacctgattaccgtcagactaagagttctacatatatatagaaaatttgatggttgtggaatggtgtcttgtttaaattactttccctgatcactcataaagttgatcatcattttgcatctataagacgttccctttttgatttagttcaataattcaacatttactcggcaccaagagtgtactgagtgcacctcgaggaactttgcatacatctgccaagttgagtcctgccttcgtggagttcgtgttgtacagggaagagataggcaaaccacagcatccacaataatacagggaagagacaggcagtccacagcacccataacaaatgagtgaagaatatggaatgttagtaggtggtaaatgcaattgaagaaataaaaaagtagacaggaaaagaatcactgggatactaattcttaggggaggaaggggaagcctgaagtattaaatggggtggttaggctaagccatcttggcagaggcagattttggtgcagccttgaaggagttaagggtgtttgtcgcatcctgtgagacgtaagaattcagccaagcagaagccccacgtaaggggcataccgtccgcatttgaggacagccaggagccagtgcagcaagaacagaggaagggggactgggaaggaagagctgagagcagagaagaatgggggttgtgaattggatggtgggagagaggtgcctacgcacagagggctttgtaggctgttttaaggatgatacaccgatgcgggattttaaggatgatataccaaggcaggagtcctcaccaacaatttaaagaactggccgtgcttgcttgctctgttgacaacatgccatggagggaaaatgacactctgtcaacgttttgagtaatccaagaaagtggcgtatgtgctgagatgagctgaatatggaggtacccaggcactggtcaggtcctggatacgttttgaagggagagaaaacaggcttggaagaggtgtgcgtgaggtgaggatgtgctggccctgtaggtttgtccctcagaaactggaaaagtggagttgtcatccagtgaactgagaaacggtgcagtatgtttatgggatggggaaaatcagagtttctgtcttggacctgttgagtttaagttgtcaactagacatagatggaggggtatgtaggtagctgttcacgtaagttggagtttcagagagaagtcagagtggagaaaataaacatgtatgtcttcaacaaagaaatagtttataaactataggactggatgaaatcttcgaagttcttaggtggagaatagaagaggactatggattctgaagtacctggtcacatatgtttgccattaagcagaaagcatcctagagctggaaataattctaataaaaaatgtgcaggactttcacccagaaaactgcaaaacatcattgagacaaatcatacaaaagctaaataaatggagaggtatacaatatcaaggaccagaaagttcagtattataaaagatgtcagttttccccagaatgatctattgatgtcatgggatatcaataaaaatccaggcaatttcttttgtaaaaaattaagagtgtttctgaaattcatatggaagtgcagaaggccaagaatagtcacagtgatctatatgaagaagaacaaagctagattatgatactgggtatcaagatgtattataaagtaaatcaggaattaagttaggttttgtactagataagcaaatagataaatgaaatggaatacagtttggaaacagatctgcatagatctagttgtctcgttaattactaatttgtactatagtgcaataaagaaataaatcacttcagcaaattgtcaattgaacttaactgtggacaaaaatctgtgacacttcagtctccatactgtacacaaaaatttatccccagtggaatagagatgtaaatgtgaaaggtaaattaagttttgtagaagaaaacctaagataatatttgtatagctttggggagggaggagctagcaatctggacacaaaatcactaaagccaaccttaacaaagtttgtggcatagcatacatttaaatatagtttaaaaatttgctaaccgtaaagaaaaaaaatgagtaaaaattattatgactcattggaattaaaaacctgtgtttatcaaaagaaatcatttcagtataaaaaaatgggcaaaaggcttcaactggcaattagtaaaagaggatattcaaaaggccaataaacatataaaaaagtgtttaccttgatcagtcgtcagggaaatgcaaataaaaaggtaccacacccccagtagaatggctaaaatgaaaaaacaatcaatcccattgttggttagaaagtgaagttcctgaaattctctcatatacaccctctcagggagtgagggtaagaataaccactttggaaaactgatagcacctaatactgtggaaggtaggattcaccattacccagcaattcctggcctcagtgtatacccatggaaaaagcatacatacattcaccaggtaacatgtcaaagcatattaaaagcagcacagtttgcattaactccaaactgcatcagaaccatccaaatgtccatcagcacccagaatggataaataaattatatcaggaaatatctaacggtatcaatgggtgtgaagattgaggaaatgaagtgagacacataattaataaaactgtacaatctctctctctcttttttagacagagtcttgatctgttgaccaggctggagtgcaatggaatgatcgtggctcactgcaacctctgcctcccaggctcaagcaattcttctgcctcagcctcccgagtagctgggattataggcgtgtgccaacacaacttgcttattttttaatttttaatagagacggagtttcaccatgttgatcaggttggtcttgaactcctgatctcaggtaatctgcccgcctcagcctcccaaagtgctaggattacaggcgtaagccatcgtgcccgacaattatcttttacataaaattcaaatttggcaaaactcttctgaagtcttaatagtgattgtcctggagaagagacaatttgaatagagctcaaaggtctatcctgagtccagataattttccctttctttatctgagttctggttacatgggggtgtttcttttgtgaacaagccacatggcagtttttatgctatatgctaatgagaagcttacacagaaaaacaaacatgcaccctggtaccatggagttttgccatcttggaaaatgtctcatgactccaacaaaaaatatgatacaacaaaacttaaatgtaggtaagtgtcagtcattttttattcaaatgtaaaattgttaaaagtcaaaatgccagacacaattccactaggtaaaggaagttaaaaaaaatggagtgaagccaggtatggtggctcacgcctgtaatcccagtattttgggaggccgaggtgggtggatcgcctgaggtcaggagttcgagaccagcctggccaatatggggaaaccctgtctctactaaaaatataaaaatcagctgggcatggtggcagacacctgtaatcccagctactcaggaggctcaggcaggagcattgcttgaactctggaggtggaggttgcagtgagccaagatcacgctattgcactccagcctgggggacaagagcaacactttgtctcaaaaaaaaaggaatgcaatgtggtatcatcgctaaggaactctgtgatatcagatacaggcacgtgaggaaaagcacacatcctccaacgcacagtgtcccaaggtctggcagataaaagcacgccaccatacagcggacataggtgtaattctgcctcacaaagtgtgggaaggctcttgtccagccaagagaaagcaggaaaggaatccagggaaaggagagaaccggaaatgcaggtgggaggtgaagtgcacagagaagaggaagtcactaaccaaatgtattcacatgtcaaaaaagtcaacataggaaaggtataaacagatataaccaataaaatgtttggaatattttttttctggacagattgttaaggactgaaaagcctttgtccagtttcagagagaatgtagagacgcccaatttctatgtactgctggtggtatatctactccttttagaggcaatttggtaatggctataaaaattgaaatgtgcaaacatagcaaatgcagctctagaaattcatcatgaaaagtgccctggaggtgacacacggggaggatggtagcattacttacaacagtgaaaaaattaaaaacaacctgaatattccaaaagggtgtagtttaaataaattaaggcacattcaggcaatggaatactatccggtaactaaataggatgaggcaaaattacaaatttggatgtaaacatttggccatgtttattaactcaaaataaatgttcagaataacatggcgtaaaaaataattaaataaaaagataaatgaacatatcacattttatgtttgtatttgcatagaaaaaattttaaaaagctatatcaccttttcaagtgtagttttctttggtgtttaagattacagaaaactacatttaggggtttttttttctgcagcactttattattttaaaattaagaaaaataattaaccataaaccatgccaaagagcttatcctgcacataatgagtggacaaaatagtttttgtttttatagcaagctcaggcgagtgaaatgactgactctgctttatagaaagacttgtactaagacatatgaggatgctcacaccctttgacccagcaaacaaatttcctaggcatttattctaaggaattatataaatataagcaaagatttacttacaagactacttgtcacatcattatgtacaacatgaaaaattagaaatggccaggcctggtggctcacgcttctaatcccagtgctttgggaggacgaggcgggcagatcattggaggtcaggagtttgagactagcctggcaacagggcgaaaccccgtgtctactaaaaatacaaaaaaaattagctgggtgtggtggcacatgcatgtaatcccagctactcaggacactgaggcaggagaattgcttgaacccaggaggctgaggttgcagtgagccaggattgcgccaccgcactccagcctggacaacagagtgagactctgtctcaaaaaaaaaaaaaaaaaaaaaaagagaaagaaaaattagaaatggtataaacaagcaacaagagagacaatgtttaatggtacatgtccacaccacacaatatacattgatacgtataagacatttgccattgatgtctataggggaataatacatgatttcttcaattgtttttttttaattttttcaaaatctatatagacattagttttatagacataaacataaatttttaaaataaaacaaaccatattgtttggggtaggagcagtgggtgcaaggcagcgtttgcagggtggtcagtggaaacctggtgagttaggagggtctacccagcgaaggaaccaggtggtgggcagggaggagagtttgggaggcttcagatggggtctaaatgagaaatgaagctcacagaagtgtgggagctagtgaaacttgccctggaggtcttgacatgtggatatgatattaacagagattattagtacagaaggaaggtaactgatgaagagaaatgatgagatcagggaacaacacagaatatttctggatgggataataaaaatgaatttttgctgagccctaagagatgggaagaaactggaggtgagtcaatgaggagaaactcaagacagtgtgtgtaaagagagcaccacagtagcacaggctatgatcagagatcagtcaagctttctttgtcctgaagtcgaaagtatccatgagcagccaaagatacacctggaaagccgcactaagccaaattctagagggtattatggttctgggtaaggagctggtgcttgtcaacgtacagtgagggtatttgagagattggagagaataaaggatggatttgggaaggtcagttgagagaagactaaagtaacaggaaagtcatgggaattcataatggtggataagaagaaaggaaacataaagagatggagaaatgacagggctttgttttcagattctatgcacttttttttcagtgtctcgtctaaagaaatctcatataatttatcaaaagaattccatgagctgtacagtcctattttcattgttttaggtgggaaattattggatattgagggaggagaaataagcaacagcagagcataacactgaagactaaagtctcccgccccttggagggagacagtaacacaaatagggaatgatgacaataatgatgaaataatgatgaaatgtgaggagttgggaacacgtgatgagctctgaggagagatgtcagggaagtttggatcagcttccaccattttatctcttgtgcttttcagatcctgaaataactctagaagtttctttaatgtttttttctggagtcacttcttctggaatatctccatcgttctcatcacagcatctcctcccttacactcctacgtccttcttggctgagtttccctggctgcctatctaaggtctctccgcacagcagtggcaatgttcccacctcagctatttctcctgtaattccatttatgtgtgatttgagtttcacttcccatgatatcacttctcatttcttccctgcatgtctatcttttctgggcaattccttctttgcaattcccgttttttaagacatcaagtgcactgatcactgggagcaaagaagacaacacaactaccctctttgctgtctgagaatgcactgaatagcaggcaccctgtgagcagtcaccagcagatgttgaaagaggagatgtgatctgtcaccagtgatgatgatgtgcctcgttatccatatagtgatgtaggaactgaagagctcagaatttgtccttcatgcactttctcacagtttatgtaccatggcagctgaaatgtgagtggtatggttgggagctggtgttatttaactaatctgtggcaactgaaaatatgagtcagaactttgcaaagtgagtggggttgcaggtttctttcctctgactcaggctctcctacatgtctggtaaggtcacccatgaccagcaactgctcccagagccccaggttaaagggggtctggagtagcagccataggcatagggaaaaactgtagacttctataactcttttacttcatggctgaaattacttaaattgttatttctttgtattgtctatgaaaactaagggaagggtctatagtgatgttgataggaatggagaaattggacatgcttttattcctgagtggcctcatacctttctgtcctgtcaggaaaattctccaacccatggtctatgtacagaggctggacatggagactggggataaatgtatagttttctcttaagtgtatttcctactgggatctggaaggttgatcagaaatggattaatattcctagatctccagtgcaatttcactctaatctctctaaaagctgatgccactagaaagaaaatccaggtcaggacagccagcagaacaccagggtcgtcaaaccacatgttaccttttctaaaagtctgcataggaatgcttttgacaaccttgatacctttttgatatgcgtccaatgtttttcatactgtgcgagcttattaaaaataattcccttcaactatactaccaaatgcaattttctgctaacaattaggaacagaagtacattcaaagtgagctttccagacaattacactggcagaaaagcaattaaagcttaggaacagtgtacacatatggttatgtaaaacatagcctttaatgttgctagctgaagaagtttataatgctgttacttttgttacataaagcaaagcatggctgtgcccagcaatgaaatatgctggatctcttagagaaatattaccaaataactttcaatggggctaaattttctacaatgtcttgtgattagacttttaattaaatttggctcaggtaactgctctatagcatacatgttaaaattagaaattcttccagacccaagtgccccataataataactattttggggtattgcgccccattataataactattttggggtattcgattacctcaaacaaagaggaatagcactatataagcagaagttgctctgggcctcaatgaaatcaatgtagctctgcaataattggcctaaagtaaaatattgaaaccagccttttcatattttccaagatccggctgtttattcattccttgagagtgaaaaatatttacattaagatatcatagtataaatgcatagtaatgattacatttatattaagatattttaaagagctaaattaatccctgtgttcatatttatatgactgatgtatttctcattttcaagttaacattgtaggtaatacagactatgttaccattgaaataaataagacttagtaaccatgcaagctaatatcaaggctaagaccagacaccattttttctgagtattagtacaattttaagtacatgatatacaattttagtatattatgtacttctaattatggttttgccagatcaccatactaaaaattgcatttatgttattcatgaagagtggttcaatcatcaaaaacattttgggattaagttgattgtcaattgaggaaattaaggataaacatggatggctaccctcttaagctgcttattgggaagaagtttatgctttaaatttaatagatgtatttataaatttgatagtgtgtacctcatattgaaatatacgtatacgaagaaaatttttcaaggtcagttcatgcaataaaaactgcacgtttttattcaaatatttttttatttttctctttttaattttttttattaaaatgttaacaaagtattagattcacctgtaaagagtgaatccatgacttggtttgcatttagagaaagacaatgctcactctaattaattccagtaaattaagccacaaaggaaattttaagaaaaacaaaaatgtgaaattcttctaaaagaagataaattatttttatataaagtcattccattagcatagatgatttctacaacttttcaaaatcaaagccattggaagtggtttttacattactcaaatctagcatttgtgaattcaaagttaaggactaatatttaatttaattaatttatttacttaagactgcagtggtgtgatcatagcttacttcagccttgaccaactgggctcaagacatcctcttgcttcatcccctcaaagaaagtgctgggatgacaggtgtgagccgctatgcctggcctatttatttccatagaaacatgccttcatagattttcatgaggaatatgaaatattaaattctgttactcagctataacttagtgttgtcccaacagatcaataatcatcaaattaatcatttatcttgattaattttaaaatgagttattataaaatagtatgtgctatggttttactgtctccaccaaaactcatgttgaaatttaattgccattgtagccatattgaaagtgggagcccttatgaggtgattaggtcataagggctgggccctcatgaagggattaatgctgttatcatgggagtgggttagctatagtgggagggagcccctgataaaaggttaagcttggccccatttcctctctgtctctagtgtacttccttgctatgtgatgctctcaccatgtggactcatcatctgccaatgccatgcccttggacttcccatcctccagaactgttaagaaactaaacttcttaacttactaagtctgtaatattctttttcttgagacacagtctcactgttgcccaggttggagtacagtggcacgatctcagctcactgcaggctccacctcctgggttcacaccattctcctgcctcagcctcccgagtagctgggactacaggtgcctgccaccacgtgtggctaatttttttgtatttttagtagagaaggggtttcaccatgttagccaggatgatcttgatctcctcacctggtgatttgcctgccttggcctcccaaggtgctgggattacaggcatgagccactgcacccggccccacagtctgtaatattctattgtagcagcagaaacaccatcctaagatgtttgcattctagatatgctttaattgttgttcttgctccttttatgtagggagaacctttctcatgtagggtgtataatatgcattttcctcactccacttcatcccattttatttttgttaagttatagggttgcagtgaagtaagtgtatgatatctatgtgtaatacacattactaagcttgatagggtggcttttctgaataaggacaaaaatcatttgtttataaatatttttcatccttccacatcttctgcctcagtatcctgagtagctgggattacaggtgtgtgccaccatgcccagatgctttttgtatttttagtggtgatggagttttgccatgctggccaggctgatctcgaactactgatcttaagtgatccacccacctcggcctcccaaagtgttaggcatgagccactgtgcccagcctgactttgacctgtaactttttttcagcttcacgtatgtgtaggaggagctgaagcagctgggctgattcatttagtcttttgtgggtataatagcatgatggagtgtagacgcctgggacatgcagattaaggctattggaggtcagagtttctcaaaagcaaattttgtacagaaaattaataacaacaatgaaacagaaaggttaattgaaggaaaaatacattttaaaaaggattggttaggactgtgtgtccacttcattttaaacaagaactaaaaataaaactgattttaaaattaccttttgccttatgtgctatggttttggagacagatttctgagtagatcaccaagagcttactttaaaaatattacagagcttactttaaaaatattactttttgttggtttaaataactcatcatcataactcagaactcactattggaatagaacactttttgtttaaatgttcacatcattttctgaaatttgcaatgattttcttttatatgtgttactttagagtactttcttggtctacctcaaagttactttggtataattgcaaaatgacacacattgctcccatccctgcacacaagtctttttaaaatatgactttgcttctcttcctattaaaagaacagtagagtgtatttcttcatatcttgagtcttgcctagcccatgagacttgctttgacaaagggcaccttagcaagtgtaatgtaagcacaagttggaaatttgttcatcccttgctgctacaaccctcccaccgtgactagcctgctgcaggaacagaagcctggtgtgcaggggctcctgctttcccaaccatcccagctgaggccctcacacctaaggaaggtcatcctggactgctcatccccaggcagtctcacgcagatcagaacagcccaggcaacccacgaagtcatgatgttttttttcagctactaaatttgggggatagtttgttatgcagcagaagctaactgatacactctcattttggctttactatatagaacttaattaatggtttcaaggcaacagcaaagtaagcaagtgagccaacaaaacttttagctacagctttaccttttcttctttagttcagaaactttaaccatggatatttggtgtaccactatctctgctacaagaatagaaggcatatctcttttctcaaatcactgaaaccaaaataaaacaagtacctaatggtctttcctgggtctgcctctataatccaggtgcagtggaggttgttgtcatacggagctggatagccaggggacaatattcgtcctgatgtggctgcatggatctgaccaccacattccgctgtagaagacacagagagatgggaacgttcagcttcaggcatcacatgtttctatttagctacttttcaaaaccaaagccattatgtctgcattatatacatagagaaaaagaatcaccatcatctctctctcctgaccgtttcaatatttcttccaaatcattacctctgtggaaagtctttatcctccatgcaattaaagttgagagcataaagcaataagacactcatgtgataattctaataatatgtgataattctaataataacactgtacctatagtctccataacagaatactagaaaaactgtctttcatagctgaaaacacacactcacagacacgtgcaaatctcagaatacataaaactcacactggaaagtgtgataaaattcctcctcttttccaataaaggaagtcaatgcaacatggtgcaagcaccctaaggcctggcttttgcacaatggtatgactgcttccacactcacctatgcacgaaggtagtggtttgtcccacactctcctgtctccactcaaacaggtcagggtgttgctgccatgcatggcgtaccccgggttgcaactgtacagaactacagtgtcggtaaagtggccttcatcacggatcctatagccgtagttagggatgcccggatcctcacattttaccagatcaaaacctgcaagagagaaaggcaaggaatgaacagaactcaagggtggacatctgccttaaaacagagatgaaacaaacaaggttgctaaatgctccttgaagggtagggagaaaaaaggagattgtgaatttacaaaggggaaaagaaagatgggtctgtactggggctatttgttacccatttgtgatttcttgaagttcggtcatcttatttgttcctccctacttacaagtttttttttttttttttttttgcttttgttgcccaggctggagtgcaatggcgtgatcttgcctcactgcaacctccacctcccaggttcaagtgattctcctgcctcagcctcccaggtagctgggattacaggtgcctgccaccatgtccagctaattttttgtatttttagtagagacggggtttcactatgttggccaggctggtctcgaatacctgacttcaggcaatccaccccctcagcctcccaaagtgctgggattacaggcgtgagccactgcgcccggcccctcaagctcttgttttccggagttccacaacttcatctgtcagtccaagcctccagtctgcaccctggattctctggtgagccccaatgccctctaggacctctaggaacgggatactctgctgcctctttgcccctctgtcacaacctagacctccaaggaagaggggccacctatcggcactgccagggtgctttgcagaatcctgacagccagcacttattccagcccattgtcaagacccgcccaccttcccgacaacttcttccaaactccaagatgtcaacttcatgggaaaagaaaaaaaaactggcgctcctgaattactgccgaccacactcctgatggtgcatggttatgaggctcttgaggaaatccacacaacaacagaaactccagaaatgaatcattataatgacctcatcaaaataagctcttaaactcaaagaaatagatgacagaaatgaagatttagcttctgcagtactgagagctgtatattccttttatgtgaggcaatattttaaggccatctgtgaaagacagtcttacagtaacatatttctattcatatcatgatgcaaattttgacaattgtaaaagggagagctggaaacttgagggaccacatggtctctttccttctatttccaccaaactttgaatgctttcttttctcaaaaagaaattaaattttgaaatgaatttgtgacttctgctacatcctcctgtcaatgtgaagtctgagatgcccttccattgaggaaaatgtattcttaacttcacaatataattttaccctgctgatgtctgactaatcaggattgagatttgcagctttgtataggagaaagaggacatgcttgatcctttgcactcagtgactaagaaaatttccttccataaagtttccttccacaaagagtcagtctttaccaaccatgacattattatttttacgataaccctgatctatttaagagacaccaataattttaattcagatgcctggaattcaagaacagaagagtgtatccatcttggtgcaaaacaaagggatatgctaaatgtccacaaaggggaggtagaaattagggggatggtttcaatcaatcacctccggtttcagggtcattcaaatatttgatgaccttcatctcactgcataatgccaagaagacagggcagaaaggaagacattcaatatcatgtatgacaaaatccatcattattacagattattcagtgctcatttctgttttcgcagagaggaaaaaagaagcagaagtctttactgttgttattgttgtagtgttactgggtttgcgggtttggaagtgacagcatctgaacaagtctttagaaggcagtcctgcccagcattggggatgaccaccagcaaactagaggcagaatgacttgttggaggtgatgattctccctggccacacttggagtccacctccctattaataacaaacaatcttccaaaatcttgcgctatcttgaatttacattaggtatgctgcttatccaatgtcattggaacatacaattggaaataaccattaggcacacaaaatcggggtgtaaaaaacttttgagttcagcatctatccctatgatcagtaccactggaacaggatcctgggaaaacttaaaaatctttttgaggggtgagggccgcccatgctaacagggcatccaggtcctgtccgtgaagaacaaagctgtgaatggcagcggggccaggaaactgtggggttctgcacacagcacccaggaggtatccaccttaacaaaccacacccaatgtgacccgaacttctcgtttttcaaggggcaaaagaaatctggagttttaaaaaaagtttttaaaaagaggtggaatattgcacgtaatgcttctaaactgagctttgaaacacatctgctggggatgatgaaagcctggactaagaagtggtcaagatgcctacacaggctgctcaacttaacaaatgaggttacgtcccaataaacccattaagagtgggaaataccttaagcagaaaattaatgtaatatacctaactaactttccaaatgtcttaaattcacctagcttaccataaatatgcttaggacagttaccttggcctatagttgtggaaaatcatctagcacaaagcctatttattttataagaaattgttgacatgagatagtcctccccactactaataacaaacaacttttttttttggaaatgcagtctgtctgttgcccaggctggaatgcagtggcatgatctcggctcactgcaacctccatctcctgggttccagtgattctcctgcctcagcctcctgaatagctgggactataagtgcgagccatcacacccagctaatttttgtatttttagtagagtcagggtttcaccacgttgtctaggcttgtctcaaactcctgacctcaagtgatttgcttgcctcggtctccgaaagtgctggaattataagcatgagtctaatcagctagagagtcaacactttcttacaaaacaagctttatgctagacgatttgtgctagtattgaatactgtacaggaaatgaaaaacagatggttgcatgggtgcccaaagtatactttctactgaacgtgtattacttttacatcattataaagttgaaaaattgtaagtgaaccatcataagttgtgggctgtgttcattttgacaataaattatgttctgattgtacagaagcgtttatcaatcataagagattttcttcactggagacatgtgtaataacattcattttcctgtgggacttacaaattgtttcagtagtttatagccataagctctacaagtagtttatagctattaatgctttaaacgttatccagaatatgcctctatgttcagaaatcatggcttttaaagacttcaatcaaaaaaggttaacaaagttctaaaatccaaaaataggcttattttaaaattagtttaagaagaaacattttcctctaccctaaaacttgcattaaagctttgttttgtaatgtttctttccactcttctccaaaaaaaacaagcaaagaaaaaagatgtatccattaaaatgtctactaaactttacttgggttgcattttgtacagaaatatgttttattgctttttctatcaatcattcaatatcaaaagtttttctttctgcttaaactacaccttgtcatacagaagaattaagccaagttatttatggcagcgtagttttctctttatatgaccagctgtctcctttttttctgatgccttttcttgtttttgcaaaagatcacttaagaccttgacagcatcattaaatttattatcttgtaaaaagctctataacttaaagcctctaggcttgtgtgatgtctttttataaaatacattcctctttcctgtcagaaagttgaaagtatttggccattctagagatcagttttccaattttcagtagactgaagagagctttgttctctcaaagctcctcgcaggatttgatggttcacacacagttgctgggagaatcataggcctttacaatgggaagtagcattggaatcacagccatcaataccttgaaggactagagaaacatccctagaaatctgaagcttctacttcgtgtcacttgcgccgtgaaccagcttagtcgcctgctagggagaagagtgctgcctccaccgttaaactgtgcccttagagccatagcatgtcagcatctctcaggttctcaaaggcagttagacttcaatctggtgtttcagacactttgacccctaggctgttactttatccacattcgttaggatacagcctagcctgctgtttccctctctgcaaattgcatgaagtacatttcaattgagctttacttgctgtgtgtttaaagactagaatataatcattgtttcctaaaaatgtcaacactgtttttgaatattggtaaaataagttgatgtgtaataggagaattctgaaatgacaacataaaattctatgatgttaattctgcactatttcagaaaagaatgtttccatgttttaagaaatctcagatggattaaagacttaaatgttagacctaaaaccataaaaactctagaagaaaacctaggcaataccattcaggacataggcatgggcaaagacttcatgtctaaaacaccaaaagcaatggcaacaaaacccaaaattgacaaatgggatcggattaaactaacgaggttctgcacagcaaaagaaaccaccatcagagtgaacaggcaacatacagaaagggagaaaatttttgcaatctactcatctgacaaagggctaatatgcacaatctacaatgaactcaaatttacaagaaaaaaacaaccccatcaaaaagtgggtgaaggatgtgaacagacacctctcaaaagatgacatttatgcagccaaaagacacatgaaaaaatgctcatcatcactggccatcagagaaatgcaaatcaaaaccacaataagatactatctcacacgagttagaatggcaagcaatcaatcattaaaaagtcaggaaacaacaggtgctggagaggatgtggagaaataggaacactttcacactgttggtgggactgtaaacgagttcaaccattgtggaagtcagtgtggccattcctcagggatctagaactagaaataccatttgacccagccatcccattactgggtatatactcaaaggattataaatcatgcttctataaggaaacatgcacacgtatgtttatagcggcactattcacaatagcaaagatttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacacctcatgttctcactcataggtgggaattgaacaatgagaacacatggacacaggaaggggaacatcacacaccggagcctgttgtggggtggggggagtggggagggatagcattaggagatatacctaatgttaaatgactagttaatgggtgcagcacaccaacatggcacatgtatacatatgtaacaaaccctaaaacttaaagtataataaaaaaataaaaaataaatctcaagtttttaaaggatatgtttaattctacaaagatattcttccaaatagagatatttccattttaatgtgaatttaagagacttttgactgatcaattttaagcctgctgaagagtagtaactttaaaaacatacagaaggtatccttttctatcttgaagccactagtctgcaattattcagggcacaaatactggttctgtatttgctttatgctctagaaactttaaaaaagactaaatcacattatttgtgtcaaagcactattaagtattattacaatcaaaacttgaatgtatttagtaattctatttctttgttttctagtgatttcattttaagtcaaagcacagccaaaatactacgaacaaaatgttctaatcaaaacaagctccaaacattcagctgatgaaaattacttctccatatatgttgcatgaattacgcagtcttaatattcttaagaattaaatcctatgtatcttctaacaatattagagttctatgagacttgcttttagctttcaagtattcggattagttcttatcttccaaataaagcacttgtgtttcaagagaaccggctccagacttaatccattttatacattaggctgaacaacgagctcacagtaatgtgagttttttcagcttctatctgagcaactcttgagaaagtagtttcatgctcaggtgagctctgaaaacataactgaagaaaaggaatactggtcatttttgaatctctgatatattttctcatgagcaactgaaaaaagcttgaagtatttacaaaaacatactatctatctgttaattttacctaagacatttcaattgggataatgtacttctttggcaaaaatctctttaagaatgactctcatgtgaaaaaaagggacagtgttttcacaccatttccttcagtgtaaagaactgcattaaaaacttaatattgctttttattaactctatttggattcatctgaataggaagggagtttcaaaggtaattggttaaatttattttttatagttcacttgagaaggaaagttcattaataatgaatttcctgaaatgtgtgattatttcctgaaatgtgtgattgttccatgttttacaatacatctctctttattcaagaatgaaattctaggtgaagtgagtgtgtgtgtgtgtgtgtgtgtgtgatttttaaactatcttttaaattatttatggttttttaagctacagatgctattgttttcaaattgagtcctcttgttagctactattttcatttaattcattcaatttttcccatatattaagtttttgctgacattattttgtaatcctatgagcagccccatggtaagatactccacatttttaaaaaatagcaatagcaaacaggttgttgacaatgtttaaacagaaatgtaaacttctgaacttaaggtaaaacatcaaaaagcctgtaaatgtccagaatgaaaatcagatagccaaattatctattttttggaactgtcttattttttatcaagcaaacttttaataaatcataaagcaagttaatcatacctaagaatttaatgagtcaatcttgaaacattttataattttaaatacattacattaatcccaagtgaatttaatgctggttgtactttgatcttgtgcagagcttccagcaggtcaaatagttaatatcaattctgagacgtctcagtgaaataattcaaattattcactttctcactgatttttttaccactatgcacgtatgttctctgttgaggatatttaaaactcagagtgggggaacttggggcaagaccaggatcaggcacctacatggatgaactgaaataatttcactctaaattcatctttaaatacatccagttggcaaatattgttctaacttgtacaaggtggtaagaacttacaattaggtgctaactatatactgtatgtattgtaacatcaccatgtgccctgtgccccatgaatatgtgtaataattacttgccaataaaaataaaggaaaataatgagctgtaaaaaaaatgttttcaaatctatcaggaacttttttggggcatggtgggaagagtaaaataaaacggctcctatcttcccctgtctaatgaatgacagataggaaataaatacttataaaacaacacgatgaatgctatggtttgcgtgaaggttgagagggacaaaggaaactagtatattggtagctggaggggttcagtgagccttgcgggagagggtttgagcaggtctaggggcctcctggacgccatccactcagagggagaacagtccaggtggaaaaggcttcaaatcgcatggcagttgggaacaccaatttacaggaacatttgtatatgctgatgcttccttttaaacgtgtggcggttgtgatggagacagggattgaagggaagacaggaaaggtcacgggaaagactggaaaggactcggctgcagcaccaaggagtggagaccaactcagcgtgcagtggggggaaggcaacggagaagactgcacaggaaactgacacaagtatattcgtatttcagagagataatcagaagcaatgtgcaatatggacatgggtgagaagaaagaaaggacaagcaggaaaatctgcaaaagtatttatttagtgctggaaaggagcctgtgtcagtggatgtggggaggggatgaggcaagagtgtgtgcgtggatgaagcatgcacaaatactattttgcaaattgagcctgagtgagagtggacacagaagactcagtagatgatagatggggtctgtgatgaagagaggacaccagagaaaaatgcagctcatgggagaggtgagggaggaagaggagaatcatcagcattgttgtcacataatgattctgatcttctcatagcagatcccctgtattaacccagaaaaggaatacatctttcattgataacacctgttatgaaataattaaaaataaacatgctttggatatgttaggagcatgaggagcacagagcgagacaatctcagtccttatggagtttcacagggaaattagacatcctaacaaatagtaatcgcaataattacccaagctataggcatagacagtatgagtcaacattgacactcaatcacacaagtgtggacttgtattctctgttgttctggtgcctgttttctattacgttttctattttttcccaattaagtgtttgttttgttgtactcacttctttgtatagcaaggggtgaatagttaaaaaataaaaagcccagaatgacttaattttgttttgttttgtttaataggaacttctgtgtgattgtgtaaggatggctccttttgtcaggtagaaccagcctacagttatctggttaatactacgtttatttggtatcattacttgatgtgttcacaatatcatgccttgtacacattttaactttaaaatgttataaattttgtgtttagtaaaatttcatgtaaaataaagttgctactgtataagtgaacttttaatgttattttttgagacaaggtcttgctctgtgacccaggctggagtgcagtggcgccatcttggctcactacagccttgacctagcaggctcaagcgatcctcccaccttagcctattgagtagctgggaccacagatgtgggccaccatgcccagctaatatttgtatcttttgtagagacagggtttccccggctgggctcaaaaccctgggttcaagtgatctgcccaccttggcctcccaaaatgttgggattacaagcgtgacctatcacatttggccttctccctgaatttatttttaattatgatttctttcctgatgatgaagctagtaaattatatatagtaccttaggcttgtaatattctatttttatttatgaaatatctttcatagtataacttcttactataatgttttgcttttgttccaattttttaataggtgttaaaatgaaaaaagtaatgaaaaaatagaaaatctctgtagttctctaattgagaacataaatctggagtagcatatcctctggcctaccgcattgattcattaatgcaatcacttagcatatgaagtgcctgctcggcttcagatattttgctagacgccgaagatacaaaattaactgacctcagtccttgctcaccagaaactcatagtctgtgtagataaaagataacatataaaagttaacatattccctattaaaaggatgcccattcattaattcaacacatacttattaagcgcttaatatgcagtatctttcgtgacacaatgctgtgtttcaatgtataagcatggttttgccctttgggactcagagtttaattggaggtattatagcaggtgcatgacgagagtaagaaagcatttgctttttgggtggtggtcacaggagttccctagctggagtgtcacggttccttctgcagggtttctgtggaagccagatccgagcacagggcagcccacacacacagacagccacacaccaagaaataaatgcagctgcttccaaaggagccccctgtgctttccacggggcaggtgggtgactgtaaactaacacaggtcatgcttgatggcaggtgctgctttcagctttacaaataataaaaacatacaaacacacacacatatgtgcatttatacaaagggagacccagaaacacaacaacacagattcagccattcctatggatcactcccttacacagaatggaatttgattatcctcagaacatactgcaaaacaaactggggatgtttatgtgtcttgcatccagataataactgaagaagtaacttccttgctgaaaaggcctagcttttaaaaaaaatctaggaataaatggtcaaaaaaatgaaactcacatatttctgtttttagctccaaaaactactaattgcttaaaaatatcttgactatcccgagcatttgattaactagtgttggttctttaggatttaaccacagggattagaaccactgcagagtcttcatggcaaagtacaaatgaaaatatttgcaatacacaaagaatttggtataattttatgtcagtcaatataagattcaaattaaacataattgaaaacagagtttgatagcttgagtaattaaatattaatatagagccaatatatagaaaaaggtggcaagtaaaagatagttctaccaatatatcccaaataccataattaaaatgtatctaaattatattgaaatataattctatgctttcaaacacttccgcacacattcaacaataacttttaaaaagaaacatgagagtttctgtgaaattgaattatatgattatttttaaagatgggagaattctcagattatttgtttttttttgcctgattgctgaagaaaaactaaattgataaaaatggtaagaaaagtgtcagaagaacattaggaacacgtcagccgggctatttttaaagtaattcttcattagtagtgtaggtttctcagcacataattttaattttcattgtctaaatctcagtaatgcttatatttatatttatttgctcttagatgggaatatcaaattgatgactcattaaaaaaacttttattttaatggagaaatagcagctctggttaatttattgttatcaccttagacttaagtctctaccagtggcttagaaaccaagtgaatagaccgggccccaacttcaggagtgtctggcccagaacctcatcactaccatgaactccagcatagaggggctgccaccagcgcacacagaagacatgctctgtgccacacaattcatcaggcaggtttgtctgtgctgtcccatataatcctgaaaatcacctacaaaataatgacgattataagagtccaactaagcagtggggcccgtggccctggcactagtttggagagggacggaggatgagaagaaatgggagacaactgagttcttcccaaattctgtcccggactcagccctcacacaccctgcccctgcctcgtgcctccttcacatcttagctgtgaagggcactgcttattgcttggctcccccatgctgtagcgatttttacaagaaaaactaaaggatttatgaaaacacgataagctcctcgtacaagtaaaatccatgtaaatataagggattatcaacaatacctgaatttgttgctgctgttatgactcataggctgatactttttttattctacaactaataaatacaaagaaattgtcccaccatatgtaagaattcaacaccttgagcagtggagccaggtggtcaattccagagaagtgacagcctcaactagaccaccgctgcattgggacgcaagagcgcagttcctccttttccatatctcattctttgaaagaatttctgctgagtgggtgactgccatccatcagcctaactgtggcttgcaggtgccagcccatcctctctgggcttattcctgaggcattaataacctaagccacccgcctgcagagcgagggcgcagggtcatcctgcctatggggatacaacgcctgcttgccgcacacttttgcccctgacatgcatattctgcacctcactgaccgtaaagcgttcagtagcaaaatacaaatacaaagcaaaatggagtacgtaaccaacatttttggaaataaaggccgtgagttccatctcttccccaaaaatggcctcgcttttgtatttcccagttcatctgaaagacacgcaactctcaatctcttccacctttgcctcccttctttccactgctcctgtcaacctagccaccgaaggcgtgcaaagccccctgcacccaccatcaggtgggtcgaatcctttgctttctaagcttccagtgcttagtctaagccttcctcactgcacacaagattgctgttgttgctgactaacgggtcgccaagacaccatggtgagtattcaccctggtcccagtcttctaaggatcctgccatctggtgatgccctctgcaccagggctcatgatgctttgtgccgtagtattgtccagatcctccctgccctttaagatcaagctcccttacggctgcagctgtcctaccctaccctgcatattcctcctgaaggctcttcctcctccctgaatttcctgtgaatcccaccacaagtaggcaatgacaggtgctctgcgtgtatctaattcttccaagtttccccatgcaaataccccattacttcgtctagaaatgaacctccctgaacgcacgggtagcccagagaacatgcattgtttactgtatcctctgagtctggcagtgaaagtggaaacagtgaaatgtatgcatattactatatttaactggtgcttattttaattctagacaatgtgtctgtaagtgcttttgattcaaataaagtagtaagcttctagtgatttcaaagtgttataaaaacacaaagttaactgtattttctaaataaaaataagtgagctgattttcaaaatcgtgaaaataaatgtgtttcaaattttaacactttctgatttgtacaaaatttgggaggatttaaaaatagcactcaaccagaaatatgcaattaggggaatttcagaatggattcagtattatttagcaaacctaaaatggaacctacacagtttcataaagtgtttttctgaagagggaattccatcagctttcattacatatcagtgtggaaatgtgtggtgacgtatttacataataaacatttccatggattattttacataatatatgaaagtcagtgcagacatcttcagtgttatgaataccaaatactgttattttggtcataatgagtttgaggatgataaatgaactgacaaatatattcaatacatttcatggccaggaacatgaataacagcacagatttccagcaggagcggaacattttccttcacctcctgatgaatcattttatttttatattttcacttagagccattttattcctttaggtctgttacattttacagtattagttaaatgactgaacattcaaattaataagaacatatataagaatgagcaatttcttagtatttccttcaaatcttgtactaagagcacagataaagaatttcttcttccaaataggcctatttcatatagatcttgttttacgctaaattgccttaagggttctggaagtttccagaagagagagctaatccatgcacatacataactacctatggaactttcttgtcttgttccctcagttggtttcattggccagaatgtataatgcaccaggttccagtaaagtgaccaaagttgtagggacgcccctggtcacctggcctccaggtgtggttgcattatggaggtgtcagacttcatggcagtggagtccacagccagtggggcaaggttgcccatccagggcatatcacgagtacccgtacttaacccgcaaacctcaaacatcaccaaggaggcatttctcctgtccagtctgcttacaaaatcatttccttattcttaacaaaggaaattgatttctggttaacataatggcaaatgcctgacttaggaagtgctgtgattcctagataagtctctgaattgttttttgcttttttttgtttttgtttttgttttcctatggaacttaatgacactgaagccttcctcatcagaacctaaacctcacagtcatggtttattcctttcttcatctcatttacaattcaagtcatcactgtcctataaattatgcagttttaaaaacatctgtcatttatctttccacctctaacattgtgtttttgtctaacattgtcttattagtaggttgtatgatgtccaatgggcaacttctaacttcgtgggcatctataatctatggttcacatcacagcaagattaaaaacctaacacaaatgacaagggacctcaacattcttgcacccttaataaaatcttacctctctctatttttaccttcaataatctacccttccccattttcccaagtcttacctctaaataaaattttatctctatttatttttaccttcaataatctacccttccccattttcccaagtcactaatagtcatcaaagccagaaacgctggtccattctgaacccctctctctctctctcacatactccacacccatgatcttactcacaccatttttagaaggagttaaaagggaaacttgcctaaaaccatcaaaagaaaactttaaacactctccaacagttaaaatactctttgattttttaaaaaaattttatagcatttcagtactaagagttttcaaaaacaacgttgtgtttacagaagaaacacatgacctgggatatgacagatgaagcagcaggtaagtagcagagccaagaggcccacatccaaccccagagacccaggagggaatttccttcaccccacctttcatcattgttaaaataggcccacatccaaccccagagacccaggagggggagtttccttcaccccaccattcatcattgttaaaacagacacacatctaacacccagagacccaggagggggagtttccttcaccccacctttcatcattgttaaaatagacacacatctaaccccagagacccaggagggggagtttccttcaccccacctttcatcattgttaaaatagacacacatctaacccccagagacccaggagggggagtttccttcaccccacctttcatcattgttaaaatagacacacacccaaccccagagacccaggtgggggagtttccttcaccccacctttcatcatggttaaaatagacacacatctaacacccagagactcgggagggggagtttccttcaccccacctttcattgttgttaaaatagacacacacccaaccccagagacccgggagggggagtttccttcaccccacctttcatcgttgttaaaataggccacacctaacccctgagacccaggagggggagtttccttcaccccactagtcgtcactgttaaaatagacacacatctaatccccagggacccaggaaggggcgtttccttccccctacctttggtcactgttaaaataggcccacacctaatcctcagagacccaggagtgggagtttccttccccccaccattcttcactgttaaaatagacacacattcaacccccagagacccaggagggggagtttcttccccccaccattcgtcactgttaaaatagacacacatctaacccccagggacccaggagtgggagtttccttccccccacctttcatcattgttaaaataggcccacaccccaccccagagacccagtagagtgagtttccttcaccccacttttcgtcactgttaaaataggcccacatctaaccccagagacccaggacggggcgtttccttcaccccaccttccatcatttttaaaatatctgacggtgagtgttcaatcttggcatttactattgaatggtgctaattgtatcacttcagatctttgcagatttcaagctcaatattcccaattgccttggtatgttttcatgttcctcggtctagttgcctggcactggaatttaattgacaggattattttcatatcagtgttttctgaaatttttacttggtttaaaagaaaaaaaaaagcatttgttgtagaaatacaaataggcttcaaatgtttttatgtcagaatttgtggagcagagaaaaataacaattttgaatctgaatcgattttagaacattttttcttttaacgacatcattaaaaatgacctacataacaaaaatcaaaatcagcaacagcatgacctgtgaccccttacccagtgttttcttcctgagacggtgtccaggtctccaggctgtttaacttcctacaaatgaaccttgcaaatgcaatgcatccatgactgactaatacaatcacaatcactttttattacccctagagaagaatgggaaaatattctgtcatcgctcctatcataacattttagattttatagcatttgatgataccatctgttggccttcattttatttcacacttaagtcgtaagccttgagttggatcctcataattacattatttatgtcatcctcctctaggtccttttgtctttctccaagtactggtggccaacaacttattcctcaattagttccacttgatgaaagtaaataacaaggtcgcctgggcatgctggctcacgcctgtaatcccagcactttgggaggccgaggcgggcaaatggcctgaggtcaggagtttgagaccagcctgctcagcgtggtgaaaccccgtctctactaaaaatacagaagttagctgggcatggtggcaggcgcctataatcccagctactcgggaagctgaggcaagggaattgcttgaacccgggaggcagaggttgcagtgagccgagactgtaccactgcactccagcctgggcgacagagtgaggctccgtctcaaacaaaaacaaaaacaaaaacaaaacaaaaacccaaaaatgaaagtaaataacaatgtgaatccactatcagatcatcacaaaatataaagaataattcattatgcaaataagaaaaaataattggcaaaactaaaccttgcaggaaattattcaaatcaatggaaaagctggtcctagactgacatgacctctgtaggatttgagggcatgacagcggtcacccgggtgatcacagacccttattaaacaaatctcccattacagccacagaatgcttggcttcttcccacagaatccaagcacagaatggtttcagtgggacgttcgacaacatcatacactgacagttccgtcttcgcgatgatatacatgttggtcagttagcaaggatgataaaacatcatattaaactgtaagagactggaatatatgcccacctctacctctgatttgctttttgacattgagtacatcaattaagcatcatcttgtgtcactgtcttttcttacaatggtcatcgtggtaccttccaccttcctccctttgagaaatggatgaagatttatgtcctgtttttagggtagcctcaccttgaaacagacgaaggtatgaggtgtttcggtttcagagcactaccgtgctacaaagacacatcccaaacttgccctctcctgaatgttgtcacgtttggccccaagtgccttatgttttacagttgttacacatttgttttcaagcttaaaatagacacataaaagtaaaactttctaacgtaaaccaggaattgtatgtttgcattcccagagatggggatgtcttccctccttgtaaaatgcccaccttgtttcataataaatttcctcttaggtactctcaggcagcctgtctccctattgtattggaattgcttagactgcctcatctattgtgatatttccactgaaaatcattctattgaagaatattttataggctttcttttcttatagcagaagtgtaaaaatgccttttcaggattcttacaaggtgtaagtttataaaaatgtatggctatgtcttgatacattgataggaaagttttgctcatgcctgtaatctcggctcttagggaggaagaggtgggaggatagcatgagcccaggagctcaagacctgcctgggcaatagagcaagaccctactctccactaaaaggaaaaaaaaaagacaaaaaataaaaacaagtggaaaggttggcaaggattcaatcacagaaacacgtgcagagtcatcctcctgtctcatcattggcattaacacttgacatctttacaataccatctttttttttttttgaaagagactctctctgtcacccaggctggagtgtgcagtggcaggatctctgctcactgtaagctccgcctcccaggttcacgccattctcctgcctcagcctcccgagtagctgggactacaggcacccaccaccacatctggctaattttttgtagagatggggtttcaccatgttaaccaggatggtctcgatctcgtgaccttgtgatctgcccacctcggcctcccaaagtgctgggattacaggcatgagccacctcgtccggcctacaatactatcttttttatagcacagaaaattctgagtttacaagttaattttcctcttaacatacacatctttttattaacataatatcagtttaatgtctgttagaaatcaacttttctttctccacaactgaatgtcaccatgttgtactcaataagaattcgtaggataattgtttcagtagtgacctgggaatagtaaagtttgaggtagaccactcattttgggggaatagaaccgaagaaatgagcacatacagattacttttagataaggaagtaaagtaactttgttagatttaagtgcttagtttattttttataataaatcagtttatcttttaaacaaattgtgaaataagtaaatgttgtgttttttcctttagctccgggtcctcatttctcttcacctgcatatgccctgtgtccttctgttggtcttccatggatattcactgtgacccggatcctttaattgggtcaccttgaactctgtaaatgaccaatgccctacctagccctagcccagaatgcatctctgtgtataattggggcatctccagcattgccagccaattcgggttccagtttccagaaactaccctgtccgtctaaagcaggtaaagccatccgctttctgagactcacaatgagggcatcctgctgctggtttgtttctgctattgtgattcaatgtcaaaatccaagccacttactttccctaaacctggttcttggatgcatctctaattaaaccgatgcctccttctgtgtctgagcctctaatctgacagtctgcctgtgtcctacattcctgtaagcataggttctgcttcataaatgctttttccacattggcgcttctcactggagctctgcctgcctatatgctgcttaaggcacctctgcttcctctctcaatatcatctgaccctaagtgacttttacagtttatccacctatcagaatttgtgtgacctcatattgggcacccaatgctaaatatctgcacagaataccttacaaaattttgtctgttgctacaccctccaaatacttcaaatattgtgttcagactgtcatatgatcttcggcctaaaatgtattcctgtttttcctggcccacagcaatgatcagtttcaatccaagtcgctccaatgtacatatagtgggctatgtgtctgagggttcagaaaatatcctgttatcatatccacggtcttatcagagttgacaaaaatacacaaaatacgttggcagaggatgaggttcatgtgaaaccgacaagacagtaataaaaaacaaagagaaaaatctggcttttgtcatccaatttataaacaaaaaatgtgaaataaattttaaattaaattggggaattagttatatatgatatcttttaaataaaaggcactaaactcttagtaatatccatgaagagtcttaaggtcattatatcattccttcaaaataagacagcaagtattttattataacgtgcttgggctcaagtctattacatcccagaattccattatcatgtaccaaagggaagtgaagaaagcatcaggaagaacctagggctgaaaaaatttacctaaatatggaggctgctgttggcatggaatggaggtggaagatatgtagttgagggagagagaagatgccagatgttggcatagaatggaggtggaagatatgtaattgaaggagagaggcgatgccatagcactcaagagggcattgaaaaatgaccttgttttaggatattatcaataacagaggaggctgagctaggaaagtggtcattgacagcaaaagtgaaccctataagacacatttccagcaagcaaaggggactctggacagccggacccctaagagcaggcttcatcatgacccatttgcagcgtgacagagcccagttctgcaggagaaaggaatgataagcaggggacagaaaagacccttcaagcagatggagagttcgagatgtgttccacattacaggggagcatatatgatgaacggggaaactgcggcagccacacacagactactgttatctagttaacatcttttccccatgagaatgtgcagcagttcccttcccaaggcctatgcaatcacagacagccgtatttacccttctcatgtaccatgagtgcgtccccttcacaggttggagctcaggctactacaaaggtctgcctgccatcaaaagtaaagccccattaccagaaagagttgcccagccccggggccgcatgggcctgcaggaccagtgctaactgaagagtgtgagcagaggccatgccatcagtctgtgcagggtgatgcattgtgagtgagccttttctgccttctctccttgtctgctaggggctaacttacttgctaggggcacagggcacagtgcctatggcccacagtctctttagaggctcatggaaatgctttgatttccttaaatcagaagaaaaaagtaaatttctgggttaaagaaactgtattaatatacaatcatctattgatagttataggcacacagtcatgagaagaaatgtttgatgttttgtgtggaggaatggactgtataagaagctcaagcccatggcagtcatggtgtggccccatccctgggtgcagctcctcccaggtcaaagcagggtagtgggtagagagccctgcagacagaaatgtcattcaagagatttctccttacattgataaacttcttcaattactatagcattcttcatttcattttcttagaaacaatgaaggaacatatggttaaaaacaacttgcctatactcagaggaacataaactgttctaccataaagacatactcatgcatatgttcgatgcagcagtattcacaatagcaaagacaaagactcaatctaagtgcccatcagcgagagactggataaagaaagtatggtacatatacaccatggaatactacacagccataaaaaggaatgagatcatgtcttttgtgagaacatggatggagctggagggtattatcgttagcaaactaaggcagaaacaggaaaccaaataccgcgtgatctcacttctaagcaggagctaaatggtgtgaactcatgaacacaaagaaggggatgacagaccctggggcctattggagggtggaggatgagaagagggagaggatcagcaaacataactaatgggtactaggcttagtgcctgggtgaccaaataatctgtacaacaaacccccgtgacatgagtttacccaaataacaaacctgcacctgtgccccaaacctaaaacaaaagttacaataataaactaagattaaaaagcaaatactttattttgaattttgttgctctcccatggatataggaatgaattatcagcaggtaggatactatagcaaaactgtttttattttttatttacctcatgaaaatgctaaaatattacttcttaccacgtatgagagatgacatcttaaataaaatatttcaaatataaaagaaaagcaacagtgccgggcgcggtggctcacgcctgtaatcccaggactttgggaggccgaggcgggcggatcaccaggtcaggatatcgagaccacagtgaaaccccatctctactaaaaatacaaaaaattagcctggcgtggtggcgggtgcctgtagtcccagctattcaggaggctgaggcaggagaatggtgtgaacccgggaggtggagcttgcagtgagccgagatcgtgccactgcactccagcctggccgacagaacgagactccgtctcaaaaaaaaaaaaaaagaaaagcaacttccctatttagattctgatttcagactgagggagcaactaacgttgatatctgtggtaaagaatcatgtaaccagaggcactgatcaaaatcccacataatttcagatgtttgctaacagtggccatgagttggtggccatttttatctgatgcggtgaaaacacagaatgcttatgatgtatcagtgggaagctcttgagctttggattatactaacagggtttgaatcctggtgctgccactcactaatgataggaccttaacttatggaaccctcggtttcctgtctttaaactgaaaataacaaaaggatcatcttcaaagggctactttggagataaaatgagacaatgaatgtgaattgcctggcacgtggtcagtgctcattgatatattatccaatatttctcttttaccatggcccccaaagacacagctggcggtttctcttgcgtatgtacctggaatgaacttggtatctgaccttcagggcttcatgccagatctttaaagttaccgtgtgaatgatatattgaatagcagttactcctatttctttatgtgtaaacttgattcatttcaatgtacaacttttctggcctatgtaagagtagagtgtcctgtcctccagagagaaattcagaagatcattgttgacaggtgactgataatagatagctagatagataaaaacagatcatagataaataatgatagataattgcctcgtcaatcagtagatacatatgtaatagatggatatagacagaatgataatagatcatagattatcaatcaatagatgatcaattaattgacagacacatgatagatacgtagggatagatgatagatgatgacaggtatgatacataaatgtaaatgtttgttgagatatctattagatgcacggatattatccaaaactactgcttgatggcatgaaaacaatgacttttccttaaaacgtcatctctaagattaaacattgatgacaattgtatcctgccctcttgctttgcatgtgaataagaccctcttgtaagcttttcctagcagagaagggaaggtggggttgctgagggcttgcccgctcctcacccacctccagacatctctgagtctctccaggtggggcctgaattagctgggaagaggagaggaggggcctggaaggccaaccggagctgcagtgaggctgatgcttagggaagatcgaggcacataataaaactatgcctgtgaccattcagaatgtcaccgctgaaacctgttttatttgcagacaacagattaactactgtaagctgaaatatttcctgaaactttaaaagtacatgtaagcaatgaattgtacattccctttattaaatatatactttatgtcttcaagtgtgtgtgggagtgcgtgcatgtgtgcgtgcgcacacacacacactttattttaaatgaaattatctgagatggaaggaaaacattcctaaataggaaactctgacgggcagatgttgcagggaccctgatgccctcacctcctgctgctccaaccctggatgtatgaatgattcttctccttccttgagtgtgggcacagtctgtgacttgagctgacaactgaacatggcaagtgtgagagcaccagatgccacggaagtgtctgttctgtcgatgctgagtttgtcaagatacggagcctgactcaatccagggaaagcccttgaaagagggtctggcctccatgaggtgagggctccccatggctttggagaagccagcaaggacacgccctgcccagagaagaccacagccacgtggcagggaaatgccagtggcaccaaggagctgggagtctcagtctgaccactgtgacgacctgagttctgctgacagcctgaagaggcccctgacactcagatgagaccacagcccagccaacacctggtcacgtccttgtgagaccctgagagaagacccagccaagccgtgtctgggctcctgacccacggatgctgtgagataagaaacggtgctgtttcaggcccctacacgtgtggtattttgttacagagcaatagaaaactaaggtacacaacactgcctattatttgaaaacactttaaaacactttataaaattatctacaagttaactgtgggaaaaacaaacactgcttattggatattttcccaacgtttttctcagctaggttaacagctatgtaaaaacaaaattttgccgtaagcttttatttacaaatgatatatagatactgcaatttacaaactacacagatactgcaatgccaggagtagatattagagcagcataatatgtttgccataatcttaatctttattgaaataagtaaaaatctgtgagtgtggatttacgtgcaggctgaatatttccttatttttataaccctattctatactttcccctggttcttagcatggttgtgaataatttttaaaactactcactggatgaaaagatgctttgactcaatttcctaaaatataatacaccgtaaaaagcaagaaggcagtgaatgctattctttgaatactataatctcttttactttaaaacagcaatgcttacacatcacaaccaagaatgtctgggaaatctgtgagtgtctttattattgacaaaattagattgtagaaaatgtgcatttgaggactgcccctcagcttgtataggatttccaaaatctagttcttaaaaagaagtaatcaatgatgacatggacccatcgtgatgcccttttatatcttactcatagccagggaggtgaaggcattgaaagaatctatatgagacgcacacagagtgtctactgatgtgtttgggtagagataggtgggagaggatgccagaagaaaatgacatcaaccttttcaaggtatcagtcaatcctataaagaaagcattatctctcttgatcaacgcataatttcagggactccaaatgatggattctgacataccctgctcttcaccttcaggtttgtttccagtaattgattgcattcagcagctgtgtacacttcatgcttgcaatattttctccttgttttcaagcaccaaaatgacaatgcttagtgcttctgtatcggtcctgagagtgtattcctgtccaaagccactctctcatttatagtagtatgtttaatgttgatgtcatttttattttcaaagccactctgtcatttataatagtatatttaatgttgatgtcatttttattgtatcaatgtgttaataaaaccagcatgacagctacataaacccacagctccatgctttaattttcgcatccacaggctacgttgtaatgtcttcagaattagtcgtcaatatcagatcacccaccttcaccttttacttattgtggcaaaaacataaatatggagctgcagtgcaaacggctgcaaatggatgggccattttacagaatggatgccattcttttttatttcacattgaatttgcagagtaagtagagtgggacttcctaggtctctctctaatgttctttaaactgagtatgaccaggcagtctgcagatccacactgcaggtggcagcacagcctgctggggagctgcaatgtgtcaccactgggtgatcccattgcatctgtagcacggctaagagcgtcagctcctagtccaacgagccttctccaaaacacaactcttgtaataatgctcccctgaaaaaagtgagttaattctaggagatgatactgtctcttaaacatttctgatacagctcatggcagagtgagaagtatagctatgactcatgaaaccgagaggagcccaggaccctggaggtgcctgcagtcaatggtggttggacatcctacaccactatgtttctctctccctccctctcatgtcacttgttaggggtattggtgaaccagcctctaatggttccttttgcccataccctctgctctgtgttacgaattcacagttccaacctctcagtcactgtgatgaccgtgccatgaagagcacagtgacaggatcaatttcccctccatcacacacagccagtggtgtgtgtcccaacgacacaaatggtctcacatttcatataagaagaaaggtttggccaggcatggtggctcacgcctgtaatcccatcactttgggaggccaaggcgggtggatcatctgaggtcgggagatcgagaccagcctgaccaacatagagaaactccgtctctactaaaaatacaaaattagccgggtgtggtgttgggtacctgtaatcccagctactagggaggctgagtcaggagaatcgcttgaacctgagaggtggaagtgcaatgagtcgagctcgtgccattgcactccagcctgggtgacagagtgagactccgactcaagaaaataataataataaataaaggttaatggtaacaatggcttctgtgtatggaatgtcacctaagagtagagcagacacagagctggatgttctatacaatgtcactaattctcacaacaaatctgcacagtgctttactattatttgcattttgccagggtggagactgggctcagagaggtgaattcatggatggaagttcaaagagcagaaggtagaaacctgatccaaggcttctctgttctcaaaagtctggccttcctacccagcgcttgtagatttttattttgggctaatttacatgcagaggacgatgagtaatccttaagcctagaaaacatttctcccataggactgtgttgaggttaacgtacaaagtgctttgagtaactgaagttagaaaaaaatccctatccctcctgaaccatggaaccatgggcaggtttctccaaacctctgttccctcatacctaaggcagtagaaaaatagtaactgtggggttttcatcagtattaagttagatcatagcaaggccttcgtgtgtgagttacaatacatgctaatcagtccctttgcaacttggggtattatgagtgtttccaaggcccctgaaccctgagaactgtctccacttcccatcacaaattgtaggcattcctatgccaagagacatgtgtcaccttctatagcctttttcatgacccctgttatacagagtctgaagaaaaacatacttaaattcatatagcacttggatgttttcaaaagccatttcatatgtgttttctacataagttagaaaagtaaactattattgtccctgcttcacagataaaatcaacactgggaaaaagtgtggtggttgggattgaacagagtaaggaactagaggaaagatgctttaccccgctctgattttgtctcactttaccacagagcaaggggcacactgagagcatgtacttcatcacagagccctgtgcccccatccagacagaggacccagagactgttcccgatgtgggcgagagccctgcacacctaacttcctgttttcagaacagattcagagtcccgcccccagctgcatgcatcgctggccctgggctgtgtgtgggcttccaggacaggcacagctcctgtctaattcatatagcacctggcattgaccttaatctgtagcatgtctgagatggtcagatcctagtccaacaagccttctccaaaacacaggtcttgtaataatgctcccctaaaaaaagtcagttagttctaggagactgaccttatgccagttgctatataaattagacaggagctgtgcctgagggtgtgtcctgtgaactgtaactttctggggaggctggagctggggttggccaggccttgctgtccccctgcctcaaaagcacagctgactaatcccctggaaccctgggcatgacaagaagaagactgaaaagggttcagtacatgactctgccacaaaccaacgcaacgactcgccctatccccatcttccgtctccttacttatctcaaagtctagaacctttcaaaagcagaaaatattttgataaacataccaatttggatgaaataaattgcttttattattcatcactttttaattaaacctttttgtatctattcagcaaatatttatgaagcatcccttagaagcaagccagggaaagtcattgttctgcataattacacccgtgcctgactctcagccacaaggtttattctacaaccaaaatttaagcttgcgtttattttgatggcttcaaagatctctttgcggttggcagtcttgcctaaacaatgagataggtgtaaagaatgacagaggatgttctcggtaagcgatggccactctttcatcaatgctatgtctaatgctgatgtacagggaatgcatatccacaaaaccagcgcctggacagagaggtccatggccttaagctcaaccatctcaaaatgattcaaagaccagtcttgcgtctgctgagatcaagtgctccctaggagtttgggcactgatcacacattcacctggaatcggcctaatgggtagagagaaagtcagcctatagggatctgattattttatgagtcattaaacaaaagtattcctttgagtggctctgctacaaacccaaaccgtaagtgtttatgatgtttcttctacctctgttcaaacttctgccaatataccctggccaggaatcactggtgctttgtggaagggaagctcggctaggttttccctaatgagcctcttcaccacgtctgaacagtagacacttctctagcttcctactttggcagatgcttttatttcccaagcgatatcattcatgaaacttaatgccaagcaggcgttgtgggattggaattgtgtccaaaaataaatgcaaatacaaaaggacccccttgaggagtctgtcatccctctgaggtgctaaaaccagccacaagacacaacgtatttgatatctgaatccagttgttgaaccacacgtgtatgcctgtctcatctccatgtccaggtcaccctggcatccacgcctctatgcccagggagtggcttagtcatgcgtgggtgctgggcgtttcttgacaagttgagtcagtgtccacagaacggaaactagcaagtgaatgagggcagtagaccctgaccaagtacataaataaaataatggaaattgtgtaaatcaaaacacagctaagtacaagaaagggatagacagagaattcaggatagtgatgaggggaccaattcaggatcccccaaaaatgaaaattcagcagggatgagaaatctggttgtggggcaggatgaagagaaagaattgtgaatgtccctatttccctgtctttaaattaaacactgttgttgccaagtgcctgggctcagagtcagggcctctcccgtgataccagctatgcagctgattcattttcagggctggccagtgcacttctgcagggtgcatcctgaggactgtaactttccagagaaagggctttatttttttctttttaaaataattggtacaaagttgccatatggaattgtggcagctctatcatgcagatccagctgttcatctccagcctttcttttttttttttttaaatttttatttttatatttttaattaactttaagttttagggtacatgtgcacattgtgcaggttagttacatatgtatacatgtgccatgctggtgcgctgcacccactaactcgtcatctagcattacgtatatctcccgatgctctccctcccccctccccccaccccacaacagtcccctgagtgtgatattccccttcctgtgtccatgtgatctcattgttcaattcccacctatgagtgagaatatgcggtgtttggttgtttgttcttgcgatagtttactgagaatgatgatttccaatttcatccatgtccctacaaaggacatgaactcatcattttttatggctgcatagtattccatggtgtatatgtgccacattttcttgatccagcctttcagtgtttctttggaatgtcgtttatacccatctgtaattcctcatccattttcacaggcccttcacttcaagcctctgtttgcagaacactttaaagatgttcctgactatgggttctcttctctatcaaaaaagtgagacttttaagagccaagggtaggggggttgccttaggaaagctagccagctgtctttcaaaagcattccctgggtgatttggtaggctcagaattctggttccatcggtgtacccaaaatagatttatctcatcagagggccaatgggactttaacatcagaatgccagttccgtaatttgaaataattgacgaagctggtccatgtaccggaaaccctatgtcaatatcaataaattactctcagagggctactctgatatccaatgcttctgttacttcaggtgaaactcttacttcttgcctgatacagctctgtggaccctcagtgtcaccagggaatacaatttgaatgacaatcatccattctaagcttcttatgtcacagatcacacatctgtgtaaggtgcgaagaagtacaaacaagtggacactcattgtccccgatttcacagagctatgggttatggctccattggacatcattatacaccagaagcatattatctggtatgaacatagacaagtctgtaataaaaagcagtgttttctaacgaaggtacacttttaaagttttattttggtctgacttactattcagaaaacagtacttgcttaataaatgcctattcagcaacgtatttattccgatttggcccaaagatactctggtttttcttcccaggcaattcctctgcatgtatcaatatcggtcaatatacttgatgcctgccaaatgaggatcaccgaaaatcgttgaaaataagttcatcagcaattctggtattcagttagaaggcctggatttgggttgcaattacaccactccctgtgtgcagcaaattactaaaatatctgaagactcggtttttaattcataaagaagagtagaaggagctatttcccaagacctggaattaccaggattgtaaagttgaaaggtccctaagtgtatgcttttataaatatgaagggataaagaaatattgtttgtacccatttctaaaaatgttagggtttttttttattaagctatatattttactctctgttgacattttctaatctactcatgtatatgcattaattatggatctgaaacatttaaatactaatgtttccttaagtagtgcaattaactatcaagaggcaattacaaaagtcttttgaaaatagctgaaagtgtctttacacagtcttaagcataaataacttgcgtaaaatattttatctaaccggtcatcatttctgagacatctttttggaataaatatttgattcaggtatttgatgaccttggggagctggggatttcttcagcttatttacttatatttacaactaacaatttaatgtgaggttaatactattttgattatatggccatcagcaccaccaattttctattacaaatatatcttcccaccagacagtatgttccagctctaagataatcttgcaaaggagacctgaggagtctccgggttttgcaggtggaacagaaaggtgaaacagggagaacaagaaaattactcctgtcaaattgattataataagagctaagtgccaatcctctccaatatttctttctcctatttatagaacatttgtgctactatgtaatcaaaaatgtctgtagaattggaaagtgcccacaaacagatgaatagattcaagcttttacaaagttactcagtgaagtggaagtgacctcaaaacttcctaaagtgatgctggatgccggggagcaatagagtcacagtatccatgtggggtccaggcagggctgagcctcgcccactgacgcaagccttctgggtgagggagggtggacatcaacatggaacaagccgaccacctatagtttccatacggtcacacggctctggagcacatggaccttcctaactgctacctggacaacagaagaggcttcagaattatggaaacagctcagtatccctacattgattccaagcccctgaaattccagtatgcataaatcttcttctggatactttttgcatcaccatgagaaaatgagaccaagtgtttacaaatgagaaatcattccaactggaaatagtcggaggaacatgggaaacagttactagggttggaaacgtaatgagaaataacacacgagctgagcacaatgtgttttttgtgaagcagccacaggaagggaaaaagtgagcttagtaacatcgcaaattgcagcagtgttgagagtgaggtcccaggagagagggaggatcccaggccaacgttttctgctctttgcccagggagccatagcaggggcaggatttgtaagaaaaagcaacgaaaatgtgttcagtggcaagagaactggaagaacgccgtaggtgtgcatggaacttccccgtaattagacaaaatttaatttacccacaggcttttcaaacagtttttcttctcaagtatctgtgttcctctaagactagtgtaggggcaaggaagcggggatgaagacatccaagtaagaaaacaaaatacattgaacatctcgacagggacgagaagtggaaaaaacaatcacaatagcattcattccatctgcaagcaaaatggttttacaagagctctttgagacatttctgagagggaaatcctggaaggtaaaattctagtaaaaattttataattataggttgatcttgtaacatcaattgttatcagtttattgtgcacaaatattaattcataggctttctatttactcagtcttttcaatggtattatcacaaaggtgaaaaactggtttcctcatgatttcagccacacttattctattttttggccaaagtcttacaattcttcacctgtgattttttcctcctaagagggatttgaggtgattaatcttcgtcttaggctcctggattagctctgggtctgtgggatgattattatcttttgcaggaccttttttgcctatccatcaaataaaggtatccatcactaacatacttttatgctcaaaaacccaaacttttaaatttctaatgtcatggtgttcagtatgatatagtttttacatttatcagatgagtgaaggatttgacaattttatatactttaaacattttaattaattagttaattttaattacttatccacaccaaatagctttttcttttacttcagaactaaaaatgctgaaagtggcagttatcactttgcaaattcctacttttgaaacacagcatctcttttatttccctgttcttttggcttcttcatttacatctttaaaaacatattccacattgatttgttcatacagatgatgggaagcaccgataactgggagctacagcttcaatcctggctccaccaactcttaaaactgttatctctggcaagtattcaaagtattcctcttagttctctcgtctcaaaaattaatggtgaaaagaaaatagtttactacatattatgtagttgttgtgtgtgtgtgtgcttatacatatatatgattaaatgtataaatatatgtgtgtatgtgtgtgtgtgtgtgtcattcaaagtctattacctccggttgtatcaaacatctcttctaaagccttcatatataagcacatgaatttgtatcaatgtatactataccccaatcaatatatttaagcccatcagatctaaaatgttgtaagacgtttccttttcaggtccaactattttgttatttgaattaatatttccaaatagataaatttcaagctactagtaatgtgtccgaatatacaaccagtcaacagagtacagaattaaactgcaatcaaaaacacagtaggcagccagaaaaaaatcaatatttaaaacttaatataagccaagtatcagatatgtcctgacaaaatgaaaaaagaacgtgattaagtcgtatgttacttactggtataggtgagttgaaaaccttggtcggtgtcagatccattggtgttgaactctagccacaggtgattggatgtgctgtttaggatcagccccagaagttcatttttagtgaacgtgcccagtggacgtgaggaactgtcttttccatcatatacctgatgaaaattcacagcatgagtccctctatgccttcactggattcttatgttagcaatggtaataaacaatccaaatcttcaaagatgcagttttaaacaatacttaaaaaggcatatagtttacagaaagataaatgaaggacttagagctaaatcatatttgttctttaaattttatctttaccattaacactggaggcaaaagattccattcttgttcagatcattttatattcattactttaagagctctttctgtgttcatttaaaattaaataaatatttctttacatttccaggtttcattatctacctttttattccttttctcatagttcagttataaaagtaaaaaggatttataatattttagtcttgaatatctcctctgaactctcaactaagtcaaagaacatacccttcctttctattcccttctgtctgaatgcactaaaggacaacaagatgtgccggaatcttgtcacattctgtagtctgcaagcctccggtggctttcatcttgaatttgaaataacagaagtatctcatcatgcaatagtaatacagaagtgtgatgttgcttaaaatgctctgtatgtggcattatcttcccaagcagttgtaaaacgagagtagatgtaataagtatacggaagataaggaagacaaggcttggttttgaccagccgggagagggaaggttcagtcatgggttcccaactagtggggagacaggtcacatggtggggagcagtgggtctgtgtcaccatcataatctgaatgaggatcgggtaaaagtgtttaggacccatgcactttctgccaatgccatgaggctcaggtaacagaaacagcactgactttctagtaggacaaatacctaatgcatgcggggcttaaaacctagatgatgggttgaaaggtgcagcaaatcaccatggcacatgtatacctgggtaacaagcctgcacttcctgcacacgtatcccagagcttaagataaaataaaataaagtaaaataaaaaagtcaatgcagcagtcctcgctcccaataacaacagagcactaggtgggcacggctaatccacctgcctccctcactagcagggggctgtaaaaataaacatttattacacgatattggaaaatgttcagtttgtcttaatagaaaaatggtaccctaactaaataaaattaaacagagtcttagtaggctcttccaatgtgtttgtctattttccccacttctttcctctttatacagattaatttttctttcattgtctttcaatcaatatataaacccagggatgtacacagatatagatactcagaaaaggagaaaatacatttagaaaagataattttgtgggtagttatttcattacaattaaatatgcacatgctagtggggtagaatcagatactctctaatctccttactaaaagactattgacccaggtcattgtgtaaaaaccattatttggtttattccatgtttttattagacgagccggggtctgacatccagagactaaatggttttaattccagaggaatctgggtcaaagagaaaaggtgcaggtctccctaggaaggccttgggctaccccgtataccatggaattgtctgtaattgacagaaatccataaagatggggaaatacgaaagaactagacactcagtgaagcccctgctgggtcctgacacactgtaggttcatccgctctcctgaatcttggcttccccgtgtcctcatgaggacttgaccaagcgcaccgtggatccctgagagattgcaccttgctcccagtggcttcatggttacaaccactaaaaatgaacagctcaaaagctgaatcgtaagattcttcagaacaacaattctgcgttctttatccatgtcatcagcaatcagcactgggtccaaccaccgaaaccccagagaaagtgtatgtcgttgatgaacatggaacactcccctgtcagttctctaaagttaaaatctgggttcaggtttcgcactgatcacaaataaaaacccagataggagtggaagtcagaagacttgatttctgattccaattggatgaggaacaggctacacctgttctgtacaacatttcctagttatattttttcacctataagtagctagattcaaagggttcttttcagttattagagaaagtctttgggattcatatgtttaatacaagcctgtaagtatctgcactacaaaccctcctcagagttcagcatttaatgccatatactcaagggatgttgctgggttagctgatgatcacagattagaagacatcacacagaatgctagcatgacaacattgaaagttctggggaaatctttcccagttttacagaaactataccctgcagatttatttccaaaattaattgcgttttccattctatattcctttcatgacatgcttctgagagctcgatatctcttacatgatttttccacatgaagcaagaaaacatcatgtttatttacgtgtgcagggggtgcgtgtatataaaattttagtctttattattacatcacagtatgtgcgaaggatcaatgtgaacagcattaggcttgaaaattaagataattttactataaacatttttaacagagatattttttagcatatttaacaaaatatatgcctgcaaaatgtgtaggtattttatatgactgacagcttctctgtaattaaatgtgagaagcacgtttttttaaaaacaactttttgttataatcaactttaaacagcatgcaatcacaaatgaacataatttccttccttccattgcaataatatttatccttgtgtattttatgcagtatctctaatcattcacctgcactaaagtatagttaagagttatttaaaactttgccttaaaggcttactgacttctaaatttgaggttattaaaaaattcagttgcgatgtaactatttctttttagattagtaagaatgtgctagtttcctgcctaaaaaccacttcttcatgacagtccctcatactgccagtgtgagatttcaaaagactattaaaatgaaagaacaactagaataaaaccactctactaaattatgacattgaaatacaggcaaacgcggccttaggaggaagtaaggccctttaatctgtaagcttctcctgacctttgcacataacttctaatgaggtcaagtggagcccggcgggggctccattccagccattctgtaaagggaggacacacagtgttttcccttttagttggctttctgcatattctcttagaagtctcatagttcaaagtgagttgacaatactgaatctaaaatgcatcattatgtgcatctacgtagatgtaaattaattgaaaaaccctagaattttaaaaagggaataaaaagagccacgtgttcctttcttgccagaaaccaggcttctgtccaactaaattgctcacctcgctgaaataagcaggtgactggacggatgatttatagcaggggagtccaatattttggcttccctgtgccatgttgaaagaattgtcttgcggcacgcataaaatgcactaacactaaagataactgataagcttaaaaaaatcacagaacatctcataatgttttaaatatgtttacgaatttgtgttgggccacagtcaaagctgtgctgggccgcatgtggcctgtgggccgcgggttggacaagatagtattatagcattagctcttgtttcttgaagcttttccttttcagtgccttgaggctaggttgcccattctccaacccctaggccatggaaggttcccaatttattgaaatacttacaggagaggtgaaaattatatcaggactcttagaagttaagggcatttctagttggagctgggattttgtcaatcaacgcaggacctgggtacccctgccatcaatattgagattctgtcttgtcctggcttggcttctcctcatcagccctgtctgtgatctgaccactgtggctggatttacctccattatcacttcagaacctttccagctttccacagtatgaccacatttaaaaatcaagattaactacagaaagggttggtttggggatcctgcaacttttaataattacaactatgtgctagacacaatgctaggaacatccacttatattattgtattaaatcctcaagacagtccagaaaggtaggtacaattgcattttgttacacataaggaagctgaagatcaaaagtgttaaataactttcataaggtgctggactgataaatgttagatcgaggtttatctacaaagttatttcaaagtccacatacactgctctaagcgaagtgacattacaccttctcaaactcattgtgtaaataaatacaaataaatcatatataaaaatatatgttaatatgtgcatatatctatatgtagaaaaatagatagacaatgtattttttgagaagaaaacttggagtcatcatgttggagaagattctttttacctttagagtatctccttcaaacagctggaagcttcgtgttctaaggtggatgcccttgccggcttctgtttctattttatagatacactcatggttattatcataattggatggaaaatttggagacagtaatgttccttcatttcctttgacacttgctccacattcggctacaataaataggacatgagagaaagaggattcaaaagtggaattactgtttttaacagattaaaaactttaaaatcatgatagcctcctcttctatcaacgtatgtgtgttagtaatatattatttcaaaatagatcagtgatttttttttattgtttgaccaactggaccaaaaaagataccccacctagctcattttgaaaattgtcttattaacagaatgacctctgactatgtggaagcagcatgctatcatacagagagttctagaataaaacagaggtgctccagcaccatggctcactggctgtgtcgtcaggttgtcacagcacctctcccacccacctcattcctgcctcatgaaatgtccccaccagttcccacgctcccattctaccattgtttgtctgcattttccttcattgacatcttatggcatcaactgggacgcattcaaaggggaatctaacgacagaccaaaccactgagttatcttcaggatgtcacatccctgaatgcctcagcattatgtcttataatggaagaacattcaatggcagtaattatctgcttctccctctttcccaatgaaggaagagaaaaattgacttctagatctaaatttgtatcaaacaaaattcctcttatcaaggtaaaagtgaaaatacatacaactctctactttctgtcaacctggagaaagtcacttaacctttcagcacctgtctcacagtgaaagtgaacagtttaggtcaagaatgctttcagctccaaaactctaagtccaatacgatcacagaaaaataaagtggctacatatacgggtgcacacacacacagaggtttgtctgtgccaagagagctccacaggagtctgcgccaacaattttacagactatactatgtgcccagcacaccgatgtaaacatcccacagaatgcctattcttttgaagaataattgtcaggttggaaaccaagcatcagttagatgccaggtatgtactgagagcaggagagaaggatgcacagtattccttttccactgggttgctcaaggtactgcagaattttgcagatgacttctgcatgcccactgccacgatactgattctttcacaccctccttccctctttgacaacgaacacaatcagctacatcactggccatgatatcctaatccacttgccagcaggaagttgctagagatccatgattgccccccagtgatttgtgcacgttgaatctcagaatgcctccatgtggaagggtgtgaggagaaagtcagagaggagaacgcttgacatcctgggttcacttctccctcatcctccttaaataaagacagaaaagcaggctttggatgtggctctcggggtgcaagtgttgaggcggaagtgcaggcaattggtgactcaaagatgccattgggaatttataatcattttaagaaattacagtaattatataactataattatgtatttgtataattataattctgtaaaaatcattttaaaagagaaatttatatgtatatatactcacgagtaggtgtatatatctataatatataaatactttatatagttatagctataaaatagatataagtctaaatataaatatatctataaatagatataaatatacatataaaatatatataatatatctagatataaatatatataattatataaatatatttatatctatatatatatttataatatatatttatatatatttatatattatattatatataatatatattatatgtgtatgtgtgttataatacctataatacctataattacttgtgtatgtgttataatacctataataacttgtgtatgtgtgtgttataatacctataataacctataataacttgtgtatgtgtgtgttataatacctataataacctataataacttgtgtatgtgtgtgttacaatacctataataacctataataacttgtgtatgtgtgtgttataatacctataataacctataacttgtgtatgtgtgtgttataatacctataataacctataataacttgtgtatgtgtgtgttataatacctataataacctataataacttgtgtatgtgtgtgttataatacctataataacctataataacttgtgtatgtgtgtgttataatacctataataaccttcgtgacatgtcaataaaccccatttacagatgaggaaactgaagcatagaatagtttacaaaccaaatgtctttcccaaggtcacacagctagtacagattaattactgatgtgatataaactgtgaagtactcataaagggaatagcacttttaaaaaatatcctaaataacacttacatgtactttaaaattaataattcacactactgttcataattaataataaaactggagtaacacaagtttaaatgttcaagaaaaaagtgtcttcttaaggacttttattctaaataggtcaccgattaattgcagctgatatttgttattacattagcatttaggacattagctatataatcatttctcataatacataaaaaaggtgggacaagaaagaataattgagcatttgtatccatgtgaagaaaaaaaatctaaaccaaaagaaataattttacatgtttttattagcctttggaatctgggattttttttaaaaaaagcagatatataataaatggtagtaactaagttcaagtcctcactatgcaagaataataactgtgcaaaattaaccatcccgttgtaactgatgaccctgtatagacagacaatgctgctgctttgccttttagaaaaaatcaaggcaaaagcaactcaccatccttctagcacttcccaaatctcactttatattcacagcttgaaactaaagtcttctattagtatctgaataagtatctctcataacctgagatgcaattaagatttctcagtgaatatgtaataatagctcatttattcaatatgtagctataactgaatgtgaatatacatgaccaaaacacttaaatgtacaaaggtaggatttcattactctagggtagtgtggcacaggattcaaaagatagtctttcacatggcattttccccaaaagtattaaattgctatgaaagtatacaaacttggccaggcgtggtgacccatgcctgtaatcccagcactttcggaggccgaggcaggcggatcacctgaggtcaggagttgaagaccagcctggccaacatggtgaaatcccgtctctactaaaaatacaaaaattagctaggcgtggtggcacatgcctgtaatcccagctacttcggaggctgcttgaacccaggaagcagaagttacagtgagccgagaccacccaactacatttcagcctgggcgacacagtgtgagactctgtttcaaaaaaaaaaaaaaagaaaagaaaagaaaggaaagtatacaaacttggcttgttaactagaaaaattattttaatacatatacattaaatgatatacgaataattgtatatagaaacaaaaatcaaatatatatttaatatgtattaaatataaatatattaaatgtataatatatattaaatacacatgtataatatacatacaatgtgtactcactatttaatttatattttagtacctatatttttcaaagattttaaagacgattaacatagaatcacatttttaaaaatttaaattatgacttttacatcttttctctgttttcagccgttatttgtgtttgagttaataccatcctactgaacataggacagttttgtttttgctttgtcaccttttttttcggattttatgtggaagtcaataagaaaatatgatattttccatgctgaacatgattagccattgtatcctgagggcctagtgcttcatgagtccacttgacaccgcagccgtgttggcatctccaaaggcctactgagaaacatgggtggggaaggaatgccaggacctgggcacactctcaggtgcaagacaaataggatgtttttatgattttatcaacatgactgaagtggagcatcacatgaaggaactatgggagatgggattgcaaacacagcctgaaccaggttgcagggaatgccctaaaacagttgaattttaaagactttaaacaaaaacacagaaggtatagatgttgtgaagattgacttgtgacacaaattctagaatttcaatagaagagaagtatctttgaaagttcaaataaataatcacaggaaaaataagttgtaataataccatgcctgatggggtacaggaatttatctaattttgtttttggtctatttgtcacttacacagtgcatgttcttattactattacatcattggctgggcgcggtggctcacatctgtaatcctagcagtttgggagcgcgaggcaggcagatcacctgaagtcaggagttcaagaccagcctggccaacatggtgaaaccctatctctattaaaaatacaaacattaacctcgcatggtggtgcatgccggttgtcccacctaattgggaggctgaggccggagacttgcttgaacccaggaggtggaggttgcagtgaaccaagatcgtgccattgcactctactctgggcaacaagaaagaaactctgtctcaaaaaacaaacaaacaaagaaacaaacaaacaaaaaacacgaaaacacatgggggtatataacaaaacaaaaaacacaaaaacacatgggggtatataacaaaactaagcccatgttacagatgagaaaactgaggcacaatgacactaattaacatgctcaagatcacacaggtgtgagagggaaactatgatttgaaccccaggcaatctgttatcagaaggtgcaataattatactacatttgttaatacacaatattggtaattattcctattggcagataggaaataatccatgagggctacttgcttatgactttaataaccttgtgattccaagaggataggaaagtgttgctgctgagggaagcaactttctgaatgggatgggttactattttacaaaatgttctttgaagaaacattggtatacttttggaggcatgtcttctgacttaattccgttttcaaattaaatcagaagaattcttgcggaagcttcttatctccattcctatctgctctctaacactacccctacctttctgaccaagataccaccaaatagctcgcatatcacaaaatgtttccttttccttatttccaaagctgtgcaggtggcctcctagtacacaaaaacagatacaacatgatattcaaatgaaagaatggatgtgtcaaagaaactgcgagagcgctccagaccctggggcagtatcccgtaggacgtaatttaataagacactgacattaagtaaagagcaagtgctcagaaaatcacaagagttaagtgaccaaaatttcaaaaattatttgagcttgatttaaaacattcattgaaaatcaccattagcagaattaaatgtttcattttaaaaaagtttttcaatagtctatttaatactaatttaagatgaatgaacacagtttcttaatacaaatcacttgctgttttataaaaaagctactgaaatgttaactataattgaattgtcacttagatttttgcaattgaatgaaactaattaaaatgaaattaacacagaagaaaggagttaattgatttttcagtcaattcttctgtacaaaggaatctacctgtgaaatttcctgtctcagtctgcttggcctgctgtaacaaagtaccacagacagagtggcctcaacaacagacagacgtggaggctaggaagccccaaatccatagcattaaccaaaatgtctgtataaattaatgcatattcaatattcggcaaggtcattttattggggacattaaataactatttatttaattattttaaaaagtaggtgaaaatatataacctctcaatctgcctattcaatacagttaaattggattcaaattctacagctgaagcaacttgtccacctaaataacctcgagcctatacaatgcctcacatttaacagagatgtttcttaacataatggctggaagtaaaggtgtatggctctggttattaaaatgtagaaattgttgtggggcttttgagggcactgtgaaattgggaaaactattaatatgcagatctctatgttttagaagctttattttaaaagcacagaaatagaaaacagctcaactaagaaacagaaacagaaagtctacctttctcctttaaaccaagttcattgtgttctacgcaacaaataagtaaatcttgcccgtaatagaagtctatattaatcaaaatatgcaattccatatttactcacgaagaatatttaagaatttcacaaaatggtactatttttagcccattcattatcctataaacctttatttttacaatttagtgccgttattggattagcttttaagaagcaacagaaactaacattttagcttagaacgttgtttcaattttttaacccaaaattaaataactacatagaattatatacagtttagtgatatatatatatcactaaactctctctctctctatatatatctatagatacatatatagatacactaaaccctctccctatatatagatatacatatatctatagatatgtctatctatagatctatctatagatatgtctatctatagatatagatatatatagagagacagagaaagagagtttagtgttaaactagatataaattaaactagatataaattaaattaaaatacaggcaagatattttgtttcactatgctgtcggaaataacttgtaatccattcaaaaactgaggataagggtgttgatattttttcgttttttatttcgcccaatgactttctactttgtcaagcaaatagagttaatacagttaatcaataagaggatatatatctcactttcattcattttttaaaaaaatctcttactagatacggatttaaggcttatgctgatgtatacatacagccctttaacaccctgagaaaattttttgttcaaataattctgaaatgatgtcatagatgcaatattaggttatggaattatagcaaacatttatctccatcatatatactctctaactttgctcctgatcttttgaccaaaatgtcacaaaccatcacaaaatattcagtttttgttattattcaaaagctgtgcagatggaattctaaatgtgctaagccaatcacgactgccctggccacaatgactgctcaggaataggcatgggactcaatgtgggccaatgagaggaaacccaggacttgtacataagcgatcttcacatagctgtttccacagaactgcacgatgtggggctacagcactgtatgtgatgatatgagatcaggaagccacccagtgctttacccagactggcaaaactgagagatgctgagacctcaggttcttgttgatgaggttgaacccttgatcaaacctcacctgaagatgtccctaggtatggactttacatcaccttaccaataaactttcattttgacttaagccaatgtgggcaactttttctctaatttgcaagtgaaaaagaagatcctaaacaatacacgtgtaatgcacatgccaacaggtgccagaagagagggtttgagcattgaggttgaatacccaaggaatacatgatactatttctatcatcctaaatgcatcatcaggttgaaaaaaaccctaaaatgaataaacacaaataataaaaaagtttccatctctttcatttcaaagtgacttgatagagagagaaatagttctcagctcagatgctcactagaaattccatttaagtcagacacttattagggaggttaaaacggcacacttttaactcagtcgacatccttaggtgtcacctgcaacctttggtatggatttgcctcttttttgccacaggcaaatcatttttatttctataattttagagaaaggaacatgaagcatggatgaatcaaatttttgagatgaaaagagaaccttgtgaggaaagcaattttcctcttttggatacacagaacttagggatgaggcagaccactgtaaaggagccagcagtctgaggagggagacaaagagatgaagacaacttgaggccgggcactgtggctcacgcctgtaatcccagcactttgggaggccaaggcgggcacatcacatggtcaggagtccgagaccagcctggtcaacatggtgaaaccccgtctttactaaaaatacaaaaattagccgggcgtggtggcatgtgcctgtagtcccagcaactcgggaggatgaggcaggagaattgcttgaacctgggaggcagaggttgcattgagccgagatcgtgccactgcactccagcctgggtgacaagaacaaaactccatctcaaaacaaaacaacaacaacaaaaaaacgtaatggcaaaaaccgcaattacttttgcaccaaccttatagaaagagccctggtgctctgtgggcctgagagggctccatctgtctgcaggaggctgctggctgagcactgggtgcactctggagagccagggaatgagggactctgatccaggacagcgtggagggagagtgattgctctgattagtaggggaagcactgaccaggctctgttacactgggcaaatcgatggggttttcactttggagagagcattctgggagctgcggcccctggggttggtggggtctggggagccagggaaagcatcagggggactgcggggttctggagtgaggtggggctaggagggtggggaggaggagcctgaactgagagctctgcagcggccagaatcctccagagctaggacataagcaggtgtggggaattagagagaaatgaagacagcacccgaatgcaccagaggggctggaggaaaaatcaggaaactgcaggcaaaatgcaaaaggctaaatacaaaaagggcctgtccaaggccctcctgtccagtgcggtggttaaaggctgagttgcaggctccctgggttcgagtcttcctagctctgtgtccttgggcaaagtttgtagagtctttttgtcttaacatttccacatgtaacagggaactgtccatcacagcatttacttcgtagaattgtcatgggactaaacacgttattacatggaaggagcctgaagcagtgcctagtctaccacacactgtttaataaatagtacctattcttccaactctagttactgagttttcatattttagaccacagagtaaaaacctgaatgacaagaaaaacagtgtaaagataatgactctggatgaaatagaataacatttaatgggtcttaatcattataatcagtagactactgactgttacatatctagatgtcaccttgatttcattgagttgggggttttgtccagatttcaaactatctcagtcaggagtctttagactccaaccaattctgggaactcctatgatcacctgcaaaataccgtattttttttcttgagataacagtcaaaatttgccttccattctcaaataaatattataaccacaaacagtaagaaccattattttaggagaaaagcagattgtgaaaatatatagatacatgttttggaaacagacacagatgatttgattcatgtttatttgtttaattttttaataacgaaattctgactgtgtatctctggttcgttaaaatccagaaatatagctttatcatttgagttacataatatccctaagcaaccccaaaaatctgccccaaaggcagaatcaaagagattctgcaccatggtaaaataaaacaagttatgctaaacaagttatgctaagtgaacatgtttgtgttttatatggactgttaaattttatcttcagaccttccccacctgcctccagttcgttaactggtgaaattagtgtggttcgtattctggactccccatggactcagaaggcttggtattaaggagaaccttggttaatctctcatctcccttttttcttcacaatgacattagtcagttttctgtaactttaaagaacaatttgtaagacccagaatatgctgagcaacatggctgggtggcaggaactagacgttgtccgtatagctaactacgagagctctggctgtgtggacaacacaccctatttaagctacaacggcagttacgattctcctttgctaaacttcttagagtggcacagttcccagattgctaataaacgtcaccccactggatcagcaagccaattcctgcatgtgagcctagtacttcatggcaaagtaccgaaataaaaattcctgttactcttcggaattatctcttggattcctccagaacacactgaaaaagtgaattcagcattcagatgcctcttgtgcccacttagcaggagtgtgcaaccatcatcccatcaaaggctgccactgacaacaaaaacaaaattgtcaccatcgttataccaagggacacgtgctgcttttaatcaatgcaattgtcagaggttgtgttattatagcttggcttctatcttccagtttttcttttgctccagattttctctctctccgtatatatatattttttcccttcataaatatgcttgacacatgctttggtttcactcttgttcaatcataaaatttcagagctgaaagggacttactttatagatgagctaattcaagcccagagcagttaggcagctcccctctcccctggttggcagagtggagcccacactttcaccctctccttccttgtcaacaaacccccacccgaccccgaccaccctaggcttcttgcctgggctagaccctgcccccatggatgaatgaaatgaaagcgtgtgaccacctacccacacaccttggcagaggtgcactccacacacggcggcccccacccaggcaggtaagcttggtggcaccttctaaacgatatcccaggaagcaggaaaacgtcagagagtctcccacaccaaagtgaaaaccaattcttcggctgaaggcagggactccaggatcatcacatggctccaggtcatattctgaggcatgcagagacagagtaaatgcatgaggatttgggtaaatacacaaagattaaatagcaagaataaaaagtgctattactaaaaaaaaaaaaaaaaacctacatatatattttccccaaacacttataactgttacgtgcattttttttcttgtactatgaactgtcttatgacaaatgacatgggatttagtatttttttttttttaagaattgacaggtaagaatgagaattactagaggctgggaagggggtgtatggagggaaggataaagtgatgttggtcaatggatacaaggatacagttagaaggaatatgttctaatacttgatagcagagtaaggtgactatagtgagtaataatacagtgtacatttcaaaatagctcaaaggcaagatcggaaatgttcccaacacaaagaaataataaatatttgaggtgatgggattcttaagtatcttgatatgtttgtcacacattctactcatgtatcaaaatatcacatgcaccccataaatgtgtacaattattatgtaactagaagacaagcagacaaatagcatattaaaatgagataattcacttcaaaactgtcagcttgagagtgtggaataattttactgatatttctaattgcttaaattggttactgtatccctcccaaaggtgctttttggtaactaacgcatgaagcataacataaaagcaaaggcacagggctatgtttctggaaatcttatcagagccaattttgcctctagaatatacctcagtgaggaacagtggaattttcctctgtttattttcaatctgtaaaccatgtgagattgaaaagtagtagacaagattttgtactaaaattactataaaccattcaagaaggaagtgctaaatataaattaaaaaataaatgtctgatattttgctgcattttgggagtaagtattcaaaatgtcagcactgatatctcacttctgtgtttgccacgttctttacagccaactccttctgatctccgtagtatgtacgtataattgagctctggctgtcaccagcctcttggtccattatcaagtccatggttttgacagtgggaagtgagaaagtgtgggtaagtgcctatttgtttggtttcctccttcttgctgtttccccagtctgtaatgcccagttttgtcagatagtatcaaacagtcagccagccaactaggaaaatatgcttaggtattggaatggtaagaagagtttcagagagaatcttgaaaggccaactaaaagatgtgcattattgcaaagaattgggacaatgaagatcactcttagtttaccgtggggaagaaacgtttagaaaactatgctaatctttctaaaaaaaattacttctacttttttctaacaccatctttagggttcccctaactcggaattttaggttcattattttcactggacatataaaatccaactgatccttttccccttagtattcctcaaatctgatccttcttttttttttttttagtttagttttcattatctgctgagtttgtcactgagatctcatacctgcacttttataaaaacttttatggaactctgtacctaaacacttccttcatctcacttagcttactggtaaagctctgaggtggatactttctgaattatctttgcgtttagataagcaatctactctggatctgtaaaacattcaaactaacattgataaccttgagatatacttattaatttgacttatgcatagtatgactcagaaagaaaataatatagacaatgtcatttaattgaactcaacaaacattaattgacaacctatcatacgtttactttttagaacatattaaaataaagatgtcacaattcagataatattatcacataccttgctgttatcattctacttctatctaaggatatactgtgtgcactcaattcaagccatacatttcctgtcatttctttaaaaatagttgaaaactccaggcactgtggctcatacctgtaatctcagcactttgggaggcagaggcgggtggatcatgaggtcaggagtttgagaccagactgactaacacggtgaaaccctgtctttactaaaaataaaataaaataaaataaaaaataacaaaaaaattagctgggcatggtggtgcatgcctgtaatcccagctactcgggaggccgaggcagaagaatcgcttgaaccctggaggtggaggttgcagtgagctgagattgcaccactgcattcaagcctgggcaacagagcaagattccatctcaaaaaaaaaaaaaaaaaaaaacaaacaaaaacattcttgccaaacaggagaatattttgatattattatgtgctatacctattatcttatataaagaaacaccatgatcttatggttctttgctttaagtatatttttactatatattgtagtttatacaatatcctctgaaagcaacttagaaggacagaaagcctgaaacaacaccatgaggttagaaggtgtgtgttagttgtaaccatcttgattaggctttctaaggattctcttatattaattatcacttaatcattattatacaaagtatatttgcaaggtgtgcatgttcatctttgtctaacacaagaaaagtgtattgccttcagaattccatcttctcaccaacgcaaagattttgttcttggagtttatcctttttttcccccttcatcaattctcttatttccatcaagataaaaatatgcgttacacggtcaatcttaagaatgagataaacaaccaaaaccaccaacaaaacaaactaacaacaccaatctctggacttcacagtcacccagccaccatatccctactctggttatcattagcacaaatttttcaaagtgttgggtgtaccttccattttcccatcctcccttccaagactgtcttcctctcatctattcaggctttccttcacagccttccactcaaatgatcttaccaaagccactgtgacctccggatgcaaaaaccaatggtcaattcttaggcttcctcttactaagtaggttttaatacagttgaatgctctcttttttctccaaaggctttcctttcttagctccctggatgccactctcctcctaactcactggacccaacttctcatttggctgattcggaacttctgctgccccatgtgttgaaattaattctatgccgatgggtttccagtatttctttttctttaatatgatcctgttatatgaactgaagactcttgtcaatcactcttgaatacatccctcaatatccccaggagaaaaaggtctgtattttcttcccaaacctgctttgcttccagtggttttcacgtaaaacagagcatcctcattcatgcaggtgcaaaatcttgaccccactctgtattttatatgacaccttcacttcctgccaatcaagtcagctctaaccttgcatccttcctgtagtctcagcttccatcttgcatctcttgctgggattattgtgtaacatgttcctgttgagactcacgcattgtctttcaagtaaacattgaaaaagctcagatcatgtcaagctcttcaaatccatccaatggcttcatgcaacatcctgagttaacatccaagttacttatgttatctgccctccataactaacttcacgtccctccactttcccctcggtttcaggggtctggccacagtgcccctctgctttatcctaaacttggtgtcttggtcctcccattgtacctctgtctgctgagagcccacccaaattagctggcctgtccattccctgcttcacaatcaagtctcagcctgtcagagacctgcctaggcaattaaagaatgagcgtactctcctctgtcccaggtactcatgactcaaccacagaagaagaaacagtatcctcatttgaaaagtcatggtaccattgaaggagacaaatacagaaaagtcattatgggaaaggaataattttggtgtaaaaacgtcatggaaacgtttttctcctgtattatatagaagaaaacaaattctgcctagggaaaagaagaaaggctgcatgtcagagacaccctctgacctggacaggaggagttttgcctggtgaaaaatgtagaaaggcttatttatttatttatttatttattatttttttgagaccgagtctcgctgtattgccgaggctggagtgcagtggcgcgatctccgctcactgcaagctccgcttcccgggttcactccattctcctgcctcagtctcctgagtagctgcgaccacaggcgcctgccaccaaggcttttgaatgaagagaaaatcacatatgtaatggcacaaagtggtccaacttttaaccttttgaagagaatgactgagaaatgatgctaattcactagaagttagcactgaagaagtagacacgtcgtagcgagtgggaaagtaagtgtggagtatccagtgcacatagttagcaactagtagcagacaatgttatgtagaatggggattgtgcaggtttatctaagccaactggaatacggggctctttttctacaatattaccgttaacatctgcagaaatactgactaggaaacacaatcaggaaacactgctttaataaggccttctgagaaaggcagaaataaactcgattaacaggaaagaaggcagatataaaagcatatgaataccatttatgataaaccacaaagtctctggatgggtaaatgcctcatttgtataataaagttgctagttatttgtatacttaaaaaaaaaactccatggtatcagtgtcactggcaattgtttgcagcacagtttctaggcaaaaatcctaccaaatgaaattactcctctaacatacctgaagaatttgtttactttaaagtcgactttgaaatccaaagtgttgtcttttgtttttaaaaagactttctgcttgtgtgcaactgtctagatgaaatttatttcttctgcaggctttaggtattattttctactggttatgtttaaatgaattgttctgaatgtttacagactgttaaccactttaaagacccatgaaagagtattttattgttgttggcttgcttgtttgtgcaagtagtttataatgacagtgtcagctgtgtagttacattctgacttttatatggtctgagtgtgttacccaaaatccatgtgctggaaatttgatcccctttttgggagtgtttatgtcatgagggacccaccctcattaatggattaaagccattaaaagggcttcttctcttttaccccatggggatatgggcgattctcccctttctgaccatattaccttctgccatgtgatgtcacagcaagaaggctcaccccagatgccagcaccttgatcttggacttcccagggtccagaattgagaaacaaatttctgttatttataaattatctagtctcaggtatgctgttatggcaagtggcacaaacagactaagacagtagtcgtcaaaagagttactgtcagacctgtggtgagggcaccagaataagaaactgatgcagtaaaatgaatagaatttgcacagacttctgagaaacacctgcagaagtgaactgtaacagacttgcgtcactgccattttctttttttggagaagtctatttaaattcattttgggtcctgatgaaagtaagaactggaggaagtgatattctcatagcaatactaattgagatacaccaggggagaatgcagagagagagggatttaggaattagtgttgggaagatttaagtctttgatatataaagtggcaagtttcatgattactgctgattacaacaaatttccaagaaatcaagtggtctgagccagtcttgaaagcttcacttgagtagtgaaataccaagaaaaatcaacaaagtcagattaagataaatggcaactaggtagaattagagggagtataaagtagttcagagcatcttaaaatccccaagaaatattttccttgaagacactatttgattttacataatgttaatcaacatgcactagttagtaggcaattgtgaagttcttattacagttgactcttgaaaaatgtgggtttgaactacttgaatccatttatacatgaattgttttcaataaatacattgacaattttttggagatttgctacaacttaaaaacacatgcagacgaaccatgtcatcaagacttaccttagaaattagtaaaatgttaggtatatcatgaaagcacaaaatatatgtagatactagtttatttatgtgttaattgactgtaggcttttggtcaacagtaggctattagtagttaagtttttggggcgtcaagagttaccctcaggttttccactgtgtgggggttgacaccccaacccttgtattattgaactacagttgaccttgaataatacaaggattaggggtgtcgatccccgcacagtggaacatcatcttacttatgagtaactcatcttacagtaacatacagcagtagagctgttgtttatataaaagtggggcaagcaaactttctaccaagatcttcagttttggtttgggagataagataaatactcaactattgtgacacataatctcataagtggcatcagaagttattaaggaatttatgagatctcaaaagtagaataaattacatgtgactgtggtacccagggaccaccttatgaaaattacatttgatctgggctatgaggaataaggaaggaaaaccctcttcgtccaaagcatcatatgcacaaatgcaagttaatatgattgttcccatcctttggcagctgtagtgcagcagggccctttctgttggtggagggtgggggcatgctggaaatgaagacactgcagaggttctcagtgtgacctgttcactgagcatcatttgtttatgtgaccaagtttatctctcacatgtttggccagtttttaagtggcggcaattttttcttatctgtagaaaaaattagcatctctgtcatagaactatacaaattaaacaatctaacccatacaaataatttctgctgtaacataaaccttatgcaaatattatctatatattatcattaaaaataaagatgttacctaacttggagtattttttgtcattgcatatgaatatattaaactacaagctcatcctcaactgtgtgtgtccacctgcttctttcatcctagaggtggttgtcaatgcaaatattggcacctaccgtagggtagaaaccaatgcaatcaggtgacaacagacccagaggatgcctcccaataaaggaactttcctcagagatcttgtagagttggtgaagagaatcgagtgagaagggctttgcagaatgtagtgacatctacagatttttcaaagacgagaattcacaaattgtgtaacacaaagtggcattttctggatgccacataactgtacttgcaccctgcttcgtggaggctcagcctcctgcaccccattagttggaatcaagtcacgcatgtacaaacacacacggatgcacacattacacacacacacacacccacacacattctcactaacagaaatggcagtattgttgccagaggagagaaacagcaaacaagaccaacatacctgaaaatgtgatattgaagccctcgtacgaaattgagaagtctgatataaaccgaagctgggcagtgaagtttccaaacaggcctgccttgatcgtatgaggcaacaccgacccggtgagcctggcaacgggctcggaaaaacttccatcctctgtgatcagtaaatagtcgtgggaactctcaagatgaaaggtgtgaaagatcatttgaactcctgagaaatgaagccgggggagagagagagagacagagagagacacacggggcggcgggggcagagagggagcggggcagagagagacagagacatagagatgacagagatggagaggaagagaaaataagaggggaagacagattgcagagagtaatagccacagagagacagagatgataaagagatgagacagagatggagagagatggagaggagagagagaaaaagagagaggttaggagaggtaacaattgctgaaaaattttttctggacttagacacatcaagccttaatcaaaatattaaaatgttatcttgatatgaaaatctagctttgaagtttaagaggaaaattggtggaaagaggacggctttagaaatgaaaaaaagcagaagggataaacaacaaaaataaatacttaagtgcatataagtacagatatgatgtaaatatgaagatatgatgtggacatcaatattgaggaaatatggagattatagatgtagttatatatagatacagatatagatgtacatattggcatagatatgtatatttaagaaaaacaggtgagaatgtttacaatgggtttcatttaaaaattgtcagtagactcttagggacagtatttgtcccagagggacaaaggaccagacaaattttcaatttactctaaacaggtgtcctttagaaaaatcttatttggaggtctgcataaccgaggaaaaacttccttaaaaatgtagttttagatgcccgtaaagcatatgacctcatagtaaccggaactacaaaggcttatttctggattcctatagtgaaattaataaaattaactgtgaacagataacttctaataaaaatgtgtatttttatgattataaaactttgatcactcataatctgtgtcttctttatgcttaatttccttcagggcaagttcttctttcatgtcattcatggcagcatagtgccacacagtacacataataaaatgtagccatttcatattaagtcgggttcaaatctatgtgaaaagacgaagtctacataatacttatgtgatcgaaattccaaatagactcttgtttattttattttttgagatagagtctcgctctatctcctaggctggagtacagtggcgcaatctcagctcactgcaacttccgcctcctgggttcaagccattcccctgactctgcccccagagtagctgcgattacaggcatgcaccacgatgcctggctaattattttgtatttttagtagagacaaggttccaccatattggctagtctggtctggaactcctgacctcaggtgatacacctgtcttggcctcccgaactgctgggattacaagcgtgagtcacttcacctggccccaaatagactcttaaagatgacacgtttagtcacagaaaaaagtttcaggctacaatcctaatcccagtgtttataatctacatttcctgcacaaaatgcaaaatatcctgatcttcactatgcttacctataaaatgaggatagaaatatctattctatgagccatctctggattatgtgaagataaattattcattatgtatgatgatactgggtaaacataaaatacaaggaaagtacaaaaattgtcccagatatatcatgaaattggaagttggacaatcgcttatttccctttatttaatcaatggtcagattttattgaatagatgcctttattccttaccacgatagctatatttcaagcttatgttcacatgcgtatattcaggttatctgataaacagagagcaaaacggggaatggtttttattgtacagttgaaagactattgttcttccaaaatcttattaaataataagttaaaatcttgaactatacatgagaaaagtagttatctcacttgtttacaccgtaatatgtttttgttttgttcccgtttttctgtctcatttattagtctgtatgtttgagacctatgatagattcttacctttcccatgagacacttcaatggtccacgtgcagtttagagagtttggataaaaatctggaaacccaggagaaaggactgttccactcttcccttggatgtagcctccacatagagcttaaaataataaagagagatgattacagcactaaagtttcacaatgattgccagaacaaaatactggttaaatggcatgcaatttgcacaaggattaacaaatttaatgtcatatccaagaaaaaccaagcagaacctgagctttatgttacttgcaaatatcatatgctagttcatatgaagggatcttaaccactacaaaaccttgacaacgtaacacagaataaggcacagcaggagagctggaacctgcattaacaagcctcagaattgcagacatggtacaggtttgcactcctgagagccgctggtcttcttagcagcacttcattgagttcaaatcccctcaacaaaccatgtcatgttcaaacactcacttcagacactcattttggaaaaaaagaagagaaagttttatgtaatcatttcaatgggaaagtggcaacaattaggatgtctgcagaatatgggagcttaagtgctcaactctgatgttagaaagttatgagttcaaatgccagctcagcttctcactagctctgtgatctctggtaagtctctcaatcctttacatttctcccatcttgaaaatagaaattatgataaaatccatctcatggataggtgtttgcaatgattgccattgtagaacacaatttacagtgtgtagtagctactaaatgattaaaatggtacctactgatagatactgatcaaaacgttatctactgagagttgctaacgggaattcaattcttaagatatcaataatttaaccttttgaatagactccatatgccctaattttacagacatcaagaggagaatattgacacgttcccgccaactttcttcttttatttcatatcttaagacctctcaagctatcctatgaatggaagcactgaactgaaaaagaataaaaggaaatggagtcaccagagccggagggtagaggcaggaaaggcaactgccgttcatgctctgcaaacaaacagccatgtgctccgggtcttgctcttctcctggaacctctccacctgcagttgtgaggcctatggatgtcaccagctcagatctcgagaccaggctgcccaccctcactgcagcacctccactgtgatggtgaaggttatgtgccagtgtgactgggctaagggctgcccagatagctggtaagaggccggtcatgtctgtgagggtgctgctaggacagattagaatttgagtcagtggactgagtgaagatttgctttcaccaatgtgaactggcatcattcaatctgctgagggctggaaccgaataaaaaggcagagaaaaggctgggcacggtagctcacacctgtaatcccagcactttgggaggctgaggcaggtggatcacctgaggtcaggagttccagaccagcctggccagcatggcaaaaccccatgtttatcaaaaatataaattattagccaggcatagtggcagaagcctacaattccagctattcagaaggctgaggaaggaaaatcacttaaacccgggatgcggaggttgcagtgagctgagatcacgccattgcactccagcctggggcaacaagagtcaaactccatcaaaaaaaaaaaggcagagtaaagaaaaattttatcttttcttgagctgggacatccatcttctcttgaccctgacttcagagctcctggttcttgaaccatcagacccagaacatacatcttcagctcccctggttcccaggtcttcagtctcagacttaattatgccactggcttttccagatgtctagcttgcagaaggcagatcttgggaccttttggcctcccaaacacatgagccaattcccacaataaatcctggttctgtttctctggagcacactgactaatacatccacttactagttagtaacacgtgcaaagttctctaccgctctgtgcttccatggcctcacatgtaaaatggggcaaaaatcacagctcattcctgcttgctgaagaatgaaataagtgaatacatgtaaggagctcacaatagtgtctcacaagtgaaacatcactcagtgtcacaatttactatgcatttcacaaggttcctttgctttttttttttttaacatgcccacattctgtgcatgtatatatttatacttcttttcttaaactaggtaagatgaactatcatgaagtaaatgatactcagaataacttcttccaattagtatgatcattctgaattatgttttataaaagcctcttccacaaataatattcacaaaagaattagataatctatgaaagatgtgactagcctcatcgtgctcactaaccatccatcttaagggaacaaatcatctcctttaatacgtaaacctcatgggaagcatgatataaaaatcggcaaaagagaaaatttttaaaataatttctagaatattttaagaatttctcatggaatttttgcatctgaagattgcagtgactccacatttcactgtgaaagaagtaacattatacatcccacttgaaattaatgtattcaacaaatcgttattgggcacctgctattgagcaagctctgcccccagcatcagggatgattaataataagagagataaaatatctgcccttctaaagtatgaattccagttggaaaagacaggataaaacctgtaacaacataaaaggcagatgatatacaatattggcagatgacacatgactgtgaagaaaattaagaaaaagggatgggatagtgtgaggcttctgggtggccagcggtgccgtacttaggaagtggtctataaataaggacttgagagagacaaaggaaacagtgaatacctggggaacaatttgggtagagagaaagtggttaggaccagggctcaagctacagtggagctgcagggacagggaacagaaaggacacctctgtgactggggggtccttgtaagggttggaggtttctttcagtgacatgatggggcactggatggccctgcctagaaaacgacacgatctcatgacctacctggggtttagccctgctcctgaggctgtgctgagagaatacacagtggtgaagggaggaaggtggtcaggaccccgaaccagggcattggcagcaagatgggaagacatggtctgaacctgcctgtgtcctgaaggtagagccggtgggactttctcctgaatgggatatgggcattacgataaaaaggaggagctgggggtgattgtgagttcataacctgagtgtgaaataactacaggtgaaggagatctcaggagaaccaggtcatgagtgtaaggcaggcgttcagctttggataccaaagctccaagtctgctgggcttgcctgtagaatggccgacattataacaggttacataggtctggaggccatggaagagggttgagcaagggatagaagggagaccacaactatgtgagaacaccagtggcagtgaatgtagaaataagcttccatagagggaactaatgccagcgcaccgcgtagtgggaagaaaaccagcagaggacggaggagtcccgaattcagaaggtttggattcgtaacttttcactggtctatgattggattggtatgaattgatgcaataatttctcaaatttttatgaagacgatcaccataatgaatgtaaaacattttatgtaaaactgagatatcttatatccaaagctacttgtcagtggtctttatcccaaaatctgcatgttatataaactgataaaattaattcatatccaactatgtttaacagtataaaaacaatcaatctttattttatcctctgtcttcatatcatcaggaaaagttacttgatcatttattggggaaaaatctgggagggaatgtgctctgccctctttttgatgttttccctccataccacacacagaacccggaaatcactgaccagccccgtcatgctgccatcaggagaaagtcagacagaaagttagagataaagctgctctcaggcttgtttagatttatatgggtgcaaacacaacgtagtccaattcagttatcatgaagactttacataaaagtaattctgtccacaaatcctataatatttttcaggagaaggaaatttgatgtatggagaattgaattggtattctcacctaaaattgaagtgaggagatgagagaatgaaatgaaatacctgaattacattttagtgtctatacaggtgagggctgtattcatatgtagacatgtctacattcccttagcagagctacaaatatagctgctcataatttgaattatgttaatctgtttcttcatgcacggtagatccttttctgagtagctgtaaaagacacagtaaaattttactgttgctgtccttaatgctataatttcttgaattttacttttctatttatgtaacccagccaacaccaaggatgcaggtatgttacattagaaatcttttggatggaggactaagatatgcagaaatcattgaagaacaaaagaggagacatacgttgtgatattttcctggctgagttgaagtaaagcatccaactattttttttttttttttttgagatggagacttgcttctttgcccaggctggagtgcagtggtgagatcttggctcactgcaacctctgcctcccgggttcaagcaattctcctccctcagcctcctcaatagctgggattacacacatgtatcaccacagccagctaattttttgtatttttagtagagacggggtttcaccttgttgtcccggctagtctcgaactcctgacctcaagtcatctacctgccccgcctcagcctcccaatgtgctgagattacaggcgtgagccaccatgtccgacccatccacccgtttttcaagttctgtcttttgtcctctacttttatccattcatctatcccatcctgcatttagagttacttattaagaaacatactaatgttttccaaacactcattgatgcttctgggcatagaacaatgaataagacagaaaagtccctgtttttccaaagtttacattctaatggggaaggcaaataacttggttttaaaactccagataacgaggtctgatttattctaagaacaagaatattaagttgctctctaaactcaaaggaggtctagatgattagactatgacggacatgctggtgaatcaacaaagtgatgaatgcacatcctggcaaatgtccactcccaggatggtgagtatggagtaagtgatacaaggtcggaggaaatgcagaagatcagaagcaaccctatggtagcagggtgccccgagacaggctgtctgctgaggtttctctgccaactcattccaggatcctacggcttcctactgatgttcatggcaaagcacacagccctctggggattctttagttatttattgtcttcccaccacccgcaccaccccatcacttccccagaccctgccaaagtcttctaataaatggaagtttgcagagtcagttattgttgcctggaactcagaaattgaattcaacaagtttatggatgggaggagggcggcagttgaagcacgcagacaatttcacaggcaacagtgatctccgtgttagagacggcagtgggaaaaagaggagctggtgatgatacacctgctagctccctggacggtggcattcacctccacggtgcccaactgtaacttgaaacctgacagcttccacatgtacatgttaaacactgacctcgttctccaactgtgttgaacttccaactgcttgccaggtttctcgggatgtcaccttggagtcacctctctctcctaaactcctgtatcctcctagtgacacttctaactactccccactattgctttcttcaactggtgtgtttcaggttatttttgtcttatcaattgcctagcctctgcaagtctgcctcttcctcaaagagatccacctgtgaaagcacagccttgggcctgatctgtttccatcttttctctttttttccatcattttcttgttctcctgaaaccacaaatacagttctatttgaagtcagacttaatgagttactttccacttcaataatattcatagactctccatgccctacagaagtcgctgattttattcatatatttatatgaatacattatatatatttttatgaataaatatgttgttcacatatttatttataatagaaactttccaccaaaaggaatcttgtgcagaaacccccagtaggaaggaggggagtaaattggggcagtccagctgcataggagagattccaatcctgatgaccagcccccatctcaccctcagaaaaaccctggggtcctcacagtgtgatcgctggacactgcagcatgaatctctgcctatggccatagaccagcactcgaggcatttgatcatcatctaccttcagtgattcacacccctcaatcctccagacctctttttttctctttgcacctcagtttataaccatttcttcacgttgaaacatgtccctccctctcaacctccatcttaaagatgtatctccaaaattgcctccaagctttcgatatcccaaattggaactttttttctccaacttctttatcctcatccacttttctgtgtctaataaagcacttacttcattgtgtgatttttaaaaatgtctttccttttgctatgctgatagattttaaacttctgtgtgattgcaaatacagcaggttctcaataaatgcttgtggagagagtaaacagttttcaaaaatacttatttaataaaaaaaattttttgacaatataaaaatattttaataacataattactattgaaatattaagaaataaagagtaaactaattgcctgcaagtatggatgaaaagggtaaccaataatactttttcaaatgccaagaacaacaaatttgtctgaaaacatatttgaattgggaaggaaagcattgattatatctcatggtgacacagacttgtttttaaagctttctattaataaatttttctacagaacatatatcttattcataataaaaaagataattaaaatttacaatgttaaatataaaatattcatatttatcatgttacctcccattctccgtgaaaaatgtgcagttgaactacttgcatgattccaaataaattctttttttgttgttaaaactatctttctttaattaaaaaaaatttcaaagttttctttgcgtttgtctttcacaaaattagaggacaatttatcccaatgttcacttctttaacatttgaatgtgtgaaagagtaatgttaaaaacacactgaactgatgctatgcacccagcacagacactgagtttatcgtgtttcatgttgatatacaatattataattatttttttttcttttctgaaagctatgaatgtttaaaggtttaaatatcctacttatgtaacttttgttgcacgaaaaacccatggggtttaagagattgcttaagatttgaagggtaatgagaacaagccttatggttggatgaaaactatcaaacatgactgactgaaactcccatatcaaactctaacatcacccaaaatttgtagatttagtaatagctctttctttgtggagacagagtcttgctctattgtccaggctgtagtgtagtggtgtgatcttggctctctgcagccttgaccacctgggctcaagtgatccccctgcctcagcgtcctgaaccgctgggactataggcacatgccaatacccccagctaatttttgtgtttttttgtgtggaaatggggttttactgtgttgcccaggctggcctcgaactcctgggcctcagcaatctatctacctcagcctcccaatgtgctaggattacaggcatgagccaccatgcctggcttattaatagatttttaccacaaattctttatactgagaaacatgttccagtgctgcaaattacagtcatgctattgattccttcgaaaggtttaaatctcaaatttacatacatttatatcgacagacaataaagaaacaaaatgaataagctaagtgtacttttattttctatggaaaatgccacccatataactggcatccctatagcatctcaattcctgtactgcaaaacctattggctctttttggtctattcccactccgtttctcctaaatcattttcctattgatccttcactcagtttccattaaacctactttgctaaacctccaggaattcttactgtaccgcacctatcaactcctggtaattctgctcatatcctgggatgcctgttcacatgctggctactttgggaaatcctacccaaaacggaaacaccaggttaagggctgtactttccatgaatgtttcctcagttactaccccctgggagcttaaaatcaaactgaactgactgtattgagtatgtaaaatgtattagtctaagatatattcaatataagttgtaaacacatgttatattatctctctctctctttctatctaactttatggagctgaatattaaaagaattgaggtcagaaaagtcagtgccgtcatggcctggagcaattccagaggaatgctcatcaaggctgagtgtgacctggtcttggaggttgaaaatgatttaaataatgcaacatgtaaggatgaagaagggtattgaatattggatgtgtttgattgttggtaagaagagaggaagacattcaattaataagttttattttctaggtcacctgctgggtagagtagaaaatagtcttggctaaaccaggaagaagtcgaatccctgaatagaccaaaaacaagttctgaaattgaagcagtaattaatagcctaccaactaaaagaagcccaggaccaggtggattcacagtcgaattctcccagaagtacaaagaggagctggtaccattccttctgaaactattccagacaataaaaaagagggactcctccctaactcattttatgagggcagcatcatcctgataccaaaacctggcaaaggcacagcaaaaaaagaaaatttcaggccaatatccctgaagaacaccgatgtgaaaatcctccataaaatgctggcaaaccaattccagcagcacatcaaaaagcctatccaccatgatcaagtcagctttatccctgggatgcaaggctagttccatatatgcaaatcaataaacgtaatccatcacttaaacagaaccaatgacaaaaaccacatgattatctcaagagatgaagaaaaggccttcaataaacttcaacaccccttcatgctaaaaactctcaataaactaggtagtgatggaacatatctcaaaataataagctatttatgacaaacccacagccaatatcatgctgaatgggcaaaagctggaagcattccctttgaaaactggcaaaagacaaggatgccctttctcaccactcctattcaacacagtattggaagttctggccagggtactcaggcaagagaaagaaagaaaacgcattcaaataggaagagatgaagtcaaattgtctctgtttggagatgacatgattgtatatttagaaaaccccattttctcatctcaaaatctccttaagctgataaacaacttcagcaatgtctcaggatacaatatcaatgtgcgaaaagcacaagcattcctatacataaataatagacaaacagagagccaaatcaagaatgaactcccattcacaattgctacaaagagaataaaatgctgaggaatacaacttacaagggatgtgaaggatctcttcaaggagaactacaaaccactgctcaaggaaataagagaggacacaaacaaataaaaaaacattccatgctcatggataggaaaaatgaatattgtgaaaatggcaatactgtccaaagtaatttatagatttattgctatccccatcaagctaccattgactttcttcattgaattagaaaaaactacttaaaatgtcatatggaaccaaaaaagagcccatatagccaaatgaatcctaagccaaaagaacatagttggaggcatcgtgctacctgacttcgaactatactaccaggctacagtaacaaaaacagcaaggtactggtaccaaagcagatatatagaccaatggaacagaacagaggtctctgaaataacaccacatatctacaaccaactgacctttgacaaatgtgataaaaacaagcaatggggaaaggattccgtatttaataaatggtgttgggaaaactggctagccatatgcagaaaactgaaactggaccccttccttacactttatacaaaaattaactcaagatggattaaagacttaaacataagacctaaaaccataaaaaccctagaagaaaacataagcaatacaattcaggacataggcatgggcaaggacttcatgactaaaacaccaaaaagcaatggcaacagaatccaaaatagacaaatgggatataattaaagagcttctgcactgcaaaagaaagtacctcagagtgaacaggcaacctacagaatgggagaaaaattttgcaatctatccatctgacaaagggctaatacccagaatctacaaagaacttgaacaaatttacaacaaaaaacaaccccatcaaaaagtgggtgaaggatatgaacagacacttctctaaagaagacatttatgcagccaacaaacataagaaaaaaagctcatcatcactggtcattagagaaatgcacatcgaaaccacagtgagacacagtctcacaaccgttagaaaggggatcactaaaaagtcaggaaacaacagatgctggagaggctgtggagaaacaggaacacttttacactgttggtgggagtgtaaattagttcaaccattgtggaagacagtgtggtgattcctcaaggatctagaaccagaaataccatttgactcagaaatcccattactgggtatgtacccaaaggattataaatcattctactatgaagacatatacacacatatgtttattgcagccctgttcacaatagcaaggacttggaacaaacccaaatgtccatcaatgataggctggataaagacaatgtggcacatatacatcatggaatactacgcagccataaaaaaggatgagttcatgtcctttgcagggacatggatgaatctggaaaccatcactgtcggtagactaacataggaatacaaaaccaaacaccacatgttctcactcataagagggagctgaacaatgagaacacatggacacaggctggggaaacatcacacactgggtcctgttcggagaatgcagggctaggggaggcatagcattagaagaaatacctaatgtagatgatgggttgttgggtgcagcaaaacaccatggcgtgtgtatacctatgtaacaaacctgcacgatccgcacatgtgtcccagaacttaaagtataatgaaaaaaaaaaaagttttggttagatagtaaaatattttaaaaagtaagttaccaatgctcaaagaagaatttggggatggtacttgaatgcacaggtatgtgagaaggttgttttgagaaaaacctcacttacaatcaaaattatgtatctcaaatgagtcaggcaaagtctcttgcttgggtatatcagttttcattaccagatcaagagcatacgtaattcaatgactgtgctatgatgaacagggtgcgttcacccatcaccttacattcagagtactacaacttttcaatctttacaggtatgactaaaatgactgcaagtaaaacaacttgacaagccccatgtcggtacctgttcaacagatctacccacatgaaaaaaaaaagagagcagcttacacacaccctatgttaaaattctatttttgtctatagtccaaattaacaaaaataaattattaaaaatgcacagtatcatccaagaaagccatatgtgtttgcatggcacataaacattcaagtaaaattattgatacaattaacttattctattgcaaatttagggtaatttaataaaacatcaaacagattcaagttcagttacacatgaagaaaacttgaatattttaagggttatcattcttattgcaaatatttttaatatagaacccaaaaatatgacaaatatttgcatcgtctatatgacatccttgagttttacaaaattataattagccagtagttatcatccttctgacactaaaaattatacagacacatgtagtttatttatttttcattactagagttccaattacaaaaataagactcagtaacataaattcaaataataccaaaaaatgtagagtgaaaaataaaaaatctcactgctcccacgctacagcctagttatctctgaagaggcgagcatgagagttacaattttagaatgtctattttcagtcaatttctatgcaattctgtgtgtacctgcaattacatatatctatacagtatatgcatatacacaacatgcattgttctattacctcttattttttcctttaaaaagaatgtatcaggctgggcgcggtggctcacatctataatcccagcactttgggaggccgaggcaggcagattacctgaggtcaggagttcgagaccagcctggccaacatggcaaaaccctgtctctactaaaaaatacaaaaattagctgggcatggtggtgggagcctgtaatcccggctgctcgggaggctgaggcagggtaatcgcttgaacctgggaggcggaggttttagtgagccgagatcctgtcactgtgctccagcaggaaagggaaaaagttattatttatttgcattcttctgattcctagtcagcactggaatattttttaaagtttattgggttagggttatttatatatatatataaatttatatatgtatatttattattagcattccaataactttagtaattagttatatatatgttattatataatatataacacataatatattatataataacatatataatataatatatataatatattatatataatctatatatttaattagttatgtatataaatttatatatatataaatttatataaatatatatttattattagcattatgtctttctctatatatatctataatagatatataaatatctctatataatatataataataaatataaatataaatatctctctctatatagagatagatataaaatgtatctgcatagctcattttctcatagatctgttggcttattagtgttgcatttcttctctcttccagtagcagagtatgattatttcatgtgtatattacatggagaatgcaactatttttggttgtctgaccctttattttacatctttaatagaataacttttagtgtgcatatagcaaaattgatcaatgttttttcatttactgtttctggatttctttagttttccaagatttaaaaactaagatttctcaaaaaaacccaaaactaaatgacaaagaaaacatgatgctcacaggcatggccacttaaacgctgtgacaaagtcagccgaacaatgagaggagaaacaggatctcaaataccaatgatgccagcgcatgtagatagccagattggagaagaaatggatctggacactacatcgttccttaccacaaatccacaaatttttagatggattgaagttataaatttaaaagataaacataagtttttacttttaggggtgattaacaagttatagatcatggtgatgctttcatagatgttcatatgtatcacaaatcgcatcaaattgttcacattaaacatgcagtttactgcatttcagtcacacctcaataaagctgttaaaatgtttaaagtttttaggagagaacaacagaatgtcttcattactctgaacggagggaagccttcttccacactaggaaaacctcatgcatggagggaagccttcttccacactagaaaaacctcatgcatggagggaagccttcttccacactagaaaaacctcatgcatggagggaagccttcttccacactaggaaaacctcatgcatggagggaagccttcttccacactaggaaaacctcatgcacgaatgaaaacagtgaaatatgggactatcttaaaattaaaaatttctattcatcgaaatgatgccaataagagaaggagaagaacaactccagaataaaagacttacaatgtgtagatcgaaggaactgtatctaaatatttacacaacacctataattcagtaagataaacgcatgtgacccaatagaaatggaagcaaagaaagagatgctttataagagatgatacatcaatgtccaataaatatacaaaaatgtgctcagaacaactgaaatgtcagcaaacagtagaatgaaataaaaacttttgatatgtttaagcaataatattagatgatgagaagcagcgaaacacagctaactgccataatatggatggaccccacagacttaaggttgcaggaaagaagctggacaaacaggaccttccctggataatttcatttatttacataaccactagtgccagacaattaaggttcaaccctgggaggcagtgactgggcgaggctgtgaaagcgaagtgtggagtcctggaaaagttcgtttagtgacctacatggtcttgagctgacagggacatgtttactctgggaaatgcattgagctacacacttatacttgtagaaataaataaatatgtagacatctttaaaaaatggttgtctgagagatagtctaaattttcacataataattttaagttttgaatctttatatcttcaatcaatgtgtaacttatttcatgtacatttttaaacatttttaaatcaaatcaggcatccaatttgagcaacactatgtcttaataggatatcccttttctacaaaatggaataattatattataaattaagtttctgtacagacaaagatctgttactagaatccttacgctattgcactaatatatttgtgtatttccataccaattccacattgttcggtttatcattagtttttcatatgctctgatacaacatgggacagtccttccttattattctcaaaaatatatttcgtatccatttggagcatttcttttccaaattaatttttaaatatttgcaaattgctatttatatattgctatatacatataaattaatatagatgctatttatatataaatatatatttatataaattatatataaatatatttataatatttatatatattatataaatatatatttatataaattatataaatatatatttatataatatatattaatatatgctatttatatataaatatataattaaataaaatagtatacatatttatatatgctatttatatgtaaatatatattatatatgcaaatatataatatatattatatatgcttatatattacatatgctaatataatatataatatatgcatatataatatataatatatatgcatatatagcatatataatacatatgctatttatatataaatatataatatataaatataatatatataatatataaatatataatatataatatataaatatatatataatttatatataaaatatatatataaataaaaatatatataatatataaatatataatacataatatataaatatataatacataatatataaatatatagaagtctaaatatataaatagaaatgtaaaatcatatacatatacatgcatatctatgaatgcatatgtatgtatacatgtgtatgtatgaatatatatgtatgtatgtatataggcctttacatttcttgctagatatattattcctggataatttttttgtgtttttgtgttttaccctacatgtttttattgtatttctaataagttatatcctatgcggaaatctattgacctgttatcctgaatgcagccacctactgaactgattgttgctaaaagtcaactatcttctctttataatatttctaattcatatcattttcatatacttttgcatttgttaggatcttcaaagcaatgttacacaatacttctaaaaccaaggagtatatcctgttcttgactttcaagggaattttataagagtttactattaattatggtgttttctgtaggcaaattcacttatatgacggttctctgtatatttatgaaagcgatatattattttagagtttatgtttaaatatttattttagagtttacttaaagtttaatgtaaaaaaatgagacatgtctttccagaaaaacttaggcataactactgttcacaggttttcacctctttcatctgcttggataagaagaagttggccagagaattcctctgtgggaaaatgccagggctgggtatgcatagtccatgttgcagattcacatatgagaggaaaaaaaaagcactaggtaatttctgccaccatctgtgattgtcgtgaaatagaagaggaattaagaatgtacattttagcaattgtctaaattcttactgtctttcctgctgcaatagtaattcttagctcatttaagattggtaagtggcaaaatgatatcaatacaatgtctaaattaccttggtgcttacaccatattccctagacaaatggagttgatgtattagaattataaccaatagcaggaaaagaaaaatgcctcagctcatctgcacaaaaaaggaacccttttgcatctctattcagaaacttagcagaaagcaccttcacctggggggctcacccctgcgttgcttggccagtggctcatgtcaggctgcacctctttctcagcctgctcgtgtggccccacagacgccgaactcgactcccacctactcctgcccagagtgcagcattcccaccggttccagctggttcgcacacttcccacacttcctgagagggctccagcagctctgtgctgtccacctgcactctgtggtctcggccacagtgccagttactgtgtgggttcgtgctttggtgacaaaggtcaaagattttgagtgatctgcagttaagcagaatttttccataaaccctgttattttgggtgctcattttaaagaagtcaaggtgtttaatgaatgcatgcatcatgtttgaaaggaaatacctttgtctgtgaaaagtattgaagatgtaaatgaaatatttttgctttttccatagaaacaatgtgttttggaacactgttttccatagaaacaatgtttcctggaacgtttttctgcagaaacaatgtttcttggaatgttattttccatagaaacaatgttatactggggttatattcatggtcaagggcaaaataccccaagtttttttggcaaatgattacaagcaacatatttacctaactgttattataactacacacagcatagtataacgttgagcaatacaataacacaaaataatcaggaatgttatttgtcttgagattcccaagagaagatttgtgtaggacaacaggagtggctgttatcacaaaaagctgctgaagatctcctgacagcttctgagctcagaatgagaactcccaggagaaggctctgctagacattcagtccacggaaacaaagacacggactgtagactgagaggaagtgagacactgggacgtatgtcaggggaaaatcaggtctgacatcctaggatatgtgtggcgactataccgccccacgtgccagtttcaataaataccatatgtaaaacacatgtgcagaactaagctccctaagtttgttcattcggggataaagttgaaggacagttgttctatctagtacatacacggtggtaggtaaacttcaaatgatcgggaatgatacgatgatggtatacaacttctcagagggaactcacgccagtcgtaaggtaccaccccctgaaatacacacaccacccagctagttagacgtgtgcgctgtctctgcacaccctgctggtgcattgcctcactgagctgtacctaccgtcgcagctgggcaaggcgtggttccactggtggttcctctcacagacgaggggctcgtcgtcacttagtgtgtaccccgggtcacagctgaaagtcactgtggacctgatgccaaagtctccaccgtggcgatggccgttcacagggatgcccgggtccaggcaggaatccgactcaagcgtcacacctggatgcacagaacgaatgcagtcgatgaggatctttctggttgattgaaaataatagagacccacgccatcaactacgaaatagtctcagaaataataagacctgaaacattatgcaagtgaacccaacaatccatggacataaaagccaatgcatcttcaaacatttgacctcgttttttaaaagagagatttatattgttatgctgtttaccagatattatctacatacaacaaccttgaataattaattaacttctctgaattttacttttcttcttggaaaatcaatgaattgcactaaataaagtctaagacttttcctgttttctatttttcaccaccactctccctgtgtcttatatatgtattaaatatagacatatgtacttctatatttatatattccagttagattttggcagtttaactttcaaataaatgcatacatacacccaaacatatacacatataatgcaattaaaaactgtgctagtgttatttttctaagtttgcattccataaatccatgctattttcaaattttagtttaagtcagccacttgcaagatagctactattagcctttgctaacgatgggaaaaattaatgtgcatgaagtaattatgatcatatcattatgagagtttcttttctcctctcacatttctcatttctctttttagaaaaacatatattttaagagctaaggaaaatgagaataagggaaaagaatatcattgtaatgtttacatatgcgaagaaataaaaaatccttgttattgctgtgtcatcctctcagtaaacatcagaacattagaatgaatatctgaactgtgaattaaaagtcttaaaaatatttctaatttaaagactgtttagtctctaaaggtgatcttcgggatattgtttctgatcattgcatatgttttatttttccaaaatttgagtgctataacttgggcctggccccaatacttttttcttaaactgtttttctaacaaattttctaaacactaacacatgtctattgccctaaacaacagaatgtaactgtccttgctgctgcgcagtatggcaggaaagcctccttccaactctggaggagctttcaatctgccagaggcaacgtggatatcatttggctagaaatctattacctaccacctgctcctccctccctctctctacatacacaccacacacatgcatacacacacacacacacacacacacacacacacacacacacacacattcactttcagaggcattgtttatgacttcttccaggacactcccacagattttatgcattattggctccaaatgaacacatggtacccaatgctgggtgaatgatttttgttgttgttgtttacttttattttaaaacccagtgctgggtgaatgattttttgttgttgttgtttgtttacttttattttaagttcaggggtacatgtgcaggtttgttacattggtaaacttttgtcatgggagtttgttgtacagattatttcctcacccaagtattaagcctagtgcccattagttgtttttcccgatcctctccttcctgctaccctcaaccctctgataggccccagtgtgtgttgttccctctatgtgtccatgtgttttcatcatttagctcccacttataagtgagaacatgcggcgtttggttgcctgttgctgcattagtttgctaaggataatgacatccagctcctagcatcaagatcaaaatcaagacaagaattccctcaaaagaagaagctctgctgaagaaatgcactgatctctaggtttctggggaaaaaaaacagttaactaaataatttcatttcttcaaaaaggtttctgtggtcactaaacaacagtgtatgcactacggcaaaacagtaataggaacgattatcttagaataagtgaggattatatattaatggttttaataagtgaggattatatattaatggttttaataatgaaatttataaaccataaactaaacttttcccacacaaaatttacagtgaaaagagacaaactgcggtagaaataaaaacatcgaattaaaatgttgaattatttacatttcaaactgaataaactcttaaggtcacaattgatgcttagttccaatattatgccataatacttccattcatttttaaataataattgacaccactattgaattttgaaatatgcagacattgttctcgttttcattacaaactgtttgaatggagagtacaggacgggaggactgttgagtggtagaattatgatactacattcgatttccagttcaactgaaactggccatgtaaaagaatcctgaaacaagaaaatggtgagaaagaacatctggaatttggctgggcacggtggctcatgcttgtaatcccagcactttgggaggccgaggtgggtggatcacctgatgtcaggagtttgagaccagcctggccaacctgatgaaaacctgtctctgctaaaaatataaaaattagccaggtgtggtggtgggcacctggaatcccagctacttgggaggctgagtcaggagaaacgcttgaactcaggaggcagaggatgcagtgagccaaggttgtgccgttgcattccagcctgggcgacagagcaagactctgtctcaaaaaaaaaaaaaaaaaaaaaaaaaggaattttgtagcaggtgatttatctccaatggaacaatacatttatgataaactaagaccagtctgtggacacaggtagccaatttaccttgtgggaaaggtagggcaaagtcctaccttctttcccattctgtctcctgcctgacagcacaaagagaaatacagaccaccggactttgttgaaacgacgtgtatattcagagtctgttcccactccttcttacttgaaccttaaagcaacaatgaatttttgatacaaatagttacaaacattactttttttttttcaattggtctttgcaaaataagtgactgaatacatttgctacttaatgaataaagggagttgattactttgcaaataatccgtgtgcagctcatacggaggtacatttgatatgagcagggttctgtatgaatcaacagtctttataaaactcctagtccaaggaaggaatgaacatttcctgagcacatttcatatgccgagcttagagatgtcacttctcacagcctccgagaggtttcaaaatagaggttgaaaagtcacagttgataaagccagtgagccaagaaattaagcaaactggccatgttacattatttactgatattgaaacctgagcctttgcctgcttttctcctctctctcatgtatgcatccatgcgtgtgcctgtgagtgttagcatgcatgggcatgttatatatacctttgcattgcatccagtaccattacatcccgaccactctcctttccttttctgatcatataaaaagtcaccgaatctcagcaaacaattggtgtggtgtgcacgcacatataaaccactaaatatactcctttatcacaatgtttcttccatgaataacatgatatatcaatcacacagtagagtatgtacatttacaagtgatgaatctttcttctgccttcagagatgattaacaagatacttttgacagcattttcaaaaaatgctctaaaattaaatggaaaaccttcatacccttgagaattccatttattttccaatttcttacaaaattatgacaattttaaagtggtgatttaaagatcaacatacaaagcagatgatcattctggagcgagaatgcaatcgctattatatacagacactgtgccacattcctcgtaaagaatggctagactgtcgctggacactaacatatgagatgattcctaagactgagtgcatgaagcagaactgcaattctaggtttgcttttacaaaagcctcaaaaaaatgacttcaacctttgagccacacaattcagaaaggccttctggagtgaatgctgtttacagtagctcacattgccttgtagcaccgctgcaaatataagtcagcctcgagtacctgtggctgtgatttctgcaacacattttgtctgtagagatcattggcatgggcctctatgggcatgaagaagcgtcattaataatttcagaaagcaaggagtgtttataatgtgaaacatgtatgatgaaacagaagagatgagcaatattcctgtttttaagaggcataaagagtttgatataaatcattcttgggtcatggatgaagctggaaaccatcattctcagcaaactatcacaaagacaaaaaaccaaacacctcatgttctcactcataggtgggaattgaacaatgagaacaaatggatccaggaaggggaacatcacacaccagggcctgttgtgcggtggggggaggggggagggatagcattaggagatatacctaatgttaaatgatgagttaatgggtgcaccacatcaacatggcacatgtatacatatgtaactaacctgcacgttgtcacatgtaccctaaaacttaaagtataataaaaaaataaaataaataaaaattggatgacattttcacttgaaaaaaaataataattcttgggtcacaggcaacccactttcaaagaatgtgttggatgagtgagtgtaatcattttctagtgcctgcatcttggcttcagaacctattttgtcgaagggtgctagacggggttacctggatgaaggggttggtagcatttttctcttccacgctttgccactttttctctgtctctgcttttctcgctggactcattggttcctttaaccctccgtgacctctgctggccttggccccttccctcctgcttgcctgtgggttttctctctccctggagcccgggatctgcgtctgccttcaccttattcagaatcacctcgaggacttgattaaaagctcaggattctgattttcatcatgagttccctgaatcacaatatttggaatctgggcttggggctgtacaatttactaagctcccagggatgtgttagtgcactatgatgtttgaagaaaccttccccttcagcaccgggtaaacggggacaccctctgagtgggttgcgagcctctgaaagcactcatatctctacaccacccacagaaatagcaaccagaacatctgagctggtattcaggcattggttttattttaaaccccgcaggtaacccttaggtgcagggctggtgataagcactcataaaatcccaggcctttcctgactcattttcttacaacaagcaaacaaaaagccatgtcctgaacctcattcacttatgtacatttccatatgtctcttcaaatacacagcgactgatacataaataagaagtgatcccaagtcaaggttcagtatcacatccttctgaggtcctatttctcccttaagtcagaggaataggtgacaaacctttgagagccttctggaagttcactatatgcaagtctagatgtgtgtttagagcagtgagcctttgaagtcacagtgctggaaagttccaaacgcaacaatttcctgtcttcactcactaggtgaggcctctgctcacttctgtggctatacagctacctcctgagacttccaacaaggtggaaagaagagggaatgctagactctccagcagatcagaactttatgactctcacacaattatcactgtataaacaggcatcatcttggtgacagttttcttcttctttttagggatggagagaaagaaaaatggcatttttttcatgtgtctgttggctgcataaatgtcttcttttgagaagtgtctgttcatatccttcacccactttcacaatagcaaagacttggaaacaacccaaatgcctaaaaatgatagactggattgagaaaatatggcacatatacacaatggaatagtatgcaaccataaaaattgatgagttcatgtcttttgtagggacatggatgaagctggaaaccatcattctcagcaaactatggcaaagacaaaaaaccaaacaccacatgttctcactcataggtgggaattgaacaatgagaacacatggacacaggaaggggaacatcacactctggggcctgttgtggggtgtggggagggggcagggatagcattaggagatatacctaatgtaaatgacgagttaatgggtgcagcacaccaacatggcacatgtatacatatgtaacaaacctgcacgttgtgcacatgtaccctagaacttaacgtataataataataataataaaaaaataaattatatatatatatatatatatatatatatatatatatatatatagaaaaaaagaaaaatggcaaagagctttactctctgaggggtactccaggtgatggaagaatgccttacgaagcctgccctctacttttaaacacaggataaatgaaaagaataccaaaacatagggtagtcattcttttaagattataaaaatagttgtcaggattacttacatattaaattattatattatagtataatataatgtgtattccatattttataataataaaatattattattataatattagtgaggatgacaagctaaatagaaatttatgaaatgactttttatcatttcctgattttccagaaagagaaataagaagaagacatttatttaaatgacttggataaacaaatgaaattagtttcttctgccttcacttagcctttggaacacattccctcaaatggaagtagaaaaagcaaagtcatctacagctacagaaatacagatgaaaagaaaggaaaagtgttctaatatttgtcaatgcctgaaaataattattctctgaagtttcatgcactatatatctaagagtcaagaaattctggtgtagaaaaagttggggggaggggtgtgggagaggatgagaaaatacaaggcttattagggatcttacaaattcagatcactgcaatgtttacacatattgttacttcaaagagaagtgacaactcgaatggacattttaaagaaacaaaatgtaaaatttcctggttcttaaattttactttaagtttcaaaatacgttactttggagcaaatgttgtatatctatatatgtgaagagtaataactgaattaaatttgaaatttgtcattaagtcattgataagcaattttcctgatattggaatatttttatctaaaagtagacaaaatcttaagatatacatgcatatgcacgtttgtgtatacttatatgagtatgtaaaaccgaggaatgcacataacaggttgttaatttaaatgtgctggagtggggctcagggagagggtaacaagagtaataggaggtgatgtggggaatggaaggcaagaaaacgaacaaaaggagatttgaaacccatcatagtagacatgattctatgcatgcatttgtaaaatcatacgtgtgggtatatgtaaattttaaaaacatctttacaatagtacttgagataaagctctgaaaaagaacagccataaaactttggcaaaataaaagtctgattccttcaggtccaatagtaattgccactttttctcgctttttccgtgctactctttgagggaagtgttttcaaacagagaaaagaataacagctgctttgctttgttttgttttaattggctaatgttaaaaatgtattcctaggggtgattcccatcagctagatttcagaagtatatttgcataaatattattataaaataatacaattacttaatctcatcatttcagaagctaaaactttgatttcagtaaacaagggcaggaaaactttccatgtggaagtttggactgtttgcaaaatacattccattataatattttgacaattgttttaaaatatgtttaataattgttttaaagtattattcatgcttgttgaaagactgttaacaattgtttggaatttggtaaggtttagcaggttttaattccttcgcctcttgttacctgactttcacccagtgaaacgtgtctatctatactcagattcggtaccacaaattgacctaaccctgtttttctagcaaggatccttttctccattgcccaggttaacataattttagtaatatatcctataagacttttgctcagaaagtacattttctaataatagaagtatattattacttccattattctatgcagaagatgaacccatttcattgtttttattattttactttgtcatacgcgatggatacgtatttttgagagttaaaaggcagtaattccaagatgctctcttatgaataacagaaagttcttacaattgcatagtatggttttgctagagtcaagcaggatcagtaaactagcacagtcatctgcaggctggaaataagaacccagatctttagttctcccatgcatgctgccctgccgggctgtcaagggaaggtgcaactcactctcatagtggatgaggaagccgatgctggagcggctgttgtcagtggtgaacagcaggtacatgaagttcccggtgctgatgaggaactggggtgcctgggtgccgtggtactcgccgatcagtggggacgaactggctggcccatctctgacctccaaggtgtcataattgacctctgtctgaaatctgcaaatatatacatcccatcagaaaagacatgcagaactgccagcttacagacgtgctcctgacatcctcattccttaatcagaaacccatgtacgttaacatgaagaaaatagttgaaattacatatgcttaaaacttgggtacaaatataaggatagtatgttcttttcttgatgagacggcacagcttaaatccctttctcttatctaatattctgtcttacaatattacagacacaagaggaggcctttattcagcttaaacaaaaatactatgaaccagattagttttcttagatgatagattgatagatagatagatagacaaatagattattcccaaatagaaaaaactcaattatatatttttaaactatttttaccattccctatttaacataattatagacatcttaaaatgggtgcactagagtgaaatcatctcttaaacaaagaagatcattaaaaatgtgtgatgagtttaaacacctttcctgaaaaaaaaaatcctgtgcctttttaaattgcaataactctttcaagacattagaacaaccatgggtatgttgccatttcagacatgaaaggatactttaataacttgagaaagttacaacagcttccaaaaactgcttaagttttcttatgcttcccgagaatctagcctgagattttatatatatatataaagttgcagccacttggctcccctgtgatgcaatgtaggtaccactccaggcacggagataattttctaagtgggcctatctgatcctcgaagagctaacccggtttctgagtgcctgacttggctctcagggagcagcttaagcgtcataagactctgactcactcagtcactttgagccaaaggatcccacggaagcctgtgccattagctctgtgctggatgttgctgatgaattgggagaaaacttgggagaggggaagcaatcttagcctcatggcgtgtagcaacagaaaacgatgttgaaaccaaagggctgtgtcctgtatacattagatcatggatacactgattagtgcaaatgcacatgattacctattcctgcaactagtgaatgtggtaccctgggccccattcttccataaagaggaatttgaaccatttgtatatcacacatctggaccagaataaggccacaggctgccacatttgggattgcatagtgccaactttgtcttatgacactattctaaatctttttcttaaaactgatttctcagttgtttgagttcaaattcaagaagtctggctaagcgtgaaagcaatctcctttgacatagtcatgctgaagttgtcctatcctgtttctttagtaacagtgaggactgacaaagtgcctatttcaacagctggaagatttccaggatgacgttggaaacagaaacatctggatgttctttgctgttgggcagcctaacacacaccgcctggcaataccatcagcacagagctcagaatttgtgcgcacaatcccatcctttaaggtgtcagcccatcggtcatggtggaaatgaacatttccttatgcaattcatcttttaagagctgtgtactatgtctagagtacagatcacacatgtctaaaaatatcagaaatatcgggtatttccaaatggaatttagcaaaacatcacactgaaacaatactgaatgaatgagattgggaaaaatcaagcaaatatcttccttcaggcaactgaaaatagagggctaatagactggccagagaagaatataggatcactacttttactaaattacttaaatttgatacgctgctgggagtcagggcgtgcttcagctccgcctgccaataccagtaagtggagaaattagtaagaaacccaacgtaatcaactgaatacttacagagttagtattttttcaaatgattgattatacacagtaattcactttctaatatagatggatttataaacaacttttttctcttgttctaagagattgtgctattggggattattattattttgtcagaagcaagtgaaaaaataaaaataattatttcaaataaatacaattactgaaagttaacacaactcctgctgaaaaacctttcctgtgttgatgttagcattgatcatttgaaaacaaaaagataataatacaatgaagttcatctatcttgagacaccataatattccggatactgaaatccagaatgtagtctagtcaagaagaaggtcattgttagagaaagcccaatgttatgcagagaataaccttgaaactttcaacaaagatgcctccctagcctttggttcatgttgctcatgacaaaatctttttagtttttaatcatcaatttggtctcagtgttgagagaaatgggaaaacccttcttatatagaactccaatagcctgcttattttttaataaacaaatacctacgcagcccagcatgcttattttttagatcatgaaatgcattattaaatagctaagccaagcaacattctagtgataatgtcactcataggcgattagttggtgattgatctgctgtccgcaccccattgcccgctcagcatcactagctgccctcgagtgaccagcagccaccaccagaacaggagagctgatttcctctaccacagaagacacctaagggaccatgggacccagagtggtttccatgtgcaatcagacatcaagctgaattgattccagtgcaggtcccaaacccagagtcagatacaagggtcggacctcgggaatggtcctccaggactggcagttcccctactaacctccagagcattggctcactgtgggcttagaggataccactgaagaagaacaaaacttacaagtaagtgcctgtttctggtaaagtgtgctcctatgcgggaaccgaaaaaaactgccatctttttaaagtttaagatccatttactaaaactatggaagagacacacaccattgggtccaaatgaagactaatttttttcttacctgtcaaaagttattttgatagagtggcctggttttgcttcaattatccattcacaatgtaaagaatccttataatatcctggccatccaggaggcaaaatgactccgctggacgctgtcagatgtccaccacatggagctaaaacaagacgtagaatatctattagatccaatgagacagaaggatatgccataacaatacccggataaaagccagaatctgcttctgtgttcatagactgaatattttcaagtatcaaagcaaatcttattcccaaggaaactgtacatttattgaaagcagggtctatatatgctacctccatgtacttaccattaccttgaagcaaagttctttttctctagtaatggtaatgtatacgtgagttctctgtgctaactgaattatctcatttaactgctaaccatttcattacgtacatgcccggttatctatagtttacatgcatttggaatttaacaattatctatacataagcaaatgtaaaatgaccttacatctcaagatggatacatatacacacccttaggtgtgtgtatgcatgtgtttatttacttccattgtgtgcattttattaaaataaatagccacatgcaacatattatttgtgagtgtgaaacaaaacaaaatgttcaatcaaatttgataagtgtagaattagactgcattgaaccttttgcaaggttttgtgacagtgatttgtaattgcaaaggagaaataaagtttgaaagggtatataattactgctcagtgaaagtgattatgcatacctgtatcatctaaaggaattttaaatagcataccaatatttcataccgtaattaagaatatgtccctggccacatgttttctttcagattttatgtattctctctcaaaattatttgccattagcaatcatctttgtggatttatagatatcaaataaagtacgtgaaaatactccaaggtgaaaaaatccttttggaaaaaatatttattttatttaaaaatggccatatgtataatgtaaaaatgcaaaaagtttatatcattttagccatgttttgatgctagaaaaaatgtgaattagtgaaatttatggatttaccaatagtatcttaatttacgtcaggaaacaaatacagaaaaaataaaagcaaaaatttatggaaactgcatgaccatatattggaatgtggcaaatatatttgaagtaacgtttggaaattttgttgatatgggaaaatctttgcaatagaatgttaaacttgaaaagtggataaaaaattgtccatctgttataaatgtaataaaagaaaaattttattcagtgaacacggcagtggaaattaaaaacatgttaataatggatagcactgggattgctttatagatcatattttttgatatattatatatatatatttttcccaaataagttgcaattgttatttttatacctatgcattattctgtagtttaaaaatatgaaagcagggtaatttttattaacttgagctcctgaagaacacttgattttttgtgataatttttaaaacaaccaaaattatacttattaatattttaatttttcttgttaatttcttaaattcacatttgcagcctatgaatcacatatcgatatacataattatatgtaattcaattcttttgttttttaaagcaatgcaacacattcttttatgaatacaacataagcaaaattaaatatgttaaatatataacttttattttgtcatgtttaaccatccaaagatactatataagaaagacatatggcagatgcagaattccaaaaaaattatgatagttgagcaatttctaaaatctgcatgataagttatttctatgtgtgaatttccatataaatacataaccaaccaaaagtttcctttactttagtaattttattttgcatttttatgtttcttggaatatgtctaacttgccaaatattaattattttattatactcttacccatcactttgtaatttacagtgtatgttagaacctgaattgctttatcctgatgaaatagacactttaataataacactgccgatgagcaaaatttacactaaaataataatgatctcagtaagtagattgtaagtaagtaaatagtaagtaataagtttgtattagtcagtttggattagattacactgccgtaactaacagccctgcaactgtagtagctacagttggaagtgaatttctcacaaatgtggcatgtctaggtctgtgagacacaggtcccttcttcagttgctatggcaggtggaaaaaggtcttaggaaagcaatcaaagacgctgacccagaagttgagtacagcatttcctcatatacctaattgaccagaacccatgacaaggttcctttaatctacaagattcaagaaaagacattccacctgatggagaccaaaaatatttgatgaacatcatcaatcatgttcatactcacttagctgataacaaaaaaagcaaatataccaatgagccaatgaggtgtttagaaagcaatttcttctttgctttttttttttgatgatttaaattacagtgatgaattccctgatactgtatttctaaaatacacacacacacatacaccccttcttgattacatatgtgtattttcctatggctttatttttattagaacaatctcattggggttacattaatgctggcttgatgaaatgttatgaaggatgcagcctgtcttctccattatctgtgatagtgcacaacactaaggttctctagacttgaaagagaactcactcacacccctgtagggtacttgtgtctttttcaatgttcaatccttaatcttttttttcaattcttttctatgctactttacgcacattttatactttttatgtgagtcatttttggtattttatcttttgctaaaaaaatcacccgttttctacagactttaagctttgctgccacagagttggtgttttcatgtatagtcatttttccccaaaatagcttgagattttcatgatgccactgagctgcattgaggaatacgagcctgttagaagcagaagaaagagagaaagagaaaccttttgcccggaggccataaaatttatactcaacatgtgcctggcatccagaaaattctgccagaataaataaataacctacgcttttaaataaaaaaattgctctattgtgagcttttcactgtttacgtaaagttatattatttttatggtatggataatttctcttttatgttaccaaatatctataacatttttctttcctagttctttttatcagaatcataaacagtttgtctattttattgatattaacaactcactcttgctttaaattgtttataacacttgaattttattaataggatcctaatttatttttgttttttctaactttttaatcttattattaaatttctttattttttgatcattttgttctacgttagaggacttaaagatagacattttccttgaaacacaggttttgctgtctcacattgtttctcatagaaagtactgttctaatggtttccagatgggatagtataggcattaaggtttgagtttctctttaatgtaaaattatagtggactttttatggatagacatttgcttgtagttctatttttattacatgtttctactttaattggaatattacagggcatgagacctataacttattttaatttgttaaggttcactttgtggtcagttatataattgatttaaacaaaacacttttcaagaaaaacaataaataagagtattctgtaagggatgtgagcttcttcaaacatttcttaaatcaagtttgttatctgtattactcactgcttcattgctattttatttttttccctactagatgcatttacttctgaaagttggctttctatttgttttcagcagaggcagtgatcggggtacccgcctgttccatcggagcgtcccctaccttctctgaggctcagctgcactcagtcattaggtttctcaacgcaggtagacttttaacatcttttcctattaactttttctttctgccgagggcttcctttgttaacaacctatagctgggttttgcctttaacctcatcctgtttgtgctgtggtccacactcaccctgcaggttgtaacatatctgcaatcagcctattatggtaaaggacataaggcacagcttgacttgtggccaggacagaacagagatgagagtgtagtgttcactttaaacttctttctcctgaaaattcatgcttccaagtcagtgaaatatgcttggctagaatacgatttgcacctgtgactaactgtgccctatcattagtatcatatctttgagcaccacatgtgtatatatttactcatttataaaagatgaaaacctacccatttattaacattttgtacagcataaaacataaaaactgtacatttaccatatgtgatggaaatacatacaaatgaaatttcagctattaagagggttttgttgcccttctatttatcaatatttcacccatgggtggtgcttcttgtccacccacaaattgttttaacaatgtatgaaaagggtgaacatcagaataccctcctttacgtgtagtattaccagacgatactataaacaggacctggttagaagtttctacttctcctctgaggtcaggagtttgagaccagcctggccaacatgttgaaacgtcccctctactaaaaatacaaaaattagccaggcgtggtggcaggtgtctgtagtcccagttactcaggaaggctgaggcagaagaactgcttgaatctgggaggcggaggttgcagtgagctgagattgcaccactgcactccagcctgggtgacagagccagacgctatctcaaaaaaaaaaaaaaaaaaaaaattgcgtttctactttgagtaatggtgagtaacttctttggaggtgggaccagggcaggatgaggtggtgaaggatcatgcccccaccatactgtggttgtcatggaggagtttaatgctccacacctagaccccagctctgcttagagtccttgatagagatgatgggtctgagaatgttattccgaggtattttagatagggcagaaattctcaactgtttatgatatttaacatatattcctgttctattcacttattaaaaataaatacatgttgactaaagacaactgagaaaataaaaataaactaagagggaaaaatcacccataaccataattaacattttggtgtgtagcctttttttagtgttttacaaagttattatcatgagatatgtatgtatttatgacacatgtgcctgcatcctctgtttttcacatgctaaggacacctgagacgctttgagcttatgatctttgtattgatacctgttattcttcatgatttatctaatcagtcctctgctgtttgaagctgaatcatttccaactcttcactgctataaatagtcttgcagaaaacattcttgaaaaaaacctgtatagttgcttatttctttatgatattgatccaggaatataacttatgactcaaaggacaagaataattttaagagtcctactaagaatttacactacaataccatgattttatataatcaatagtatgattaggaaatgccagtttctacataaccttttcaataatacgtctcattcacctgtttaaatctatgctaacaagatagacaaaaatgatattttacttttcttcttaaatttgtacttctttgatatacactagaggtaagtttttaagttttttaaaaatattttcttagcttattgcgcactgactattctgatatggactgtgaacatatactctaagtaaacatttttaaaatgagtaattattagaggcaacatctttttccttaaaatattttcctctctatatttattagataagtaaccagaacagaaatatgaagaagaaaattaggtggtatttatgtcggctgtaacaagaacaacaaaatagttaaccataagcaacactgttataggttgaattctgtccccccaaaaaatcatacattgaggtcctaaccctcagcgcctcagatggtgactgtatttgaagattgggtacttgcagatgaatttagttaggataaggtgttgctggaagaaggggacccccaatccaatatgattgtgtccttttaacaaggagaatttagacacagggacagacacacacacagggagagctccttttgagtctggaggcagagatgagggtgaggcttctccagccatggaatgccagagattgccaaacaccgccaggagctggaggaccagcctgaggcagatcctccctcagagttccagaaggaccccaccctgccgatgacacctggatctcagacttccagcctccagaactgggagactgtacactcctgttggttaagtgactgtgtgtggtattttgttagggcagccctagcaagctaacacagtttgttggtttgtgtgtgtgcctgaagatagatgtgtgatttcaaaggagaagagcggggggtggcagggactgcaccttcacagcggggcacggtggagctccagaccacgttcccgtcttgcagtatgcaggtaatggactcggatccctgggtcttgacaaagccatcatcacagtggaaagaaaccgagctcccgagtagaaacctgtcaccaaaacgtcgtccgtttataggaatgccaggatcatggcactcattctgaccaaatgctgaaagaaaaagaagaagaaaaaaggaataaaaatacttgagtattaattacatgtattaaaaaagaagaaaacagaacaagcttataaagcattcatataatgtatataattatataaatttcagttgtatcattcatagatagataatacattaataaataggatatcagtgtctagtgagaaagagcgagcagggagatgaacaaatataactatcatttatgcagcaatttagggtttgaaaagcacttttcataggagcttagacaaagagagaactgatatggtgggtggtagaaagtgtctgggctcaagatttctctcgttagaatcctgactttttttcttactatgtcagaggactctgacattgggcatatgactctgacgctctaagcctagctatctttatttacagaatgagagactactaaatttatatcctctagttactataacactaaatgaaacaattattgtccaattctaagtattctgcctaagaaactaggcagttagcatatcataatgtagtattactcatattaatattctctcactttattccatctacagtgcatttaagtagatattcttacataaaataggttttaaaatgaggagcctaaagcaaagagaatgagctgtcattaaacttcactaattacatactagtgctgtattttaatccttggctcctgacatcatattacacagttgtttttactacactactttgttgcaagaaagatgcataagtggctgagtgggtgggtggatggttgtatagatgggaggaagaatagaaggaagaaaggaagaatggctggctggctggatgaatggagggatggaaagaaagatgaatggagggatggatggaaagatgaatggaaggatggatggatgaatgcatgcatgcatggatggatggacagatggaaggatggataatggaaggatatggatgaatggatggatgggtgaaataatagataaatggacaaaacgatggaagggaaggatgaatggaaggatatggattgatagatggatggaaggataaaaggaatgatagacggaataatggatgaatggatggacacatggatgaatgatgaatggatggatggaaagatggataaacaatggattgatggaacgatggatggatggaaggatgaatggatggaaggatggatggatagatggaaggatggatggaaagatggatggaagaaaggatggatagatgcatggatggatgaaatgatggatggatgaatgaaaggatacagatggacagatggatggatgaatggaagaatagatggaataatggtttggtgggtgcatggatggatagaatgatggatggatgaatggatggatggataaatggaaaaccggagagaaagagatgtaaggagatgaaagagagaggagatccagcttcttagtttaggagtgatgaagccacctatctaaatacagtgatacatttgtttttaagttttcaggataacactataattttactactgtcattttcataatgattataaaacctctgaagtatcaaccttgaaatgcaacttcacatacatataagcaaaatgggaacatgtaagtaaaatgagaacttggatgtgttgactgtgtgggcgtacttactggtgtaagtgatgttgaaccctctgccagtagtggaatggtcagactgaaattccaagcgaactatatgcccactgctggccagctgggaaggcacttcattgccagaaaaagtacccaggacagttatgtcagaaatgccatcatccttgaccgcgagaaagtcaaactgaggctcaacatcaaaatcattaaagattaggtgaattcgacttcctggctccgagataatcaaccagacacagttcatgttgttcccatattcctctggataatttggtgacagaataatcccagatgatgccgtaaagttgaagaaacatgaaactgtgaagatgcaaatatattttcaaacagttatgcacatatccaaagaattgccatgtgaaacagacagctaagaacctggaaaggcaattcatgcctgcaaatagctatgatgatccaactattttaatataagtaattctggaccataatgttttctcctttcctaatttgtaagtcgaatatttcattatcatatagagcacaaccagaacctatacataatcaagcacaagcgtggttcaaaaatgatcctttccagttgactgaaaacgtgtgccaaatattataatttctagttataattttctgccttcagaagagcaaatattaatatggaaaagtatattcctatatcataggaacaattcagcctgctctttcataacttttaaatttatattttatactttcctgtgagtgcattttctccagtaatttaaaatttttattagttacagggtaaacatgaataaataaataacttggaaacatcagatcatgttctagttggataatataaagtattttgaaaaatttacttttaagaatgtgtacttaaaatcatatatattatataaataattttttggagggagaaactgttggatttatctctagaatacatttttgcttcttattccatataattttgtacacacttttcagcctttgctatagttatttacaaataaaaaaaacctctcctttaaaatcgactgtgaagccttttctacttgttaaaatagtattcttaagaggaagtgggcagctcatcaactgaattccaaaccaataccaccacccatgctcgcactggtgaacaacttgtgtttaagtgttatacagcattattaagtcacaaaggactctgttgctgtactgatgtctgatacagcagatcatcactggcttttgatggaaacaacgatatatgtgatgaccctttctggtaggaaacgttcaagtacattttgtcgagtagatgtaatgaaactataaattagtttttactaaatgaagaaagcaggcaagttggtgttcgagaacgtccttgcacgtttccagtaaatgtggcaccccgagccattctgaaagctgccctccctaaatgggcggtctgtgtctttctccttttctccccttgcaagatccttgcaggacaggagggagtccaggtcaaggcataatactcacatacacagctgggcttgttgccagaccactgattgttctgctgacaggtgataactctctccccccaccagctcaaaggccgccgggcattcaaaggtgagtgtatctccatggaggaaactgctgcccgtccgcttcccataggcggggattccaggatccccacaccctcccttttcaatttctgaaaatggaaaaacaaatgaacccttaaaaaaacacacacaaggaatatttttatctctacaacttagaaagtaaatacgtggcttctttttgctgaactaaacatcatttttgtaaagtgtttctaaaggatattcaattgatcttaaatttaatttcaaataccagaaaaagaatgtcatttcaaatgaagggaaaggtatttaatttgctatcttttaagggatacacgtggctacacagatacgctgacaacacaaatgctgcaattaatcggtgcatcttctggatacctccgatcttttatctgcaattgctactactaaaatgcaaataccagtttaattttcaactatgtgctttttgctataaacaatacaaataatattcttcattccctactgagtatttaaataaatagaatctatttgaatattctttccctaaaatgaatgttaacactcacttatgaagcagaatgaataacagtttggtctacagaggaaaacaaaatattcagaatcaatctttcattaaaacatcactgtaataacatatgcgtccaaatacaccaaacctatatttcaaatgttgatctgtctcaaatgttaactacacagaatgttttcattaaaatattttatttatttattcatttaaaagactatttttgagagccactgtgtgtcaggtcctgttctaggtaagggcttagtgaataaatgagacaaaatcctcgcacacatggggctggatatgatttggctgtgtccccacctaattctcattttgaatcccacgtgttgtggcagggatctggtgggaggtaattgatcatgggggcaggtctttcctgtgctgttctcaggatagtgaataaggctcaggaggtctgatggttttctaagggggagttgccctgcacaagctttctctttgcctgctgccatcatgtaagacgtgacttgttccaccttgccttcgccatgattgtgaggcctctccagccatgtggaactgtaagtccattaaacctttttcttttataaattgcccagtcttgggtatgtctttatcagcagtgtaaaaacagactaatacaggggttatgttttatggaggaaaattttttaaaattattatttttttgagacaggatctcactctgttgtccaggccggagtgcagtgatgtgatcatagctcactgcaacttccaactctggggctcgagtgatcctcccacctgagactcccaaaaattaatgtgatttgatgatgggtaatttaacacaagatagaggggtatagagagatggatggaggaggaggcagtgaagaaaatgccctgaaggaagatggcaatcagcccttcgaaaaggagatgtgatcccagtgtgccgggcagggcagtgagggacaaatgggcagaggtggtttggagcagaagggaggccctgcctgttgggcttcctgtttgtgcagagtgatgcaggaagaaggcactgcagagctttggaggagacctggtgtcatctgactacagacttaaaagatctctctgcaactttggaagagcagaggcaggtgaaaagtgagtcccaggaaattcagggtggtttctctggacaccagtcccaaaagtgcattggttttacttttagaattcttcatgggcttgcactttattatcttgcaggggccaagagcaaattctttgtggggtattttttagtaacctaactacttcctttccttttctttatttccataggttttggggggaacccaagcagtatatgctgcgttcattttgtagtcttctattcctcatccccttcacaccctttccccgagtccccaaggtccattttatcattcttatgcctttgcatcctcatagcttagctcccacttatgagtgagaacatatgatgtttggctttgcattcctgggttacttcacttagaataatagtctccaatctcatccaggttgctgcgaatgccattaattcattccttattatcgttcagtagtagtccatcatatatatatatacgtgtatatatacgtgtatatatacacacgtatatatacacgtatatatacacgtacatatatacacgtgtatatatacacgtgtatatacgtgtatatacgtgtgtatatacctgtatatatacacgtatatatacacgtatatatacgtgtatatgtatatatgcacgtatatatgcacgtatatatgcacgtatatatgcacgtatatatacacgtatatatgcacgtatatatacacgtatatatgcacgtatatatacacgtatatatgcacgtatatatacacgtatatatgcacgtatatatacacgtatatatacgtgtatatacacgtatatatatacatatacacacgtatatatacacatatatacacgtatatatacacacgtatatatacatatatacatatatatacacacgtatatatacatatatacatatatacacacgtatatatacatatatacatatatatacacacgtatatatacatatatacatatatatacacacatatacatacatacacacacacacaccactgtttctttatccactcattgattgatgggcatttgggttggttccacatttttgcaattgcaaattgtgctgctataaatatgtgtgtgcaagtatctttttcataacctaaccactttctaatcaagctgtcagttttggcaatgtttgtagaagtgactcagaactgaatttccagatggtttgaaggtctgctgtgagggatatagaaacgttcagaggttgatccagagatgttatattgcattcaagaggagaaactttacttctaagtgtctgggaatatcaaagaagtgaagtttgatacattatcacactagcatgaagatgttgaatacataggatatcaccaacttctgtgaagcagaagagcacacacacaaaatgcagatatttggttgaggttcaaggtacactgctaacgtcacacctcaggctaccaaacaaagatgatccttacagagtcagctctacgaaagcaaaatgttcctaatgcaacacaagccaaatacatctatagagaacacctttgcttaaagatagttcttggagtttaggttgttgaacagagatgggaatggatttacttaaatttaatgcttgggatgccttgaatgagcgtctgtcactgaaaccgacagtgagttcaaaacgctgcatggtttataatagaaaagagctcttgtttgttgtgggctctccattgggaagctgggctgggcgcccagggtcctggcatagcacaaatctgtgcagtcaggagtccagacaccacatttggttttgaatcccccagtgtttgctgggccactgtgatcaatttagtctcatcaagcctcagttttcacattatgagcttcctacttcctacctcaaagggtggccatgagaattaaagaataagattcatggaaattacctggtatattgcactggaaatacaattattactatgattattagcaagccttaaatgtttcattctgcctctgtgatactaaagtttacaatttctccttagagtaaaataaattatggcattttggggatactatttttaatattaattaactcagggagctctactgtgcagaggtttcagaaattaaatgagggtgagggtctttctgctttccatgctgaggatcaagagagacctgtggttagctgatcccaccaaagaggctgatgtttgtttatcctgatgcatggctacggctggccgtggacagaacctgtgttggacaagtcccttatcaggcattaggggttgacaagtaactgtcaaagtagcacggtccaaactcagtaggtttgtgtgtttcacctagcttttgtcctttagttatagaagaaatgtaagcatgtttcatgattatgccagcgatgtttcatttgggggaactatcttggaatattttgcattcttgacttcttacacactgagtgtcactactgcctccaaattatggtgacaaaattcacacaagttttgcaattttatttgaggttcatatcaccttcaggtagagtagaagatgagtaagatactgttgacaatgatacagtatgtgtgtcaaacccccttctctctatgtcagagacgattttaacacattttcttagaaacaaacactacagccagatgcggtagctcacgcctgtaatcctagcactttggaaggccgaggtgggatgatcacttgagatcatgagttggagaccagcctggccaacatcatgaaaccctatctctactaaaaatacaaaaattagccgggaatggtggtgcacgcctggaatcccaactactggggaggctgaagcaggagaattacttgaaaccaggaggtggacgttgcagtgagccaagatcgcgacactgcagtccagcctgtgtgacagagcgagactccgttaaagaaaagaaaaaaaaaaaaaaaagaagcaaacactatgatttggtatcaattcaaagactgatgcacctaaagcaaaaaaaaaaaaaaaaaaaaaaaaaaatgctgtacaaactatctcttccaaattattgaactagatataagatttgataatgaaggggcctacggaaaatattgtttaaggatcattccgaagagcttacatagtccagttacaaatactgtcacacctccctctcttccccaaaatacatcacacagaaattttctctgttgctctagctatattcccaaacatgccatgttgtgcctcagttcaggttctcacccctcactgtctatcatcatttgccatcattgacgctcttggggtcctctcatcgctccccatgctgcatcccattttctgtgttgcagccaaactattttctcaaactccagtgctaaggataaccgtaccttgcttgaaatttttctggtgaccaactttgttcttagtccagatcctatccaggactcaggaaccatgtgtgatgtgaacatcgctgttttctcctaggacatatctcgttagttctttcccggtgtttcacaatccagacttgctacaatttcttttagtgcctgagggtgtctcccctcttcagccttcacacctgctgtaaatatttagtccattctttcctctgttgtcttatttaaccatgcactgttgatattctaattcagtctgcgcttgctcggggatggcctgtatcctacgtgtctctagcaccactctcttttctgcggcaagacctgtcactctgcattatatgtactttttgtgctttactgtaagccctggcagggtctatcttggtgattgttaaatctgtagcacctgttcagagtcaacacacaacagatgcttttctaaattattgttcttattaaacttgcaatttaatgatttttattcgcactcacatttacatactaaattgtattttaattgacaaatttaaattgtatatattgttcatctacagcatgttattttgaaatatgtgtacgtatcataatggctaagcaaagctaattaatatactaattaccttacatacttctgatttttttcttgagaacacctatactcttagcaattttcaagaatataatacattattattaaccatagtaccatgttgtataagagatcccttgaacttatttacatgttgcatttatttatttgaaatggagcctcgctctgtcacccaggctggagtgcagtggcacgatctcagctcactgtaacctctacctcccggattcaagagattctcttggctcagcctcctgcatatctgggattatacgcatgcatcatcacgcccaggtaatttttgtattttttagcagcgatggagtttcaccatgttggccacgctggtctccaactcctggcctcaagtgatctgccctcctctagcctcccaacaggctgcgattacaggcgtgagccattgtgcctggccttgtatgtcacatttataggtgtgtgtgtattatatgttgtatttatatgaagattttatatattctggagaatctgatgaagctcagtccctttttattctttatttcagactgagatctggaaaaatggaaaagtatacaagtaataaatggaagacaaaacttctttattggtaaaatggatctatgttgtttagaaacatatccccaagttttcatgagaataagtgagattttttaaattgccaaagaagattttgagttgcatatgatatttaatttttggcacttacaatgagtagccactagctacagtgacttttcacacttgtcaattctttttaaaaataagtgttcttggctgggcgcggcggctcacacctgtaatcctagcactttgggaggcggagacaggtggatcatgaggtcaggagatcgagaccatcctggataacatggtgaaaccccgtctctactaaaaatacaaaaaattagccgggcgtgttggggggcgcctgtaattcccagctactcgggaggctgaggcaggagaatggtgtgaacctagtaggctggagcttgcagtgaaccgggactgcgcaactgcactccagcctgagccacagagccagactccgtctcaaaaaaaaaaaaaaaaaaaaaaaagtgttctttagatatagtttagaaaactggccctttaacaaaacaaataacagaggaccaaacactacaagagaaatagagaaaaagaactctgaaggtagaaataaatgaatgtggactatgatggatttttaaacatccaatttccacataagaatgtattcggtgtatacttgaatttcaaaaagagctaagaaggcagaaaggaatgagacataactgtgccgtcagaagcatagttagcacgcttgcttgtttccttttgtgtagtcaaccatgggtgtcccaggagctacatggaaacacgtccagggagttgcctggtcctttagattctgctgtggccacatcccctgctaacaccatttctcatgttgatggcatgtcaggcaaggcagcactgtacatggacacaagacagctagtacagaactcactgagcctacactgctgtgtgttctttgttctctgtgacctgtctccacaagtagatgagaactccatgaatgacagctttatcaggttctttctcttcccttccaaaaccacttatgaaagttctttgtataaaaccgctcaatgaataaaactaaattctaaaattaggttcacccatagtcatgtatatgaacagcaatttctctaaatctcaatagatgactattggattatataagctgatatccctgaattttagtgagaatgatttaccaagagtttaaatcacaccacgttctgctcccacggttgtgcttgcattaccaaatttattctggatggggtaatacaatttctgtttgacatatgaaatatagcaggttgctgcagtctttgttaccatgaagagttgagattcttcaagttatcacaaaatagatgtactatgatgatgttccataaataagagggacctttaaattccatacggtttgctactggattgcaattaatattctgcagaaaacactctgctgtagctgttcaggaaatatttcttaaaaatagtggaaaacatttagatttcagacagctaactttttatctcccaaaatagcagaccaaaactcttattgcctgtgtaagatatttacacaacttcttatatgcttattcgtatgaaagcaatgttgtctagcttgtatgtctgccttttttctcatgtgctatttgactaccatctgtattctgaacttaaggcttaaaaactttaatcacaaactagaatagataaggtgtgttccagggctgccatagctactacatgcgggaagtgttaatgaacagattaaaatggcccagaaatcagtacatgcttccattttcgctgaagagagagtgagtaaaagcaacagtttcttgtgcaactgaccacactgtgcctgctcttagattctcattttttttccctgagactttcactcagaaatccctaaactaattgatatattttcatcaccttcggaaaacaagattgcagcacataaatggaagtctacagaccctgttttttggagacagtgtgagaacatgtccacgcggtatggacgtggcacatgctcccggcattactgaaaaccatatgacacagcacaacccagcacttggacagacatggagcctcccatgactctctccttgtccgtcaccatcagtgacataagcccagaaagtagcggattgctgttacagtggcctgtgcttgttaaaatgatgtgtgatcgtgcttaattatggtgctcagggaaaattcggttgtgtacatgaaataccatgtttgcttttcatacaaatgtgctttgtttgactgaaacaagaatgagatgattccaaaggtgtagtcaaaagctaagatggagcgggaactacacctgctgtgtttttccttcccttttgtggccccagtgtgaaatgctggactctggaaattcgggctataagtaaccacagaaatgaactgtctcagcagctcatctcgcttgtctcatggagaccatgagagtatagattttcaaacttgtttatagcactgtccaaattatttattagtgctgttggaattcagaactttgttggtgatcctgcccagaaaactaagagactggatgtcagagagcacttactgggaaagcaacaattttattcaagatattggtcagctataatcatggagtcatatttacttggccaaattccctgacggtcccgctgatctagtaacccgatttgggtatataaaagcattgattttgagctgaagattcagatccaacaatgtcctgtgtctcagctcaacaggtctgtctgccataacctgcaacgtaatgagaagcaggttttccagtgatcccactgccctgcaccagagcaagagaaatctacattaacatcacaggacatctccattgaatttccaaattggtgatcatgcagacacacgggattgcacaaactaatgtcagaccatagtaggaaatgagaaggaagaatgagtcattttaaaggatagaatttttcctttttaatattatagatttcttttaaagacatagaaaacgaatacaacagccaaggtagtaatgagaagcacctcagaatacatgaaaggtatgcataatgcaattttactttccagaattaattagtagaaatttagtcctgaaaaatcatcttgctatagtgttcctttcacttacattatactcgaggcatacaaatagttaatgctctgctgtgtctgttgccattgtttaaggctgaaacgccagctaggaacctcatggaggtcgaggcttctcaatgacgcaagctgcgctgttctctaattcttaactcagcaggaactgaactttttgccttatcaagtaacacatttctgagcacctaagtggtcatcctcacagaaggatactatcaggcttacaatctgcaccaaccagatgctcctggttgattcttgagttcaggttcactgtaaacttcaaaaataaaactaactccactgccgtttccaaaatgaataattgaaaatgaaggatgaaggtgctgatcaccagatgaagccagatgaacaaaataggaataaaaatttactattctagaatttctgtttttcaagtaataaaaatacacacatatttgtatttttaaataagcatatacactgatttttaataaaaactctatgtatttgtgtttgcctgtcaggaggaggatattcaagtaaccctcagctaactaggaaattctgaaacctggaaaatcccacgtctggccaattgctatagattcgtaaccccttttatcaacaggattgagaagcaaataaataggaaaaaaaaagtggagaaataattcagattactttcgtcacctacaacgttctaatcaaataccaaatagccaacatgtcaagaaaaaaatctgcatatctagattcattaaaagaaataatcttcatcaatacagttttgcataaattaattgctttattttcctgctacttctagaccacagtctggaagcaggatagcaaagtgagtagaaatatagactcttggaatagatcctgttttagatggaatctcagcaacatcaattatctgtgtgacttcctgtgagttgctagaagtacctgtttacctaattgtggataataatcgttcgcatctccttaaagatccaatgcatgagaagccaatgcacagtgcctaaatagagcccagggtatattaagttctatctctttgctattattattaacatcatcattgatattacttttaatttcaatagttgggaagtcattcaacttaagaaaagccaagctaagtcctcaaaattatttgataaaagtccttaaaagatacaactactttatgatattcctggaaaacgtataaccccagtctaaccacaagaaaagcatcagataaatacaacctgaggaatagtctacacaataccaaccaggactcctcaaaatacccaagatcatcaaaccaaggaaaggcagtaacaattcagagggaccagatgaggcaagacaattaactcagggtggatctgggtggttcctgggacaggaagaggacactaggaaaaaaaaaaaaaagccatggaaatctgaataaaatacgaccttcagttaataacgtttccatgttgtgatgcatgtacctaacgatataaagtattaaatatagggaaactggctgtggggtggacagaaatgctctgtactatctttgcaacttttctttaaacctaaaactactttaaaatcaaaaatgttaatttgaaaaaagaaatcagtgttgtttttaaatgtgtactactgttctggttaaaaattagtcaaattctaaacttttgggtcttaatacctttgtcacgcttgcaatgattccttttaggcataggttatggaatactaagactttgaacattctattactttcaccattctgcgcatggattgaaaacattccttaaacacataaagatggtacttgttcacgctccaatatattaaaaataataagtaaaatgcttcccatgattgagaaaaatcactctttcctgtttctcttggtccagttatctaataatcagaatttattatatattaaagagactaatactgcctatttatagttttcctctgtgctgtagattattaaaaaaaagacactaaaagctgtgtaaagttttactgtggtggtggtcattttattacaataactgaagacgaagcttcatttgctgattctatgctcattttcagtatgaaaaaatgaaaattacatctttaacattctattaaattgatgggcaatttcttttcttaaactcatactacaagacagttgaaaccaagtctggaggaaaatgcagagtcattaaagtataaaaggtggtggtcttcagagactggatccagggattggccctgagtaggtcctccacaaggaaacagttggatataggacgagaaggactgctctgagcccacattcctgagggagccacacattgaatgggcagagataaaggaatgaccaaatgcaaatgagagttactatatacaatcccaggttgtgattaagaaaagagaaacatcattctctaccttatcaaagacttcattttatttacacaaaacaaagaatagaggagttctcactatgaaaataacaattttgtagactttagtaacatcagccaattcaagataatatttagcctgtttgattatgtgttaaaccccaagataaaaaaaatccccagatttctaaattataaattctacagatgtctttttcttttttttgagacagtgtcttgctctgttgcccagactgcagtgcactgctgtaatcttggctcgctacaacctccacctcccaggttcaagcaattgtcctgtctcagcctccagagtagctgggactgcaggtgcatgacaccatgcccaggtaattcttgtatttttcgtacagacagggtttcaccatattggtcaatctggtttctaacttctaacttcaggcgatccacccaccttggccgcccaaagtgctgggattacaggcgtgagccacggcgcccggccccacagatggcttagagtattagccaccacaaccggccccacagatggcttagagcgtgagccaccgcgcccggccccacagatgtcttagagcgtgagccaccatgtccagccctgatgtcctagcgtggattctatcatctacacctatctacccttcccatgactagatgatcaatgaaatctccaaggtcactctactctgcaccagtgtttcattcctttgaaacttagtttcacttattttcagtcttgttgcctctcaccatgaaggggctgctgtttcctcaagggctggactcacacttagccactcagcattcttgatggcatacaattctgggtacctgatcaatgctcagccaataatttggggtttgttgagggagttggaaaaaatgagccagaagttaaacctgaaagaggaaccaagaatcttggatttggggccactttccacattgttcttccactcacttttcccaaaatgcctattgaaagaatctttcaaaaatatcatgtgcatttcagtaattcttataattgagtctgtctgaaagcattttaaaaggtatactactgaagaaatctattgtaagacacaaacagaagacagaagacaaaacagtaaattttgaaaaagagcatgttacaatagggctagaccatgatctgtcttttgggaatcaagtgggaaataaattaaatatttcaaatctattttcgatgcatttttctgatgccagtgattttatgtatttttcatcgtcttagtccccttgtgctgcgataacagaaaaacatagactgggtaatgtatgaagagcagaaatgtatttctcatggttcaagaggctaggaagatcaagataaaggcactgggaaggttggtgtctgatgacaactgctctctgcttcgaaaacagtgccatgaattctgtgtcctccagagggaggaacactgtcctcacatggcagaaggaaaagggcaaaaggggtagattctctttgttaagctctttattaagggtcacagctcttactgctaccaaattggcaacacctgaattttacaggagacaccttcaaacaccagcaccagctagtcgagttgtacagtcctatgtatttaaaaaataattaaacagattaaattattttggggtcacttattattactcatcatagttcaatgatatttttaaataatcagtttaattaaggaatgaattaggtaccacaaattttaccacgtctaaatgaacaatttaaggagtcttaatttaatttgacgaatttgactaaaggttatagtcatgtatccaacaccaaaatcatggtatggaggcttctcattcctccacaatttcctccatatccattttcagtccattttttctccctttcccttgctcctggcaaccagtgatctgatttctgtcaccatagctttctctcttccagaatttcatataaatggaatcatagggtacacacatttttgtctctggtttctttcactgagtgtaatgattctgagattcatccatttggttccctgtatcagtagttatgaactttttgttgctcaatggtcctccactgtgtggctttggcaccatttgtctatcttatcaccagctgactcaatggtcctccactctgtggctttggcaccatttgtctatcttgtcaccagctgatgggcatttgggttgtttccagtttggggctattatgaagaaagtcttacgaatgttccatcccaggtctttgtgtggaaatgtgtttttatttcactcgggtgaacacttaggggtggaattgttggatcacagaataggcacatactttttggtgaatgggtactccctcagcgaccttgtctctcctcacaactgggatggtggaagtcacctccaccagtcctacggcacgagctgcttgtgtttagacaaattaatggcgaccctcaaataaacacacacctcaattatttaactatttttggctacttacaaaatcagaaaagattcacagtaccagttttctttgttggtgaaaaagtggtctctccaagctcttccgtaccattttaaaaaaatttacctccttttaaaaattatttgttttatgttcaatgcacccattattcaattataagtatgaacacaaatttatcagtataggaagctcatttgtatctaagagcataatgaaatatatcatgattcaattagagtttatgatatttgtttagtacaggaagctcatttgtatctaagagcataatgaaatacaccatgattcaattagagtttatcatatttctttgcaaaagccaggtattgcctagtttagtctattaattttgagtacaatctgacttaataatctctgattagcaaacttgggaagctattgaatagttcgcacattgcccagttactgcattcattgagagtgtaccaagcaaaacataccacaaggtagcacgtctagtctgtgtatttattcactgtttgtatgcgaatatgtgtaacttaatgattgtcccttaggtcatatagagaaaaaaagttaaaaaattacttggctattgttcttgtagtttttgtaattacacttagtaaaacaatatgacttcaaaaatgtaaccctagtatcacaatttgaacacaaaatctttcttattcattcaaataaagaaaaaaatgtgtgtttctgtgattacacaatgatcttacttcctttgccatttctatcaggaaggaattgtccttcttgattatcaggtcaactgtcaaggaaccacagtgtttgtgttcaaggaacccttatttgacttaacaattgcccaagagtaatgaaattggcatattgttatcatcattctatttttttaaatattattttatttgagacagggtcttactctgttttccaggctgggagccatcatggctgactcactatgatctcaggctcctgggctcaagtgatctttcgacctcagcccctggagtggctgggacaacaggtacatgccaccacacccagataatgattttattttacttttgtagagacaggggtctcactatgttgaccagcctggttccaagtccctgggctcaagcaatcctcctgtcccagcatcccaaagcgccaccatgcttgtcctattttatcattagtcattgttgtgaatctcttactgtgtctagcctgtcaattaaactttatcaggagtatgtacgcatagagaaagcataatacatatggcttggtttcaggcatccactgggggacttagagcttatctccttgggacaagggaaactcctgtatgttgaaaatgccctgtcccagctgggcaaggtggctcacgcctgtaatcccagcactttgggaggctgaggtgcgtggatcacgaggtcaagagatccagaccatcgtggccaacatggtgaaaccctgtctctactaaaaatacaaaaattagctgggcgtggtggcacctgcctgtaatctcagctacttgggaggctgaggcaggagaaccgcttgaacccaggaggtggaggttgcagtgatctgagattgcgccactgcactctggcctgggagagagagcaagattcggtctcaaaaaaaaaaaaaaaaagaagaaagaaaaaaggaaaaaaaaggaaatgccctgtcccagcagcagggagcccagagagttttcattactcttctgttgttgttagtgcattctgccctgaagaaaaacatcaaagaaaatctggctaggttcggataccctttttctctctttttattcaatagacagcaaatttaaccaaggtaaatttcagcaccttgattcacgtatattgacattgaggtgaagaactatgacctgttagaataaaactgatcaaagatgaccacaaaagattttagtgtctaccatctctaaaaggtgagtaatggaatctgcattgtatttcccactagaataaaaggggttttatctcaagtaaaatgtgtctctgtgaacaaaaaagctgggtctatgtagaatcagaaagaattatttaaaaaaaatctgtgccaatctgaaaatattcttgataatctgtgaaaatgtaaaaaagcagaacagactattgcatgaattatacttggtaacgttttccaaatttgtattgtcctatccctaatactttcctttcaataacagtagatacaaaagcagagcatgtgaggagctgtattagaatcaggatttcattctcagtaatatacacactactcctaaacgttccatcctgcacatcacatgagttaaattatttcttgatcatcaatttttttaagtaccagaggttattttgttccgtaggttacgtatcagacagtgatcatgagactcatagatacttggaactccccttttggatctaatttagctcgacttctctaactttgcttttttattaaaaaataggaacatcacttttcaaatcaattaatggaaaaggaagctggagactgtccacctgctctttccctcaattgcctcctctcctccttcaatgtcatcttaagtgacttctccttattaaacaccaggacagatgaagatacaaggcaatataattttttatttatgtttttatttcttgacactgccactttcaaggtgagatgccataattaactttttaaaaacttgtcaacttactttatttttcttacattacaaaccactaagtcaaattattgtgctaaactttatagtttactaaaatgtaggcctgacataaactaattggtgctaagttatatttaatgggttgtgcccagttagtttcctcatgttccaaatcactggatgtattagtccatatttgtactactataaggaactgctcaagactgggtagtttataaaggaaagaggtttaattgactcacagttcagctggggaggcctcaggaaacttacaatcgtggtggaaggtaaaggggaagcaaagtgccttcttcacaaggcggcatgaaggagaggaatgcagggggaattaccaaacacttataaaaccaacacatctcatgagaactcactcactatcacgacagcagcatagtggaaaccatccccatgattcgatcactctacttggcctctcctttgacacaagaagattatggggatcatagggactaaaaatcaagatgagattttgggtgcagactcagccaaactatatcactgaataagcataacaagaactggtcagattttattttgctttgagattttcaaggccagcctacttcatcgcaaaccacaaaatgacacaaataaaatcagaagtgcaaactgaagtcctggaaatgaatcagtactgatttttcttcaagtcaaaacttctcataaaaagatggtccctgtctcctatttaataataactaatcataaaaatttaacaatatgtaatgattccacaattcctatatatatatttttgaaacctttaaaatgaagattttcacagtcaaatgatgaaaatatttaataaggatgaagtaaaaagaaccttcttcatcaatataggtgtatggaaataatcatatttcaaatctatgagatatgaaacaatctatttgaccatactctgcaaatctagtgttcatagagtgatcccacaaaaataatgatatttattaaacttctgttaactcactttatcccttttatcaactttttttcaaattccatggaaatgtaaaagtaactatttaatttaatcaggctaataataacctatcttaatgaaattcagagaggaaacaagagactactttaaaaaccctctctagaggaccaattgcttccagcagaggaggcgtatgcctgtcaaatcgattactgtcaatgtgtaatgttagcatcagtttatgagctcaactgataattcacagggctgacaagcgcccttgcagaatcaggaattaataaggtaaaggaattttgaattttagaaaatggaattaagccttaattccatgaagaacatagtaactttgtcaaattgcattatctgcttcgttgcgtctaccattacttatatctgaaggtaattacaaaatagctattattcttacagcacctgaaatttgaaattaaatagatgttaaattattatataggttttagaagttctaatttcaactatatggttggggacctaaaagtgatatgtgagctacgtagaatgaatttccttgactgttaaacactcgaggaaggggggaccttaaaagtcactttagaaaacaaacaaacggctctgcagccagaactgcttccttattcagagacgaatggccaggcctcaagagaagcataactcttgcagcttatgccaatattcaaattacagtacaaatcttgacagaagctgggctttaaagaaatggcacgagaaacgaaactgtcaagaatattaaatcaccccaaactgtttatactgagcatattttaccaaagaaggtattcaaataaaaatgatggggaaaaaaaagactttcatagcaacccttaaaagactgaccataccaaatgtcagcaaacatttagaaaaactgtgtgtaagagttcaccgttagtgagggtggaacttagtacagccaccatggaaaacagtatgcagctttcttataaaagtaaaaaagaactatcatatgatccagtcatcctactagtgggcatatacccaacagaaatgaaatcagtacatggaagagatagctgcactcccctgttcactgcagaatcattcacaatagccaagatacggaaagaaccgaggtgtcaatcaatggatgaataatggtaaaaatgtggaatactatttggtcataaaaaagaaagaaatcctgtcatttgcagcaacacggatgagcctgaaggacactttgttaagtaaagtgagccagtgacagaaagacaagcacatcatcatctcacttttacggagaacctcagaaaactgatctcattggagcagaggatggaatggtggttaccagagactgggggaggcaggaggacaggaatggggagagatgagttaacaggtgcagggtctcaggtagaagtaagaagttcttgtgtgctattgtacagaagggtgattacacttaacaatattgcatggtatatttcaaaatagctagaagagaggattttcaatgtttttaccgtaaagaaacgctgaacgttggagatgatgcaaatgctacgaaccttgatttgaccatttcacaatgtaaatatgtactgaagcataaataaacagaaatgataataaaatgctgaaggaaatataaaatgcaaaaattattttgggaaacaatttggtaactttttaaaaagttaaacatgtagttaatatatgacatggcccttccacacagaggtagtgacccaagggaaatggaagccatgtccaaagcaacacttgtacacagatgttcactgaccttcattcttaaacgcccctgcagggaaaaaggcatgaagacactttgggggctgtcaggaacgttcaatatctttcactatgaggtattcgcactctgggaggggtcaacaatgttcaatatcttgacgaggggtggtgaaaacaagggttgatgtttatcaaaactcatcgaattgcacacttttgaatatctgcatttcttgtgcataaagtataacttaatgaaatggttaaattgttaggtttttcagcgtaaaattttctatgaaataaagtctatggttgttgttttctatggtttgtaatttataccttacctataataaattacagatagtcccacctcccccacaaaaatacatccacagcaacagccagcactactgagtttggtcacataaactgtgcaccagatcacaccaggggcactggccacactgtctatttcttatatttgtcaatctcgatatgtattaatcgatatctgtatgtatgtatgtatgtatgtgtgtatgggtatacatgtacaaatttaattataaaagaggataaatcagaacaaaaatataattgccaagtatgtatatatacacacatgcatatatacatatatacacacatgcacatatacatatatacacacatacatatacatacaaacatatgaatatacacacaactatactgggaattctaatatctcatcttccctctttgatacatcttccactgatatgtaggactatctgctataagggagatgttattacatcattattatcaatatgaatacttacaggtgacatttaataactgcttactatgtgctgagaaatgtagaaatcattttgtatgtgttgtatagattttaaactagattataaacaccatgagagtggaagctgtatctgtcttctgtttatttttttaatgctgaacaaattgtctgacatatgtagtaggtatttaattaatgtttatcaagtagatgatggttatgaagtccctttatttcatcattacaacatgttaaagcatttttctgctaggcacagtggcttacaactgtaatctcagcaccttgggaagctgaagcgggtggatcatttgaggtcaggagtttgagaccagcctgtccaaaatggtgaaaccacatctccactaaaaatacaaaaagtagccaggtgtgatggcaggtgcctgtaatcccagctactcaggaggctgaggcaagaggatcacctgaaccctggaggtggaggttgcagtgagcagcgatcatggccctgaactgcagcctgggtaacagaacgagactccatttcaacaacaacaacaaaaaaattcaaagaagctctttgtaaatatataagataggttctattgtttaccttattttacagataaaataattgaagaaaattggataatattctaagcattgaatagttgcatgactagtaaactggagggttcagttcggtcttttctcactgcattgtctgagcccttaaatctctcttcttggttttagttccttagcaagatcaggaaccctgctagtaatggattctgggaaatgcagtttccaggcttccagactttctgttctagacagtaaggagcccatgagaaaatgaatatggttaaaacaccaacagagctagcaactctatggactctctatggaagagggatgatggagattaggatttcccagttccactaagacacaggtccatgcaacagctgaaactccccatccctcaccttccctcccatgtgcagatgtcacacctgggccatcactaatcttgtctaaccctgcatactctcctctgctctacagaaaggcagtaacttggagagtgaaaattttcccatctcattttcccactaggcagttgctttagtgtgccgcttttgtattcccagtttgtcttttcccggaagtcagcatgtcactttcagttttaaaaggctatttaactggtattcatcttgccgcctccctgacccatcccatccccatgccttttttccagtagtgcatgcctctcttccatcccttgtatgagagttaaattatactttacttgaattttcttctatctctacttgatttacctcatttccaccaataaacaactgacaaaacttgtttattaatgttctcccttcatgtttccggtaacatatgacccatagtcttgctaaaattaagaggaaacacatcacatctctcactttacttttgctctatctacaacgataacttgttcaatgactttgaaaatttgctcctatttattcataacattggagaaaacaaatattttattccatacaattgtcatttcctaccagcctgccaccacgcccacagtgagataagatatcggctgctcttctgcagcacctcttacttcctgccttgacatgactttactgtgtcacacttctttcaaatgttagtagatgcttgatagtatcacagactcgaatgtgatcatgtaagagatcactgtgtgaattccatgttctgctaaatttttgaagttcctactctgaaaattataacataataatagggtctgaggaaaagtcccagaacccagttggtagttatcaaccaacaacttaccagaaagatgactcagtagattgcttggtaatacctgaacttcttaatctgggcattataatcaggaagaggcatgggtagagaactgaatatgactatggaaaaataaaacaccttttaaataaatagatttttaaataaaatatttgggattgagaaactatgcaaatgaaagatagacggttaaaagaaaaaaaatcatttaaagtgtttactccttagcattgtcaagtgatgaaatgtatttataccacgacagttcctgcttagcttttgcaggtaatggttgccaagtctttggtgcaaaaatagaaatgataatttttagaaaagttgttactccttcccattactgaaagttaaaaattgttttcaatatgggcttttttttttttttttttttgagatggagtctcactttgtcaccaggctggagtgcagtggtgcgatcttggctcactgcaacctcaacttctgcctcccgggatcaagagattctcctgcctcagcttcctgagtagctgggactacaggcgtgtgccaccacacccagctaatttttgtatttttagtacagatggggtttcaccatgttggccaggatggtcttgctctcttgacctcgtgatcttcccaccttggcctcccaaagtcctgggattacaggcatgagccactacacatggccaacatgggcttatttttattctacattgtttatgtgaaatggatctgcttaaatatagtcatcagagtaatgcctaaacacacagacacacacagttacatttcttctaatcattgaagaacataccttatcaataaatgggggggttacagtcaggttcttccagtagcagatggcatacaaaattcagtttaagatgtgcaaacaagtcattgaaaaaataaatttacttgaaaactgtgtcatagcaacctagtttttaaaagttataatccaagaaatacgttttatacagagattggaaggttagaaagttgcattttgataaacatggtgggattctgaagaaacaatgaatgaaatagaaataaactttattagacaacttttgtggaactacagttgttgacatagagatgtagttacttttctgtttcttcaaaattcttctaacttatctccaggtcttctgaccatatagctttattttgatttccttgacagggacttccactgcctgactgtttttctgcaaatattttcaatgagaatcccttctgcctttcaaaatgggcattaagtgaactacccactttcttaatatcccctttgctcctaaattaaatattttattttttctttatttgtggttggtgttgtgtggtgtgggcggattgcttcttggttcatttttcaagatctccttattatgtaatgaccatggttctttcggacagtctaaattattttctcattaaagccatgcacacgtgccacactctagtgctgacgagggcatcttctttatgtcttggcccatcagatggccatttagcgcccaacattggtgagatgcttctctcttagtggaaagtgacagaatgcctgcaaccccatattcttattttctaatctgaagttaaattcaggcttgtgttgacttttatttccctacgtaagacttcagagcagattcaccagtgcacagttctaggactgaaaaacgggctcccgtggcagctcagccattctctgttgcactggaaattgcttcctgcttcaacttctggttaagtcagctagaaagttccctggactaaggtgctcaaccctgcaaaatctcagatggctcccaggcaagactcccctctggaagtctaacgatttccttttaggtggcaaagcactgagtgatttctctgctttctcatgaactacaacaatcgcatcattcctggcattctttgattatgagacctgaggtcttagtagcatctgatgctttccagagtaaccttagaattatataagaatacctttgaggttctctggcagtaaatgtttagataaggccatcatagtaaatattccttagaacatttcccatttatgccagcgtcctttcagaatattacctctgtaaggtacgactaaatcgttttttaaaactgtgtttcattttcaggttgatataatctctaatgcaaaactcatctaattaccagtagatgttcctatatgtaataccaaaattaaagatcaaggtgattttatgacttttccatttaatttcttctgagcatttgtaaagagttccagttaattcaatatttgcttattccatacaagcctatattaaagaaaatagtatccctgacagttaatatgtgttttcactgcattttgttatagacagttcaaaaatgttctgccttgattatgaagtacaaatatttccttctaaatagtgaacataatttagattatattacttctccagcctaaaatcatgaggaaatcccatttattagtgttaaatctcaacctaattgtttgatctgatctctccaccttttctccatatccccctcattcctgccccatagacttcattttgctgctgaataaaatcactaatttaacatccgcagatagcttgtctgctcccatcttgtattcatctcctggaacagacagttccttacacttctcgcctatatttctatgagtcagagtgctggcaggaagtggcacactcaaatcggaaaattaaaaaaagttaatgcaggaaatatcgggaatacttgtgattggtttaagtcaactatcacgggctagtcagcacagttcccatgtgctgttcacagtggatccatttatccccccagggagctggtagcagacaggacagggagctggtagcagacaggactgggagctggtagcagagaggacagaagcccctggtgggagctgctacctttggcaatccatggaagagagacggagagacagcacacccctacttcactcactctgtggcctcagtcactcccctttggtgaatcccaatgagaagtcagagggcaaaaaagccccttgatatgttcagtcctcagagcacagagctccctgggaaagaaaatagtatccctgacagttaatatgtgttttcactgcacatatttcactgcacatatttcactgggaaagatgaagcatggggcagaggggctgaaacagatgccctgagtggttcttctccatcagcccagccacccagtcccgccacctctctggagacctcatagaaatgcctgaaacatcacctgtggatgcctattgaacacatcccactcttagaccaccacattctgtccaatcctttcaggcttttgggcattcctgaagcccactctgtccacctctccactctgtccacctctccgcctgcatggagacttcgaatcagcacatctcgtcatgtctgtcttctaaccacacctccaacctagcgaccttgatgactatgagctgttacatgaggcaactcctctcacctgcacggtgccacccaccttccgtcctacctcctgccttcacccagacctccttcccatcccaacaccctacacgtcactcaatcaggttcttcctcgaacaatgtgtgtcaggtcaggcaactgccctgcacaaaacttccatggcttctgattgcagagtgacaagagaaacatggcagggggctgatgccttgattcctcctgactttgcttctgccccactggaaagatcttccccttggatgagtcttcccctatagcttagtctggtcttcctgcaattaaccagatgcaatccatgccatttcactttgcaactttgtatttgcaaatgctctcttctgggacacatcccagctacccaggtgggcagctccccactcccttcaccagcactcccttccagagactcacactgctggttccaccctaaggagcagaggctccctcactctccagccctctgaccattcccctacatttttctttattgaatttattaccacctgggagaacatcaaggctaagataccatcattataagatgcttaattacttcatacactattgaaaaagaaaattaaaatgtgacatgagtctctcttaccaacgcgatagtaagatacatcccatatcagaggtacaaaaaggtgagaaagtccatgccttagaagccatgagacaggttatatattactattattgttattattttcactgcaaaactgtctgattagaatgtaaaatctgtgagagctggtcttttgcccagttgctacttacgtaatcccagccctcaaaatagtgcctggcacacaatattcagtgaatatgcataaaattaattatgtaaattaagtgtaatgtttagtggctttaactatatcattgtttcattttcttttctaccttctatatcttataaatcttacgtatgttttattattgatcataataaacatcacaccaacatagtgattacatgtatttcaaaacaagaaaagtgtgagtcttgtattgttctatatacgcgacaccttagaaacgctttctgagtaaaaggcagtcttttcaacacattggcaatgagcatttttaggagtaaggcttaaaaaaagatattttcttcttctcttctcaaaacaaacactgtccatggctatagatttttgtcagtatgctaatatgttatgattcgggattattagagatgaaaacattaaggtaatgccaattattattttctcagccactttatgtatggcttctccaaaaaaaagagtgtgaagctaaaaaaaagagagaaaaaagcatgcaagaagcagacagggacttaaacaagacagcttgaaaacctggcttattgctcatttaaagtgtggagcttaattcttatctctggctatggttctcatgcatcgaaaaacttcaaagactgaagtgcaaactcattttctttgcttgatcctcctggtagggagggaaaaaaatcaaatgcaattgtgtgaatttatcataatactgttcaaggggaaaactcataaaaatcctgtctgttgctcacttgatttgatgtatccttgtctaataccaccattcactgaagacaacacaggcatcccaaatgacggagcggctctcaacacgtcaaccccactccattattattggcctcaactcgggaaatcttatctatgaggtatagtttgcattcatataaaaccctctttggcaattcatacagttctgacttatcctaaaggctgaattaaatgggctgtgtaatttgtaaacagaattcacatttattctaatgggacagcgggaaataagatcaacactggcagcttctccagccctgctcaaagaaacttcaacagaggccaacgtatccagggaaaaactggactgcaggagcccatcctcaatgaatgttatttatccttcagagtagattctcttctttacatagaagatggttgtgattataatttattattaacattaatgttttccctttctaatcacagtcaaaaggaagacagaacaccctgttcccaccaaagccactatagatgcagctaattgatatcttttctttttttttttgtttcagagtcttgctctgttgcccaggctggagtgcagtggcacaatctcggctcactgcaacctcagcctcctgtgttcaagcaattctcttgtttcagccacccgagtagctgggattacaggtgtgtgtcaccaggcctggctaattctttagtagagacagggtttcatcatgttggccaggctcatctcgaactgctgacctcagatgatccgctcacctcagcctcccaaagtactgatacctatttctaaaatagaggtttttgtacaaataagaattaagtatccatagaatttacccagtagaaaagcttcagacttagctattaaaattatttgaatattcaggtccatctgtgatttggtaaataattaccatggggttttattatttttaacaaatttttgaattttgagataattatagatccatatgcagttgtaagaggtaatacaaagttctcatgtaagttttaggcagttacaaagatcttgtgtaaccttcgtgcagctttccccaatggcagaattttgcaaaactgtattataacatcaccaccagtatactgacgttgaaacaggtgagatacagaacatgtccagcaacacagacatccctcccgttgacccttgatagctacacttactttggcccatcaacacctccctccttaactcctggccactactaatctcttctctcttcctataagaatgttgtagaaatgcatgtgaccttctgggattgacttttttggtcagcaccactctctggagagtcatcaagttggtgcttgtatcaatagtttattcctttttattgctgagtgggatttcatggtctagatgaattaatttgtttaactgtttgcatcttcaatgacatttgggtgatttcctgtctttgactattatgactaaagctgctacacatattcctgctactattacttattattatgttatgtgaacagaagccttcacttctctgagataaatgattggaagtgcaattgtcgggtcatatgataattgcatgtttagctcttataagaaattgctggccaggtgtggtggcttgcacctgtaatcccagcactttgggaggccaaggcaggtggatcacctgaggttaggagttcaagatgagtctggccaacctggtgaaacctcatctctactaaaaatacaaaattagccgggcatggtagtgggcacctgtaatcccaaatcccagctacccaggaggctgaggcagggagaattgcttcaatctgggaggtggaggttgcagtgagccaagatcgtgccactgcactccagcctgggtgacagagcaagactccatctcaaaaaaaaaaaaaaaaaaaaaaaaaaaaaaccaagaaaaaaaaaagaaaaagaaaaaaattgccaaactgtttaaaaatgtggctgtaccattacacattcccatcagcaatgtttgagtgactcaacttctctatttgagagcatttggcaatgtcagtatatatatatatatatatatatatatatttttttttttaatatgtatttttaattttggacattttgatagctgtgtataatagctcatttttgtcttaaatttccctgatagctaaaggtgttacacagtgttctatgtgtttatggtacatgttctttggtgaaaggtcttctgaacatatcctaactctgtgactctgtgtgtgtatctgtgtgtgtgtgtctgtgtgtgtgtgtgtaattgtagagtcttaagagttctttatgagttcttatcagatacgtggtttgaaaatgttatcttccagtctacagcttatcttttcaagttctttatatgatttttctccgagatgtttttcattttgataaggtaataatcaattatttggtaaataattccaattgatgaattatgttttgggggacaagtctaagaaatatttgcctagtctcagattgcaaatatttcctcatatcttttactaaaacttttatatgtttacatttacatttaagtctattatccattttgagtagatttttgtaaaagatgtgagattcacatggaggcacatttttggcctatgtatgtccagttgtcctggagccattcactgaaaagactattcttcctccattgaattgctttggcccctttaccaaaaaccaggagggcatcttctgtgggtttattcctgggctttctattccattccattaatctctgtgtctgcccttccaccaacaccacatggtcttgattactggagctatataatatgcagtgaaattgggtaaggtgcttttcccactcaattttgttcttcaaaattactttagctattccagttcctctacattttcatacacattttagaataatcttgttcatatctacaaaacatatttgctgagattcttataacaggtgcattaaactgtatatcaatttgggagatttgagatctttactctgagtgtcccaatacatgaacatactatatctctctacttattttgatctttggtttctttcaatagcattgtatagttttcagtctatgagtcctatacatatacagttttctttagatttccacatattacattgttttgagtgattataaattgtattttaaagaaattgggtgttcacgtgttcatattattatatagaaatacagtagattttgttgttgttgttcatcctgtatcctgtgaagtcaccaaactgggttcttggctctaagagtttatctgtgaattctttgggaaattctatctagacgatcacgttacttgcaagtagagtcaggtttactgtttttctttgcaatctgtatgccctgtttctcttatccttgcaattttgaatggacttgagcttccagcactatactgaatgggaagagtggatatccttggtgggttcttactcttagggggtaacatccagtctttcatcagtaaggttaattctaagtgtttttttgttttgttttgttgttttgtaagtgctctttatcacaaactgaggacgacccatttcctcctgccttgctgagacgttgtcatgaacagacgttacagcaggcttgatggtggcccccgataacgacatgtccactcccttgtccccagacgtggtgactgtgattttatttggaaaatgggtctttgcagatggaatgtagttaaacatcctgagattagatcatcctggattatgttggtgtccccacatccaaaatacgaatgcctttgtatgaaacacatagaggagaaaacagacaccaagagaaacatgtgatatgaagacagaggtaggagttccagcggtgccactgttagctgaggagcataggagacactgtaagctgtaaaaggctgggaatggtttctctccccgggagatctggcagggagcatggctttgctgacaccttgattttggacttgtggcctccagagctttgagagactgaatttgtattgttttcaaacagtacatttgtggtggttagtttccttaggaaactaataggggtgttgaatttgtcaaatgctttttgtgcatcgactgatataaacatgtgatttttcttctttatcctgttaatttaataaatgacattgattttgaaatattgaacagtctttcattcctacaaggaaaacacttcatttgcttatggcatataatttcatatatatatatatatatacacacacacacacaaaatcctgtaccacgtaaggacatttcaatcaatgatggatcatgtatacaatggtcccataagattataatgtagttaaaaacctcctatcacctaatgacatagtagccattgatcatagcacaatgcattgcgcatgtgttcctggtgatgctggtgtaaataaacctactgtgctgccagccatgtgaaagcggagcagtgcaactgtacacagcaggtaacacttgataataataagtgactatgacattgctttatatatttactatgctatactatccatcactgttttagactatgctccttatacttacattaaaaaaaaatcactgtaaacagccttaggcaggtccgtcaggaggtatccagaagaaggcattgagatcactgaacatgagagcttcattcatgtgtggtattgccccgaagactttccagtgggacaagatgtggaggcggaagacagtgtgtaggcctaagctatgttttgtgtgtttgtgtattagttttaaacaaaaattttaaacaaaaaattttaaaaagtaaaaaaaaaaatacaaaattaaaataaaaaatgtttacagaagaagactataaaaatatttttgtgcaactgtacaatgtgttttaggctaaatgttatagcaaaacaataaaaaattttaaaaaatgaaaaggtttataaagtaaaaaagttacagtaagctaaggttaatttattattgaagaaataaattttataaataaatgtactgtagcctaagttcacagtgtttataagtctacagcagtgtatggtaatgtcctaggccttcaatttcagccatcactcactcactgactcacccagaacaacttcccatcctgcaagctctattcatggtaagtaccttatacagatgtcccacttttttatctcttatacagtgtttttactgtaccttttgtatgtttacatatgttcgatacacaaatgttacttcttgttacaattgcctgtagtattacagtcacatgctgtacaggtttggagcctaggaacaataggctgtaccatatatcccaggtgggtagcaggctatacaatctgggtttgtgtaagtgcactccacgatgtttgcatactgttgaaatcatctaacaacacatctcagaacgtatccctgttgttgttaagcaatgcatgactgcatatgcatgtatatatacacacacatacacacgtacatatatatttgaattctatttgctaccattaagaatttttgtgtctatatttatgagagatattagtacatagattttttttttgttatgtctgtacctggttttggcctcagaatattataacttcacacattacttgtgaagtattcccccatctattttctgagtatgtgtagaattgctgtcaatttttctttaaacatggttttattaatttaaatcattaaaattgtcctctttctataggaacttgcatatttctgtttaaaatgataattacaatgaatatgagtttgtatatgtgactaattatcaaatcaaggccatggacttgcatttgtacttatgatgccttttctagcagacatccactagtgagcagtgtacactgcacaccacgtgtcaccttctgctgcaaaaaaatgtgagaggatacacgcacaaggctattcatgtcagactatttcttatagcaaagaactggaaagagctcatcaatagatgggttggaagactgattgaataaactgtggcctctccatctactctgtggagtgctgtacagccagagaaagaggagagagagagaaagagaaagagagcaagctactatagaatgagctccagaattcattagatagaaaaaaaatagagcctaaaacacattactgcttacccaatttgggaggcgggttgacacaaacatctaatatctatatatagagatatctacatatgtgtgcgtctgtttcttaaaagcaagaatgaaccagaacaattctacaaattagtatttacagggggaaagtgaaacagtttagaagagaaggaagcagaagtgagaccttcaaattatacctacctttgcagagttgactgtggaatatcaaagtatgcaaatctttgtatatcacaataaaacaaaattattttaaagcaatctaaaatgtttaaagaagtaaatctaattgtgaatctagcaatggacagctttaaaggaccttgaaatacagtaatttgattgggagacatgaagtgtaaacatgaatgcaaaaccattttagattgttttcagcactactgatgcatatggaaatgttggtattgctttcaaatttttcacgtctgtgttgtaagatacagcaactgagaaattatgagatattctaattccacctttatcagagttactgagagcggggacactgggtgaggaaaggactacagatatacaatggaagacatgagaaaaaaccttgcagtgctgaatgtgaatcaggcgtatcagcatgaaatcttgtctctttgttctatacacacacacacgcacatacacactcactccctatcgagtgaaagggcccagaaagaacaagaaatcaagcagtgattaatattgtaagtgtccagatcataatgttgaaatatcatttgccattcaaggaagccaagaatcactgggctggatgactaatttcaggtttgaagcagaaattacacaagataaatttggaatggtttatcccactggatggcaaagaagctatcatcgactcaggagtcaagaacacactaaaaggcaaaattagcacaattttagcatcaacaaagataatacattccatagattgaaaatcatcagactgttttaaattcatgagttctttcctaacaatacaaaacaataaaagaaattactgtagagcagtagtgctcaaccagtagaacttttgctaccatcttctctcccctcattgggacatttggcaatgtctggaggcattggtatttgcacactgagggtgaggatgctactggtatctggtgggtcaaggccaatgatgctcctaaaaacctacagtcacaggaccgtccctgccttaacacccaaacaaaagtatgcagtggaaatggtgataggcctgaggctgaggaggctatgaaaacttcctattctgaatgtaatatataaatgtaatgtaataaactgaaaaggccacatttatcctgtcttgcctatcaactttgccaccagacaaccaaataatatgcttcttttataggagaacctcagcaagtaaatacaaaaagaagcaacagaatcagaatactatcgatttgtggcatttagtcaataaacacagctggtcagtgcacgtcagtcaccccgtctcctgatgggagaaaacaccactagctatgaagtcctcatgtcagaaaaactcaaactcgaacctgtccaagcctctttatccagtgccaagtcacagaaactttcttaaacactctggagatgcaatcggcaaaatgtctactatggcaaattcaacagggaaaaagaaaaacagaaaataggagcaacatataaactaatatacttacaacctacatcaaacaatcacaatcataacacagtacacttttaataattcttttatcacctcatcatgaaggaaaaggaagccattttcagtagtctgggttacgttctctgggtttcactggtggaagaagaagttataattttggggacgtcactaaggtaagggtactaatatatcctgggtacctatcacattctgcagattgacgtgtatacatatatgttaccatcttattttcacaaacactcaagaggcagatatgactgtgcctacttgcagatagttctcagaaagagaaagtgaattacaaagtgaggtcaacttaaacacacagctcgagcagatggaaccaagcctctatagctgcaatgtgcacaactcttttcattacacatttttttttaatagaacagacttcttatgaaagtgcggatgatgaatcagtgcatcacagaccacaataaagaaggccagaagagaggccattcacttgggagacagctgtaataaccaaggtagaaatacgtcggaactagaggggacgagaggaaacaaggccatgtagcaaatgaggagttctgatttattcgaataaagtccacaagaacaagaacaaagccatgtaaacagtaagaggataaaactttgagaaaagacaaaacataacacccaaaggcaactgagggattatatccttgaaagaaagagtataattcaagatggtatgttatagaaatagcaaaagcgtaaaattgagatctatcatcttgactccaaagaagattgtacagagagacagagaggcaacgatgaaatgactgcttgttctgggcacaacagagggagaagggaatgtaatggaaagtcaaaaatactgtcccgggcccggattgataattacatttttgacaagaaggtgaacagtctggaaagataacagtaaagttgaaatggactaaaaactaatttgagaagtttgttgtaatagaattgactgcaagaaaggaaattgccatggccccagggagaaaaagaaaagaggatgagggagaaaaaaatcgtgaatgcactttctgaagcactcctagtccttggaagagggacagactctcagaaatcggaaacgtgtgctgcatgggctattgtaaaattagttttctttaccttttcagatcattttccatcaggcaagtcacaaatttacatagactgtttgcaaaatacacaaatgtaaatatggctttcaactgaggatctgtcctctctgttttaatacaatgtatcctgacaaaaactcagttatgattcctactttgtagataatgaaactgatgatcagagaattaattactgagtagttcatggtcatgctagaaacaaaaagcaaactcaaggatagagtgcaggtagtgacaggataaaccacagcttcctctccacgggtaaacagattctcctaacaaaggtttcactctgtgtagacaaaagaaacgctgtttggggaatctagttaggaaaaaaatctggtaaaaagtaaaaggtaaataggaacacatgccattcttgaaaactattttacttataaagtgcaaaaatgcataggatgaggttatctagacttcggaatcctgacgtcgatgaaatggaacctgttggaaatataaatatgtatgggtggtgctcaagttattatttttgacttctagctggtttcattagcatttctttttctaactttaagaacttgtaagagaaattaaagcactaattgagttgggggaagaaaggaaataattagcatgttgtctgctcacacatagtgacttgttaacaaaggagttgaagatgtaaagaataaaggaattggtgaaatgttatttcattttcaggaagacagaaaattcttaataaaattaaaacacagcgtaacatcagttgttatattttgagtacctcattaataaaaggattaagaaaacatcaaaagcacaacagacatgatcaaagagccacgggcactgatgaaaagatgaaaagaactctatggcaaagaaaaatgatgaaccagcatgcgtctgcatctatcaaacacaaattaacagaaaatagcagcacacttttttatgacacaatttcaatagaattaaatattttaatgaaataaaaatcctaattcagtttagcagtggagatcagtaactgagtctcagaaaaagggaaaggaatgaataaaagaagaaaaaaaaagatggcttaggttttacccaaagataaaccactttaggaggtatttttagataaagtggaaaatgaaaagtatttagggtaagagcgatgcatattgcagaggaatgggaagtgcaggcagtgtactttgtgcggctggtgtgggacaggtggcacccggaaccactgttcacagagggcgacaggaagggtcagaggttccgtaggattagcccctgcacatgtgatcatttggcttcttttaaagcagtgtgtgcattctttgctgctttatttctcctggttggaagggctctgctcccacttcctgggggtttgcttcagccctgttgcagggatggacaggtcacttggagtggccagtcaggttctccgtgttcctggatgtggcagtggatggagggtgcagaattgagcaggaccacttggggccatttttgggtttgagatggaggccatcggaggtgtctttactcttcgttcctcaaggccatgaactgtaagagcaatgtaaccccagaggagctggaagctattttctctgtcatttacagacaccccacatgggacagagcctcaagaaaagaaagcagagctgaggaaatgagagtcctgataccactgggacctcctaaccctggatacaaacaagcctcttgtgtcatacacaggatttctaataacagagatataatcctaaaaataagatagaagggtaagagaatattagcatgatgctgtcaatccaagtgagggatacagggagcctgaattgggggagtagatagtgaagacagaacaaataaaaagcctgtctgtgtttcctgatggggccaactctcaaaagggagaagaggattgatctcaagaccatccttggacaaaagagggacacacatctttctgaaactggtgggaaggaaggaaggaaggaagggagcaagggagggagggagggaggaaggaagaaggaagaagggaggaagggagggggaggagggaggaggaagggaaggaaggaaggaaggaagggaaggaagaaggagcaatgaagatgactgtggaggagcaaagaagagatgttcttgctgtacaaaaaaggtgactttttccctgaaaacttggagagaggctgctgtgggtttattaatgaaggtttaaagaaaagtgaaggtttgtaggagttgctgtaagtccatgagtactaataaaaggaccacatgccatgcaaaggtgagagtgtggggcaaggagcggggcagcatgagtggaggccaagtgggcatgacccatgaccttcaggaactgcagcatcgagagtcctctaggctgagctcactcctgcacaccacagagggatgcattacagagaaaagctttagacacttcaggcaatagtgagtgacttattctcagttatatgtctaaatgacacaacttcatggataattgtctccactctccactaattttggaaaacttacgcaggcataattctattccagaagaagcacctccctatgtatgaatgagccaccttcccccaagagtaaatgtaggaaagaaggtgacagccaatcgcaatggatgtaaacaatcacatataaacagaaatcaaacacgtattagtaggaggcagaaaagtttacttcaaaggaaatgggaaaggatcacatgaaaacttgttgcctgtcttccaatccatgagttctacacagcacaaagcaacatgcaaagcacttgtaatacacttaatctttgagtttgcgtcttgaaattagttggtggggggaatcagttcttaaattatttgcatcaaaatagcataaacctgaagaattgtagagggaagttaaaattaaacaggcttattctgaaaaatatctgagagactaaactcagcttctttgcttttaaaaatgtgaatccaaatcagcacaaactcaatataatcttgttttctctacccctctgttatgtgacaatgtctcatgggttggctttgccaagtcagaggaaaccccaggctcccaccatgcctaaggatgtcctggactcggaaagtgaattttttcttatgctatattttctctgtggtgaagaacaaaatgaacatacctctcatgacagcaattttttttttttttaagatggagtttctctcttgttgcccaggctggagtgcaatggcacaatattggctcactgcaaactctgcctcttgggttcaagcaatactcctgcctcagcctcccaagtagctgagattacaggtgactgcaaccatgcctggctaatttttgtatttttagtagagacagggtttcaccatgttggtcaggcctgtctcaaactcttgacctcaggtgatcctcccaccttggcctcccaaagtgccagcattacaggcatgagccactgcacctagccgagagcaacatttatatccatataaattcatgtaaagttttaagcctcacgttgtaaagtttctaattatttcagacatttaaacattaggacatttaagaaaaactattgctccagtcttaagactcacacagcttgccataatcaagcgttttaaagtggaaaagccagacgggagagagggtcaccagctcctcctcatcgatgtggtcctcaggagcctctccttccctggttgagacacatacgaaattcggaaaatcatctggtttgctgactgtttcactttcatgtatgtgtcctgcacatcaggatttgcttcgatgacgaacgttgactgtgggtctcttacactcaggcggcctccagcctctgataagatgggccttaacatctccgttgaccaactgacttcatggtctttctctgtcatgacctaatcaggagtttcagatcttcctacccatacacatggttgcatacaagcctctcctatttttttttttattatgctttcagttttagggtacatgttcacaacgtgcaggtttgttacatatgtatacatgtgccatgttggtgtgctgcacccattaactcgtcatttagcattaggtatatctcctaaagctatccctcccccctccccacaccccacaacaggccctggtgtgtgatgttccccttcctgtgtccatgtgttctcattgttcaattcccacctatcaatgagaacatgcagtgtttgttttttttttgtctttgtgatagtttcctgagaatcatggtttccagcttcatccatgtccctataaaggacatgaactcatcatttttcatggctgcgtagtattccatggtgtatatgtgccgcattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggatggctgggtcaaatggtaattctagttctagatccctgaggaatcgccacactgacttccacaatggttgaactagtttacagtctcaccaacagtgtaaaagtgttcctatttcaccacatcctctccagcacctgttgtttcctgactttctaatgactgccattctaactggtgtgagatggtgtctcattgtggttttgatttgcatttctctgatggccagtgatgacgagcattttttcacgtctcttttggctgcataaatgtcttcttttgagaagtgtctgttcatatccttcgcccactttttgatggggttgcttgttttcttcttgtaaatttgtttgagttcattgtagattctggatattagccctttgtcagatgagtacattgcaaaacatttctgccactctgtaggatgcctgttcactctgatggtagtttcttttgctgcacagaagctctttagtttaattagatcccatgtgtcaattttggcttttgttgccattgcttttggtgttttagacatgaagtccttgcccatggctatgtcctgaatggtattgcctaggtgttcttctagggtttttatggttttagggctaacatttaagtgtccaattcatcttgaattaatttttgtataaggtgtaaggaagggattcagtttcgtctttctacatatagctagccagttttcccagcaccatttattaaatagggaatcctttccccatttcctgtttttgtcaggtttgtcaaagagcagatacttgtagatatatggcattatttctgagggctctgttctgttccattggtctatatctctgttttggaaccagtaccatgctgttttggttacggtagccttgtaatatagtttgaagtcaggtagcatgacgcctccagctttgttcttttggcttaggattgacttgtcgatgcgggctcttttttggttccatatgaactttaaagtagttttttccaattacgtgaagaaagtcattggtagcttgatggggatggcattgaatctataaattaccttgggcagtatggccattttcacgacattgattcttcctacccatgaacatggaatgttcttccatttgtttgtctcctcttttatttcattgagcagtggtttgtagttctcctcgaagaggtccttcacatcccttgtaagttggattcctaggtattttattctctttgaagcaattgtgaatgggagttcactcatgatttggctctctgtttgtctgttattgttttataagaatgcttgtgatttttgcacactgattttgtatcctgagactttgctaaagttgcttatcagcttaaggagattttgggctgagacaatggggttttctaaatatacaatcatgtcatctggaaaaagggacaatttgacttcctcttttcctaattgaataccctttatttccttctcctgcctgattgccctggccagaacatccaactctatgttgaatagcagtggtgagagagggcactcctgtcttgtgccagttttgaaagggaatgcttccagtttttgccccttcagtatgatattggctgtgggtttgtcatagataggttttattattttgacatacatcccatcaatacctaatttactgagagtttttagcatgaagtgttgttgaattttgtcaaaggccttttctgcatctattgagataatcatgtggtttttgtcattggttctgtttatatgctggattatgttaattgatttgggtatgttgaatcagccttgcatcccagggatgaaacccacttgatcatggtggataaggtttttgatgtgcttcttgatttggtgtgccagtattttattgaggatttttgcatcgatgttcatcagggatattggtctaaaattctctttttttgttgtgtctctgccaggctttggtatcaggatgatgttggcctcataaaatgagttagggaggattccctctttttctattgattggaatagtttcagaaggaatggtaccagctcctccttgtatctctggtagaattcggctgtgaatccatccgtttctggactttttttggttggtaagctattaattattgcctctatttcagagcctgttattggtctattcagagattcaacttcttcctggtttagtcttgggagagtgtatgtgtcgaggaatttatccatttcttctagattttctagttcttttgcatagaggtggttatagtattctctgatggtagtttgtatttccatgggattggtggtgatatccccttcattttttattgcttctatttgattcttttctcttttcttctttatagtcttgctagcagtctatcaattttgttgatcttttcaaaaaaccagctcctggattcattttttttgaagggttttttgtgtctctatttcgttcacttctgctctgatcttagttatttctcaccttctgctggcttttgaatgtgtttgctcttgcttctctggtttttttaattgtgatgttaggatgtcaattttagatcttgcctgctttctcttgtgggcatttagtgctataaatttccctctacacactgctttgaatgtgtcccagagattctggtatgttgtgtctttgttctcattggtttcaaagaacatctttatttctaccttcatttcgttatgtaccaagtagtcattgaggagcaggttgttcagtttccatgtaactgagtagttttgagagactttcttaatcctgaattgtagttttattgcactgtggtctgagagacagtttgttataatttctgtacttttacatttgctgaggagagctttacttacaactatgtggtcaattttggaataggtgtggtatggtgctgaaaagaatatatattctattgatttgggggggatagttctgtagatgtctattagatctgcttggtgcagagctgacttcaattcctggatatccttgttaactttctgtcttgttgaaatgtctgatgttgacagtagggtgttaaagtctcccattattattgtgtgggactctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatctttctccacctctttattttgagcctatgtgtgtctctgcacgttagatgggtctcctgaatatagcacactgatgggtcttgactctttatccaatttgccagtctgtgtcttttaattggagcatttggcccatttacatttaaggttaatattgttatgtgtgaatttgattcagttattatgatgttagctggttattttgcttgttagttgaggcagtttcttcctagcatcaatggtcttcacaatttggcatgtttttgcagtggctggtaccggttgttcctttccatgttttgtgcttccttcaggagctcttttagggcaggactggtggtgacagaatctctcagcatttgcttgtctgtaaaggattttatttctccttcacttaagaaacttagtttggctggatatgaaattctggactgaaacttgttttctttaggaatgttgaatattggcccccactctcttctggcttgtagagtttctgcggagagatcagctgttagtctgatgggcttccccttgtgggtaacccgacctttctctctgcctgccctttaaattttttcttcatctctactttgctgaatctgacaattatgtgtctttgagttgctcttctcgaggagtatctttgtggcattctctgtatttcctgaatttgaatgttggcctgcctggctagattggggaagttctcctggataacatcctgcagagtgttttccaacttggttccattctccccgtcactttcaggtacaccaatcagatgtagatttggtcttttcacatagtcccatatttcttggaggctttgtttgtttctttttattcttttttctctaaacttctcctctcgcttcatttcattcatttgatcttccatcactgataccctttctttctatcgatcgaatcggctactgaggcttgtgcattcatcaggtagttctcctgccatggttttcagttccattaggtcctttaaggacttctctgcattggttattctagttagccagtcgtctaattttttttcaaggtttttaacttctttgccatgggttcaaacttcctcctttagctcggagtagtgtgatcatctgaagccttcttctctcaactcatcaaagtcattctctgtccaacgttgctccattgctggtgaggagctgctttcctttggaggaggagaggcactctgatttttagagtctccagtttttctgctctgttttttccccatctttgtggttttatcttcctttggtctttgatgatggtgatgtacagatggggttttggtgtggatgtcctttctgtttgttagttttccttctaacagtcaggaccctcagctgcaggtctgttggaatttgctggaggtccactccagaccttgtgtgcctgggtatcagcagcagaggctgcagaacagtggatattgctgaacagcaaatgctgctgcctgatccttcctctggaaattttgtctcagaggagtacctggccatctgaggtgtcagactgcccctactggggatgcgtcccagttacgctactcaggggtcagggacccacttgaggaggcagtctgtctgttctcagatctcaagctgcatgctgggagaaccactactctcttcaaagatgtcagacagggacatttaagtctgcagaggtttctgctgtcttttgtttggctatgccctgcccccagaggtggagtctacagaggcaggcaggcctccttgagctgaggtgggctccacccagttcgagcttccgggctgctttgtttacctactcaagcctgggcaatggtgggtgcccctcccccagcctcgccgccgccttgctatttgatctgagactgctgtctcagcaatgagcaagccttcatgggcgtaggaccctcaaagccaggtgcaggatataatctcctggtgtgccatttgctaagacctttagaaaagcacagtattagggtgggagtgacccaattttccaggtgccgtctgtcacccctttctttgactaggaaagggaattccctgaccgcttgctcttcataggtggggcgatgccttgccctgcttcagctcatgctttgtgtgctgcacccactgtccgacactccccagtgacatgaacgaggtacctcagttagaaatgcagaaatcacccaccttctgcatccctcacgctgggagctgtagactggagctgttcctctttggccatcttggctccaccccttactctcctattttctaatacaatttagaaaatgcataacactgaaggccttgtgaatgatgtcaccatgtgctttgtggttatctaagttggcgcagtttttcacttagcatcattgcattacttcctactatgccaaaacctagttgcgttctctcctatcctatttagcattgaaatagtcctagtggacgtgtttcagtatcagaggtggcaatcacatcttcagcttgctaatcattccaggaatgagcttcccataaagacgaaatatttggagctgttgatttctctctttcagaagtgggaggaaagcctgcagatgacccatccccattgcccattatagatgaggctactaaaggccaggggtattcagaacaaactggatgcagaactgaaacccgagcccaggtctcttggctaagctctagcactgcactatcctgccccccttgtattctacacttcatgctggagccctcctgctgcactgtctcaccctacacaccctcatcctgcacttcctcatcccatagcccctcattttgtactccttcccttgcacatctcatcctggaccccttcacctgtacccctcattctgtactcctcacctgtatccctcattctgcacctctcttcctggacccctccctctgaatccctcacccaggcctctcctcccgtactcgtcactgaacacctcatcctgtacctctcttcctggactcctcatcgtggactcctaacctggaccccctcatcctgccctcctcactgcacctctcatcctggactcgtgaacctgtttcccttgccctgtacccctcatcttcacccctcatcctacactccctgaccttcagctcacatcacaacctttttgccaaagtctgaagctgcctaacttcttcagtttctctcattctcagtctcagatggcacaaactttctttctgctcactccctttcccaagagaaaagcagaagaaacggagctccacatgctcacatgttaaagcaagaggtgatctaaaagaaacgcattggagctgagtcatcaaaaccgcatgccacgcctggccgttcctggcttagaggcaagaggatatgtacgcggtttaaaaaacacaggatgaatttcaagaatagaatagtcccatctataacttttaaatcagtaatgcaaaatatcatccatttctaagacaacacaattcagaaattttaacaaagactcttgttgagatcataaaaactcgtaaaggaaacagaaataccaaagaaaaataataaaggtaatgagaaaattgaaagcaacaaattccaattgaaaggaaaaaacctgtttgtaaaagtgggtccttgttgtatccgatgcagggatcccagtggtaaagatgtgggagaatgttatcacattcacacactcatggaacacatgagaaatgaggaaggcagccatatggctggaaaaaaataggaagctcattccaattacagagcctaaaatatcacctagaagtacaccttgttaatttcacaagctctttcataattcgcaaatatcattatcagaactttcattcttacctgagactaaaatacagattggagaacgtctcccaggaagtttgctctaacgtgagccccgcagcgcttaacctccgtgtcatttccactacatcttatctcagtttactttgacatgtaatctgtgaggatacatgttgggaagggagagtgcaatgtagctggagctaacgggccactaacactggaatttaaatgtcaaatttctgcgttagaatttaatgttctccggcaccacctgctctcctggctcatatgtgctgatatatttaaatatttaataatggcttatctcacattattaagaggaatctgtgcttataattcattcatgcaatataactcagaaaaaaatggaaatcaagagtcaatgggtcttctgatatttttcttaaagttaagactgtcctgaatgtcagcatatcttcatacaaactctccaaccctgtcaacaaaaaagggtgatgactggaaactcaatatctttctaatatatagtttgttgttattacttgtttgttttaatatcgtttcagtaaaatcctatgttcatcttattcgtcttgcgttaagacaacggaacgctagttggcctagctggtaattcacctaaagaaaacaatagcaacaatgaacacatataatctattaatttcagcttcaaacacttaattattaatatatttggtttgtaaatggctcttaatatctttggttactaaatggctcaccaagatgaagacattgtgtgctctgcaatggtctggagaaacaggattgaataaaatggggctctttctcaaggactcgaggacacacaaaacactctaggaaaactgttaccttagctaaaaaggagctgctgctggtagccacagggaaacattggaaggaatttccatcccagtgagctgtccaggagagaggtgcagctctcaagctgggccttggggaagggaagggttgtttcctacccgcaagggtaggaaggacccgcccggagagaagggaagcggcatgagcgccagtgtgggggagaacgatggatgggcacaggatggcaagcacacagcatgctacactgtgctacagcaccctgtggctcttgagaggacacgtgatctggaagaggggcagaaattcagtgacttgctctgtggtggctgcaccgtggtggggcacacgggagccacaggtgcacgaagaggctgactcatggaccagagtgagcagggtgaggcgaggagagacaggccggtgtgtccctcaccctgctggctgacgtggggcacagggtacacaacacagcggccgtaatatgacgggaatcgcacggtggatccttctcatacaacttccttgcaatgcagcaccagtgccacaggaatatgcacttttaagcccaccctgacctgaatctccgtctatgaagacccctgggtgatctccacgcatgcggcagtcggagacacggatgagagcagagaacatgataaatgcaggtacatgggagatctgtgcagaaatgcatccctttgccaacaggggaattcaaccaatagcagcagagcacccaccactgaagggtaactcccggacggtccaggggaggtggactcagagaaccagagagggcaccggatatacttcaggaattgggttccgaaaggtcatcattcagggacccaagcactcaagaatgaggctgccggcacatgaacagatttgggtccaggaatcagagcagcatcaacaaccagaaacagtctgtgttgactcattggctactgggctataattcctcaaacgtataaaaactcaactaagacttaaaaaaaaactggagtggtcctaagattattgataagggttaaatggcccatgataatgctacaaaaatctaaacagtccagaaactggctaagacactcactcacattttgcacatctctaaggatgcagctatacaacctgcagcttctgcacagctgcacaggtgtggggcataaagaggtccttgcattcccagagcttctgtctcctgggaagaaaggcaattaaacaattgttgggatggaggcagctcagggtggtataggattgtgtagcagcaaatcacataatctaggatgtgaggcttattggggaaagtaaactctgagatgagacgggaagatcagcaaatgatctacatggtgagtccatagaagaatgatccttgttggggagatacgtgtgcaaaggtaaaagagaggaaaaaaggaagatttgaagatcaggaagttccatgggacaaacatcaagtgtatgtgagtggtggtgagagatgaagatggaatctggaaaccactttacagaatattctgtggaccctgggaaggctccaaccaatttgaaacagtgtaggaacactctctatgttcatttttttaaaaaagataattctgactggacccctgtgtgtgagcaaaatagaagagtttagtagcggggagaaatgaagtttcgaccactacagaggccgcctagaggggacactgtggaagccgactaagggtaagagaatgaagataaacaggagggatgggatagaaggatatttactagacggaactgaccgaaattcgtggagaaaaagagaacaggatcataaaccaccaatgtcgctaagaagaaataacacaaaaacaataattataaatctgttgtccaaattctcaaagaatatagggagattattttccccggctgctagacaatgatgccgcactctgggtaagaacagacaatgctgtgatgtgagtcccaggtcaggaagcttgttctagaagcaaagagctaagcaccaggaaggcagacatgaccacttgtggtcccaagaatagaagggctagttttgtttcaagggatgtggagggcagtaacaataagtttgttctttagcatattaaatggaatggcagtcctcaggaaagcccgttgagaggatatttgaatttacagcacatgagttcatgtgacacgactctttcccttgcatgggcctcaccgcagactcaggtcccaccatcagatgcggccctcatcgctctgcggaactgaggctgctagagagggctcatagctgcacacctctcagggaagtgctcaaacaaaggccttaatttagaataaagaagaagatgcaagggctactgaccccgagacctggcattcctgccacagactgcaagtccagaaggcttttgctggatagaatgagggaatgcgcttctgaaggcatggctgaggagccagcttggagagtatgctgggaaggatgtgctgctgtcctctggatgtggtcttcaccctaaatccacggccataatgctgtgtcagtccccagaggctggaatacatggggccaggaactgaggaggggaagcaggagtagctgtctcacctccaccccaggagctgattgagatctctgctccccgatctctcaaattaggcaatgtggttgtagagaacctgcttctcagaggggagctgtctccatcagcaggaagaggaagggccccatgaaactgtaagctatccctgtggcccagcatcttccagatcctcatgcccaaggcctcaccagtaatggaagcagccatcatccttgcaggaggactggccctaatcaggagaaaaagctggggccattgtccccaatgagacaatacagatgagtgggacgatttatccatggggactctcttacgtgtgatagaacacggacaagtctagcagccacacctgagcagtgcactgtgagcagagaccgaggccctgtgaggacttgggtcagcatcgccctgctgcagaagccaactagcccagctgagaggccagctaaggaggcagatcctcacatgggccggacaggagggtggcggtgaggtgagtgtgtgttacacgtgttcctaggaaacgaggccagtcagaatcctagagaagctgtttccagatggagaatactgaccagtgctagtgctgggctgtatttgatcccaagggcaccatttgggtgctctcttcagaatccaggcccccccccccacctcccagctgctcgggacccacactgcatttcttttcaggaatcatcccaagcagtgttctggtccctccctgggggccacccatgtcaatggtcaatggcaccaagcctggcccaattgcttcagtttggaagactatacagtgccatcctagctccagacctccctgtagcatcatttaaggcaagggttcccaacccccaggccagggaccagtactcgtccatggcctgctaggaactgggccacacagcaggaggtgagcagcaggcaacggagcattaccacctgagctctgcctcccagcagatcagcagcaacattacattctcctaggagtgtgaaccctattgtgaactgcacatgcgagggatctaggctgcatgccctttatgagaatctaatacctgatgatctgtcactgtctcccatcacccagatgggactgtctagttgcaggaaaacaagctcagggctcccaatgattctacattatggagagttgtataattattttattacacattacattgtaataatagaaataaagtgcacagtaaatgcaatgcacttcagtcaccctgaaatcatcacctctcccagtccatggaaaaactgtctaccttaaaaccggtcccttgtgccaaaaaggctggggactcttatctaagaacctgatgtggtctgactgtttgtgtccctccaaattcctaagttgaaacctaacctcaaatttgatggttttcagagatgggccagcctttagagcgtgatgacatgatgagggtggagcccctgtgaacaggattagtgcccttgtgaaggatgtccaggcttgtggccttgcgctgtccaccacgtgaggacacagtgagaaggcgccatctatgaaccaggaaacggtcctcaccagacaccaaatctgccactgccttgatcgtggacttcccagaactgtgagagatacaattccattgtcgccaagccaactctatctccatattctgttacggcaacctgaatgaactaactgtgcacctgtcgtgactgggcactgttcaacctctccctccacccaactccacttccttctctgccttacagacgattccaagcacactcccaatacctcctgctacacaagtcaccaactcaggctctgcttccaagaaaaaggataatttgtcatagacttaagtcaagcccttggaaaaaaatgttaaatccaccttagatataaggctgtatgtgctgtgaaaaaggaggtacacattataaacgctttgtgacagtcaactgagcattcccacaacatgtaaacaaaaggttatttgaagccacgtcctgcagcttcaccttctctttagggttttagaagtcactactattctggcaggcactgtcttgtctgactatgaatagcgtattggcttcatgctcacaaggacaggggcatgagctcactttctacaaggaccagtgagctgtcctcggttcagggacagcaccctgtgccgtcattgcacttggacgctgttcaatgtgcataattgctcacctagagaagacgggcgagactgggctgggtaactcatgccagtacaaccacgcaagacgagaagcaccttcaagattacataacatcaatgctgtctcaaaagttccgtctgccaagaatggtaaagatgctggtttttgaaccatctcctacattcctgtattcagtacaacacacagcctcacttcccccatacaccctaggagcacagacccttggccacagactgagatgcctacacaaatttccattctcttattatcactgtattcatcggacgaaggagacaattccgtttcttgtatgaaatggtgatgctgaagtcaaataattttactggaatcactcttagtattagcccaaaataggtcttgttttgactatacagcagcacatcacaggaaacagttcctttaattcaccccctgctggaatgtaaatagctacggcaaattacatgaaacatgatttctggagatgcagttcatcaactagtgtgatgaactcgaaccgaatttttttttgtaaccaaaaatgcttcagagtcaactcactttactatagacagagaagccataaaaacgtgggaccactacaatagcaaacatgtaattgcttataaaaatatccagggatcaagtttgcttcttgttaacttcctcatggctagaagctgcagtggttatgagggaacccaactttcaattgagcatagggatttttctttattttctgtggactaacaatcagttgctatgagatatatattttattttcaaatataaaatggagaaactatgccccggactcacattatcttttcttatatagtattctgagatttactatttatatggattctatctattataaatatgatttataaatatataaataaatgatttttaagtatataaattatacaattatatataggtagaatctatatatatagcaaatttatatataaattgtatatgtaaaatttgttttaaaaatatatactagtcatatagagtttgcttatgaatggtcagtgttgctttatatggctctatcataattaatttacatcctgcttcttagcatttgggcttttgaacagattatttttaattcagtattttcatttgtaaaatggttttaaacaaagcttacctctctcccattactttctgacacttaacatgatctccctcaagagctctctttgttttttaaactttgcatttttttccccataatttgcttaggggaaattatcaattcacactctctctctctcgttctgtgtataatagctatagataatacacatgctcataagtatgaacaggcttatatactagggaatatgtataacacatactgtataacatacacatgccaactgaagtctagcaagagcgtttgtttctgtgaattgttcttctgtgtttgctgctggggcctcaccagcagggatccctgttgtttttcagtctctgagctcctccctgcctatcctccactcactgtgattttcaggggatgcacaggccctggttttcatttctccaccctacttgctttctgaaaaatgctcctaaaagggtccattaactgagtagaccctccaggcatcttgaggggatggaggagagaggattgtctttggggagttagagacagcacaaatggagaaatctcacatatgcccaagcctacgagcccgggaatgatggaggccacaggtgggtagagtggacccaaggtcctcctggtccacgtgtcctgaggcagccccctcaccattactgtgtgtgctggcagggggtagtgggggtgccaggaaagcatcctccagggagattttctcagagacaacagtgcccaaggtagcagagaccgtgaacatcttagggttagaagtgtgatccgaagatttgagggtccccgaaatattttacactactcaggctattcctgatttcttgtcaaggttggagtaggtaggtcagtaagggttgacatgggtggcctttggtaatgagtgaggttacaatgatagctactttcttaggatggagtctcagaaattcaagtcgatgttaaaataagatgatgtggcatttcttgcatagcagtttgtctagggtttgtagtctgagggactgactgtgactccaggtatgagagggcacacactgaaaatttctggggaaactatgagaaaatgtcgagagctgttgcctcagaggaagttaactggctcagctagaagctggagagaaggggtgcttacaattcatctaaacacccctcagttgggtttacatgtcttactgtgcacactattatttatataatgaaaacatcatgtttgtagaaaaaatctcaaaattaaaatgaaaatgcaaacagaaataagagctcgcatttcttaagttcttactccatgtgttatgagccttacatgttttactcagttgatttttcaataaaattatgaagcagttgtgattactaggacttttttttttaatgacgagtctgatacacaaagggtttaaataacttacactaaggttcagttactgggcagcagaaccagtattcaggggagtacagctccagagcctgtgttcctaacactagatgttagtgaaaatcaggcaacatcaaaacgtagaacatttaactctatgtgaatatatgctgtatatattttctgataatttttttttctttttttaagatggagtctcactctgttgcctaggctggagtgcagtggcacgatcttggctcactgcaagctccactacccgggttcaagcgattcttctgccccagcctcctgtgtatctgggattacaggtacccaccctccacaatcagctaattttttttttttttttttttttgtattctgaggagagataggggtttcaccatgttggccaggctggtctggaactcctgaccttaagtgatccgcctgccttggtctcccaaagcactatgattaaaggtgtcagcccccctgcccgggctgttttctgataatataatttatgaataactttgctttgagtcaaataatataaaattatgtatacgcataaaggtcacttttataagtgatttgcactttgtcttcaactgttagcttaatatagtactctggaaatatgcatttttagaatgtcttctactgttataatctcttaattttttaaaatcctcaaatgttgtattggttaatggttttaattacctttttgcctttggactattcttttgtcaaagataacacatgacattgaattggccatctctcaaggactgatggccattcacgtttttatgacatctcatgaaaagccatctcagggtggctactgagactcttaccacagcactaattagggtaaaatgtaattataattaatgtggtgtggtcattcactgtgaaatatgacacatagaagaatgtttaccttttattgggactacttatgtctcttcatagtcaaggatgcagtttgggcacgaggttcctctcctattcctggtaccataaacctcatgatgtgtatctcaatgctgctgagatgaatttactgcaatttgccctgttgggaagtgtctggtatttcactgatgatttcagattctaccaaaggcagcagcaaatgcaggtcatgtggaaaatatgatatctccaccatactttcctgaataactgcacagtcacataaaagttcaattgaaggtcaggtctaaaaattcaaacgtcaggaggtattcagcagttgcctctgcattctagttttagtcattgaaagggatgtaaatatacattttttgtcgtagtatttcttattcacaagggtcattaagtccccaacacaccccgtgtgtcagcaaggagggaccctattttatgctttgtagatgaggatactccggggtgggcccacacaccaagagaccctttaatattgtgaccctttatcccacacagagagagagagcagccaaggtgtggcgtgttcactcacatggactcatgacaatgtcccttaccatgcttgttgatttaggattggtggatgcttttttattatctccttcattgatttcatgggtaataacttcttgttacatttttcagctcctaaaactattcctatggtatacacttgggaaataagaacatactgcctatttactcaaattcaaaaagtagaataaaatacagttccaacagctccagataaatattctcatttttacctaaacacatacacatctatcggttcaaatactttaaggaactcagttaccaatgaaggaaccaataagatattttaaaaactatttcaaaggagaatccaaagatcacaactatatagacaatcagaaatactgaaataaacttgctaatccatttaaaagtaatcaatatccacaggacaataattaatgggatctttttcacaggaaattcatttgcatttcaatggttcagaaattgtttgcattgctatcagttttctataacttgtaaagttgtaaactagctcaaaaacaatgacaggcacagggctttcatttcaaatatttgaatttggctcataaaaatttataattgtaagtattttcagattcactatattgtcttttctatgtttgctcacataaaagaaggttttcagagacaccagccaatatgatatggtcaaaagatccccacatatgcccacacttcctagcttacacctaatacttcacctcactctttattttgggataatcagagcacatatcatggcaagccgagttttcagaagttaaacattctcattcacgaaagcgagtgttagtagactttaaggaagttcccgtcatgattcctatttatcagcattgtttgacttgttgattttacttctacctaaccaacacagaatgctctctgccctctcttggaatgctaacttccaaccctgtgaagtgtaatctcatcataccttggtaaacagctttaaacccaggtgagccaatgctatcatccgactgcagatgtagccacatctggttgctcatgctcacaatgaggtcaggaacactggatcccgtgagcctgcaagaaagagaaatgtcaaagcttttaggtaaggcaacaagtacatcgacttccacctgaaaggagggtcttgctgctttaaacagccaaaccctagatatataggtagcaagaccctctttcaaagactgtacagcctctggtccattatattaatattcaaacatcactatcactggtgctttacagaaattactctattctatggctgccaattcgtgaattttcttttaaaaaatcaatttagggcaatcaaccatcccattttcctggaaccgagaggcttccccaggtgcaggaattacaatgttacaactgggacagtcctggaaaaaatatggcacagttgttcatgtgaggtgactagagatgtgcacagttgctgtaggattgcacaacaccagccatgaaagacaaagcatctctatcacaacaaattgtatgggttcattcacaaaaggttttcattgtctagaactagtatgtaactttatcacaaactctccttttaaaatatattataggtaattatacattaagagaattttgaaaagaacaacatgcatagctgaaatagatttggcagcatttattgaacactccccccgcatattaatgtctgggtcacaccaaatgtgagtttcaatgaagcattcattgtgcattaacaaaacagtcacataggggctgctgtcagccagtgaaaagaaacactaaatccattgattgaactcaacatgctgacagaaaagcatgttgaaatagaaaaagtgtaagaagaaaatcaattcaaccaaaacaaatgtccctaatcaaataggaagcttgactttcagcaaagtagtttcaggaatatgagcatatgatttgccccatcaatcatatcatctgtctatcaaccctacatcctcaccttaggcagtacagagcaccggattcttcaaaggaagaagaacaactgtcattatatgtgaagtaactcatgcaatgttacacacaaattgaaaagaggaaactatttctgtgaatgctgtgtggttaactaaatatgtatttctttctgaagatttgtcttcgttggcaacattgttctttttcatttgcttgttttgttggcttgtttgaagagagatttttttctttctttcttattcatacatttattgaagtgtaacaagccaaaaagcgcacagatcgtgaatgtctaactctatgaatttttacaaagtgaaccgccacacagatcaacacttagacaattaccaacaccccaaagccttcttgtaccttctcccagtcaccatcctctcctcccatcttgccaaactatcagttttacatcttctttaaagtttttttgtaaatgaaatcatactatatataacattttgttcaacatgattttggtgaaatgtattcatgttattgtttgtagtattgtttcatttacttcaatttctacatagaatttatagtgtataaacacaagtaggggatgattaacatttctaaattcttgaaatttttattaagataattgtggatacacatgtggtaggtagtacaaaataatataaagagattacatgtattatttacctagtttccccgagtggtaacatcttgcaaaactataacaatcaggacattgacatggatacaacctaccagcctcgttaaaactttccctgttttattcgtattttgtatgtacatttgtgcatgtagctctgcacaaatacgtcacatgtctcggctcctgaatccaccgccatagtcaatgcagggcagctccattccttccaaattctctggtgctcttcccttaaaatcacactcatgcccctcttgctacacccccttcactgtccctaacccctggcaaccactaatcagtatccatctctaaattatttatttaaaaaaatcatacaaatgaaatcacagtgtttaacaacctgggattggattttacttagcttaattcctggaagatttatcccagttgttgtttataccaatagtttgttcccttttatcgctgggtagtatgtcatgttgtggatataccacagcttgcttaattaaccacctggtaaagggtatttggactgatactagttttggcagatgacacctaaagctgctttgaatatgtgtgtgcaggtttctgtgtgagcataaatcttcatttacctgagataaaagcgcaagagggcaatagctgcattgtgaaatcatgttgagtatttaaagaaactaccaaatttttccccagactgtttgtacattcccaccagcagtgtgtgagcaccccagattctttgtattctcaataggcattcggtgttgtcggcatttttccacactttaacagctacgtgcatttaactaatgggtaatgatgtacaacattgtctcatgggtttatttgccatttatacgtcttcttgaatgagaggtctctcttttcctccttttaaatactgaaaactctcttgatatattgtagtacagataccagtccttgtcagaaattagcagttttgatttaaatatagtcaattttggttccacatgcaattacaacaaattatattccataagtattagttgcagggctttctatatatcaagtttggaatctggcttagttccttccttctttccttccttccttcattccttccttccttcgttccttccttccttcatccctccctcctctccctccctccttccttcttcctctctccttccttccctccctccttcttcctctctccttccttccctccctctctccctcccttcttcctctctccttccttcctttccctccctccctcccttccttccttccttcttcctttcttctttccttccttccttccttgctttctgttatcattccctaagataagtgaatatataaaagaaaaatatgtatcttaagtcaaattcatggttttgggtagaagaaggaagaggaaagtaaacatactgttttaatattacacagttaaagaagaatgtgggcatagccgttagtttttccctacatgttaatacacacatggcacttggttcacatgcaaaacgagtcgaggagagtgttttcccttctccctttgggattacaggtgatgtcagcaccctactcatctgtgttccccactttacacccctttcactttgagacttatgccaccatgcaacatgactctactgctgtccatcatcgtcctctcccttcgtgtagcccctggcttgttgtcattgctccctgtgggcaatctgataatgcttgtaaagtgactcaagggttcttggctcttttaacccaataacttttctctccactctactgcaaggtataacatcaaggtgcaaggtatgaaatcactggtcataccttgcaccttcctactctttatcataacaaacttaagcacctaacccctcttgctgaccacactgcaacatcttttaactattgtaagtgtgtactttctgaaacacacttcccaattcttggggacctctactaatgattttgtcacatttttacccagcctggacaacatgattggtactctgctattctgtctttccagcaccttaactgtgttaaagtctactaccaatctgtcccatctctgacaaaactccaacttgagatcaatccaaccatccactctctatcttcctgtatgtgtgcacaagaaagatgatgaagaacttgctgatttatactgacatatatatatataaaatttccagactcacactagacacatggtgccacatttttttcctgaattatagtcagtgtatttttcctattgccatttgttattgccctaagtcgtcatcatttttctcaagcccattcccagcccttatttcttctgttctcagcagataactttactcataagtataagggggaaaacatttagggcagtcaaaacatgaaatacctgcctcttaaaatctcctaagttttttttttattcttttcatgtcaccagtcatcggccactagaagtaactgttgggggagtttattttcctcgtacttctttgatgtttttcacaccactgttttctccccatttccaacctctcagctgaacactgattatctcacacccaccccaccaaagtaggctcctaactctgtctcctggttctggcatttcatctcccctagacattcgacttgattttaacttactaaaaacgtaattgtcatgtaaaaaattcttacacattgaaaagacttatactgtctattcaactactttagacatacctctcagtcgatatatttaatttcttaagttctatactgaactttgctttaatttaatcttatattactttgttcatttgcatgaaacagtcagcaagcacactgccatattccacacaaagttcttcaatcaaatgtcaaatcaggtttatgtttattactcattttggaatttaagcctgctatgtgacagttatatttatgagaagaactgtaattacagcttattatagttattttaaagctgattaacttacaaaaatttcatacagtaaaagcactttttatttttaaatttttatgttattttataattatttaaaacaaaagaacttttgttcctctttctggtttttagaactattttggcttgctaacactgagatattatttctttaaaacaaagaagcaagcaatattgttgccctttgcaactggttatctgtttgaaacaggattttcaaaataataatacctgaaaaataaaatagatactggctttgattaaatacagtaggtgctcaaatgaagtcattttgttgaatgtcatttcattataacaatgatgaagaagatagattcctagcaggggtggtgtctgtatgggtgtatcagtctactctcacactgctatgaagatattatccaagacctagagactgggtaatttataaagaaaggagatttaactgactcgtatttccacatggcttgggaggcctcaggaaacttacaatcatggtagagggtgaaagggaagcaaggcacgtcttacatggcaggaggagagagcatgtgagggaggaaatgtcaaacataaaaccatcagatctagtaaaaactccttcaccattatgagaacagcatgggggaaactgcccccatgatccaaacacctccctcaacacatggggattatagagattacaattagagatgagatttgagtggggacacagagccaagtcatatcaatcaggttggcatgctccccatgtctgcctggacttgctcccaggttttctcccacatcccaaagctgtgcatgtgaggtttattggcattagctaatgagctggttggaaaaggaatgaatgaatgaatataaatcgtcaaataaaaatgtttcaagtatatgataatcatacaaatgcaggacaataaacaatgcaatagcaaagtgctcagggagctgtcacatgtgtaaatgtttttgacctctctcgggggaagaggttttcctgacaatgttttcttggcaaacaaacatttatttatcccttgatgtaaccaacctgcacccctatgaatgtcactcatccatccaccaaaaatttggtaaacagtaatctttcttgtcttcattaatctttcttaaaagtgtgtatagttcacatttacttaaatgtttaatattaggagtgttttggtctttatgcagaagtttggtcttgctttttgtgagcagaaatatgcttaggaacttaactcttgtttatatcaattagcctaaggggaaattggttttggtatacagagttttacttgaagtcacagtttccaaagacctattaatgatgttaagtgggaacttactatactttaacattcatcaaaacatatagttacacaactagtcttgctttctttaacacagctcaatttttccccaagttgactctatagtacatattgttctgatttaaacttaaaaataatgttatcctaatgaaacactaaataaatctatttttgatagaggaaaatataattttattttggagaaataagccatcatattgtagctgcctgccttttttgcccccaagccctgcagtgtaaaactctgtcatctcccaggcgtgttcagctccagccatatttatttttccccattctccagaatgatggcatttctccgttcccagggctttgcaaaccctgaaatccttgtatggactgtcaactcttcctgctaagctaagagtctttgaagactctgaggattctcgctgggcatttcttagcctcttgaagccagattaggatttttgcctctaggtcatcacagaatccttcacgcaattcagtttcacagaaaactgcttcaacctccaccttctttcaaattctgagctctctgggtgcaattttatgtctcttggccactttatccctagtctctagtaaataacataaacatttttaaaataaatcaataaataaaaatataaattaacctacactgtattcattatacagctacatgtttaaattttataggaatatttccaaataatgatgtaaatcttagtgttatgttaggcagcataccaagggcttaacatttggagttctgtgatggctctgtcattaattcacgtgtgattttagctaaatcattttatctgtattccaggttcctcatctatgaaacaagagaattgtattaatccaacctgaaggaactcttcagacctaaaattctgtgatcttttgcacagatttcagtgaagatactgctgtctcacattgatatgtctggttgcagtcagtatcgatgttgaactgaaatcaacagtgattatttctccaatttcaagtatgtgaagcggttaacccaaaatgaaggaaatgatatgtgattatgtatttgttcctgccttacaactagggcactttgtgagtacctttaactctttgagagtgtaactaaactctttccaatgcaaatgtgtcagtgttcttgaaagcttaatgacaaccataagatacagtaactttatgatgttttggttacttgtcattttactgtgtagacaagaacaatttcatctctgatcaaatcttccctttgcaccttgctaaatggttcaatagttctattctaatctacgtgaaatacatgtgttaagggctggaggtgatggctcatgcctgtaatcccagcactttcggaggctgaggtgggaagactatttgagtccaggagttcaagactagcctgcgcaacatagcgaggccttggctcaaccaaaatacaaatgcaaaaacaaaacaagagatggataacacctatctctgactctgaaatctttcatcaacataacccactgaaattcccatgttgttgtgtgtatcagtagtttgtttttgggagtaatgattttagttctcttataaaaatatacatgtgtttttccaattccctgtcaaagaatattcacaatgtttctattttggcaattatgaatagagttactataaacattcacatggtataaaatttttctagggtaaatacttaggaggtggatttctgggccatatgattgatgtatatttactatcatatgaaactaccaacctatcttccagaatggcggtaccacttggcttttccgcttgcaatctcaaaggttacacagaacatacatccattggtgtgacattctcacaccccaaaattacaaggataaataatgaatcagccaggcttggtggcttactcctgtaatgccagcacttttttgaggccaaggcgggcagattacttgaggtcaggagttcgagaccagcctggccaacatgatcaaactccatctctactaaaaatatgaacattagccaggcttggtggcagacatctgtaatcccagctacttgggaggctgaggcaagggaatggcttgaacctgggaagcagaggtcgcagtgagccaagaccgtgtcactgcaccctgagcaacagagcgaaactccgcctcaaaaaaaaaaaaaaaaaaaatgtgaatcagtaagtagttcagggtttaagttgggggagcctgtcaacacaaagggatactacagtattttgaagtgaagggaatgttctgtgttctgattttgctggtggttacacagatctatacatgtatttacagtcatagatctgtacacacagaaagttctactttactgtatatcacttaaaaataatttgttcagacctgaagaaaaattctgcatgtgtcacgaagctgtcaaaatacaacactaataaaatgtagcacctgcaatatgagatgcctggattttatgggtatgtacctgaattttaaaaaagggggagatgtgctaaacctttaatatactcattacagttgaaaatttgacaatggaaacgtaaagcctgcccttcagataaaaacttgcctaaaactgaactgctttgtagtctttatgttcctttaatgtccacgaatggcataaattgttcagaatgtggagaaagcagagttacttaattgtatgatttaagtgactacttgccttaattgggtagacacagggtgagctggagattaataaggataagtaaagacaaggtactatcttttcaggcacctgggtacctgggcagactcattcctcttgaggatggagtaaaataccagtaatgagtttcagacatgtgttgataaatatctctggtacaaattggcagctgcaaagcagccaggggcagaggaagaagtcaactcagttatttgataagccaaaccagaaggaatttaagctctggaaggccatatttgcactcttgggtctctcacatatcttcagatacagtattgaggaggtactgagagcaagtaaagtgagttacacgttctccacctacccagcacctagccgggttcccaggacatggtagttacagattccatgtttatttatatgatgtgtaccactgcagagggccagggcaggtggaaaagagcaggaatctgatttataaatcaagctgactgaaaaataagtcaagggagtgctttcattgaataaataatcatattattaaatacaatgttaaaactgaagataattcatacatatactgaagttactatcatttccccactggcatcaacatgaaattagaacaagctttagatttcatttactttgactcatgcacacgcctcactcaagtatggcagactttatttactgtgctgaaatccattacagccaggtggcacagaagatgatgtgacttaacatcaatcatttacaatcgctattttaaattcactaaacattatctgaattataaattgttcacgtgcggaactgcgtgaaaaagatgtaatccaaacctcttgatcttgcagatctaaggggaaaataaaagttgactaaagcccaacgtgatgctactttacagatttcctttactgagtgcagcccacactacttaaaagtatatggactgccagtcctcatgacatgcagatccttttttccttccccctctgtgtaaaacacaaatatcaggcctgataatggcacaagaagctaccagaagacactgctaaaatgtgataggagaaagacaagctggcctgggaccgaagaccagagaaacagcagagcatggggtgacttgtggccgatcacaaacagaaggccactccgacttgctgttttccacccctgaacaggcaacagaaggaccccagcaagcccgttccttctccagatgcaactgtgacccgtctgactaccagactacgcagcaccacagcaaataaaatggatgtaagagccacaccaacaacaaacatccaaggaagtcttcatgttccttgtggtcccagggctgccttgtcgaagaaaaaatatctaagaaggcagaacctgcaagagggatgcagctatataaatgatctcacctggggaggcccttcgtcccagtaggtgtgagactgagtctcttccccacccagacacagcggtagagtgggcggaataggtgacggggcactgcaaagagtggtccctccgacctccctcatcgcctcaccaacatctccccaagcccacccaaccccatgcactccaagcctgggaaatccttctgccccctcagccagcaccagcagaaagcagtggagactccttgggcactaaaggcactgagcagataaaagtaaacccttgaagcctccaatagtcaaattatcattggaacctcctccccagcccacaaaataggctgagacccacatgccaagcctaaacaaggtacttgcttgctaaaatattaggtgggtacaaaagcaattgcagtttttgccattatttttatttatttatttattttttagactaagtttcactcttgtcacccaggctggagtgcagtggcatgatcttggctcaccgcaacctccgcctcctgggttcaagtgattctcctgcctcagcctcccaagtggctgggattacaggcatgcaccaccatgcccagctaattttgtacttttagtacatatggggtttctccgtattggtcatgctagtcttgaactcccgaccttaggtgatctgcccacctcggccccccaaagtgctgggattacaggtgtgagccaccgcgcccagcctgccatttctttcaatggcataaatgccattactttcagtggcaaaaaaccacagttgctttttcatcaatctcataaaaaatataaatagtacctagcaatacctaacatgacacacaaaagagctgggacacaatcatcacaccaagagccaaggaaatcacggcttgaatgatgaaagacaatcaaccaaccccaacagaaatgaatcagagggtggattttaaagccaggtcgcttaaaaatgcttcagtgatcatttacaaattatctgcaaacagatgaaaaaaaacgataaatctaagtaaagaaataagttataaaaatgaactaaaaggaaattatggaactaaaaataacagaagagaaaactaaaaatagctagatttgcttaatattaaaattgaaatgagcaataatagaatcagtgaacttgagatcaatggaattctcctacactaaacaacagagacaaaacagactacaaatggaaaaggggccgggagtggtgactcacatctgtaatctcagcactttgggaggcctaggtggatggattgcctgagctcaggagttcaagaccagcctgggcaacacggtgaaaccccatctttattaaaatacaaaaaaaaattagctgggtgtggtggcacacacctgtagtccctactactcaggaggttgaggcagaagaattgcttgaacccaggaggcggaggatgcattgagcacagatcgtgccactgcactccagccccctggagcaatggagaaagactctgtctcaaaaataaaaaattaaaaggaaaaacgaataaagcttcagaggcctgtgggacaaaacaaaacaaaacaaatacacatagaaaaaagaatccaactattttttatcattagaattccaaaaggagacgagctagatgatggtgttgaaattatttaaaaaaataattgctgaaaacttaccaaatttggcaaaacacgtgaatttatagacccaaaaaaatctaagttaacctctcaaaaataaacctaaacaaatccattccaagacacatctaatccaagttttaaaaactaaagacagaaaaaacaaccaaaaagaaacaaaatgttacctacaggataaaactacttcaatgacaatgattttcccatttgggatcatggaggccagaaggaagaactgacaaccacaaattctatattcagtgaatctatccttcagaaataaagggaacttaaaaaaattatcaggcgtataatttgtttttgcaaattaagagtaggtggtaggctgggggcaatggctcacgcctgtaatcccagcactttgggaggccgaggtgagcggatcacaaggtcaggagatcgagactatcctggctaacatagtgaaaccctgtctgaactaaaaatacaaaaaattagccaggcgtggtggcaggcacctgtagtcccagctactagggaggctgaggcaggagagtgctttgaacccagaaggcggagcttgcagtgagcccagattagccactgcactccagcctgggcaacagagcgagactccatctcaaaaaaaaaaaaaaaaaaaaaaaaaccagagtagttggtagacctgcccttaatggttggctcaagaacattcttcttgaaaagaaatgaaggagaaaagaaaagaaacttttacctgtgttttcaaaagagaaaaaacaagaggaatctatacaatataaactggactattttgcttaccatgagttccataaatcttacttaatgattgaaacaacaattagaacagcgtctggtacttcagataataatttcaaaaagttgaaggggtaaagggccctaaatgcaagtgcagtttccatacttcaggtggtaaatgttcgcattagttgtagtaagataaataatggcctcactcctgtccaatcctgctctcactctaatccctcaaatctgtgaaacttacttttcagatgaaagattttgcaaatgtgattaagttaaggatcgaaatgtgggggattgtcctgaatgatgtaggtgggccctaaatgccaccactagtatccatataagagagaggcagagggagatttcaggcagagaagatggtctcgtgactctgaattcagagagtgggttgatgtggccacaagccaaggaacgccagcagctgccctaagctggaagaagaaagggatgaattcttccccagggcctttggagtgattacagctctgcccacatgttgatgctggcctagaaaacctgacttggacttctggtttccagaactgagagtacaaatttctgctgttttgagccaccaagtttgtggaatattctatagtaacagtaggaaataaatgtatcagtagactgttataagtcacatatgtttattgtaatgcccagaacaaccactttgaaaactacaaagaaatacatgaaatataccacaaacaggttaagataaaattaaaaaacaaaacttaataacccttaggaaggcaagaaaagcagtaaaaggggaatgagaaccagaaataaagaaataataaaatgccagacaaagcactaaacatatcaataattaccttaaatataaatggtctagatatgccactgaaatatcagagagaggcagaatgtattaaaaaattacccaaataatgaggcttaaaatatatgtcaaaatcaatgacccaggcatattgatagtaaaagaaacaaaagacataccatgtaaatattaataataaaaagcaggagtgcctatgttaatatctgacaaagtagacttaaggcaaataaaagtatcagagacaaagagggacaccacaaaataataaaaggattgacccaccagaaatatgtaacactcctaaatgtgtacaaaccaaatatcagagcttcacgacaagaagcaaaaactgataaagctaagagaaaaatagcaacctccacaagtatagttgaaaactttagcacccttagcaaacaggcagaaaatatcacaaaggatattcaatcaaccaacaggatctaactgacgaatatggaactctcaactcaatacacatgtttttcaaagccctatgaaaagctgacaaaagataaatcacaccctgggccagataatagatcttgacatattcaaatgaactgaaatcatagagaatttgttctctgatcacaaaggaatcaaactagaaatcagttattaaaaggcagtagaaaaatctctaaacatatggaagttaaataacacatttctaaataatccatgattcaaagggaaagtctcaagtgaaataaagaaatacatagaatgaagttaaaataaaaacacaacatataaaaatatgtgggaagcagataaaacagtgccaagaggaaaatttataacagtaaatgactacattagatagaaaagaatgaaaaaaattacttaagttcctacctcaagattctagcataagtaatgcaaaatagactcaaagaaactaggaggaagagtgcgatagaggtctaaattaatgaaatagaaatagataaacagtagaaaaaataacgaaacaaatattctctttcaaaaataatataattgatgaagctataagaacacttgcagaaagtcagaaaaagagaaagggagagagagatagaagggaacaattacaaataccagaaataaaatagaggctattactacagattcatcagccatcacaaagataataaggaaatattataaataactgtaaattcataaattcaacatattattagatataaactgatttgtcaaaaactattaactaccaaaactcaaccaagataaaacagacaatctaaatagtcctttattatagaaattaatggtataacatgttcaccaaaaataaaatcctcagacccagatggtttcaatagaaaattctactaatttataagtaacaattaacgtcaagatttcataaactcttgcagaaaataacaaaagagaaaatattttatagccattataatcttataatgaagatagtattcaactgataccaaagtcagacaaaggcagtacaaaaaagaaagagaaaactatagaccgatatcttttatgaatgtagttgcaaatatcctcaacaaaatattagaaaactgaatgcaacaatgtacaaatcaattatactcaatcatgaagtagaatttattccattttatgaaaggctgagtcaacttttaaaaaaatcaatcaatgtcatccaccattagaagaggctaaagaaagaacatgatatatcagctaatgccaaaaaagaaacatttgacgattcacaggacacatagtgttcatgagctgaaagatttaacatagtaaatatgtcaattttctccaaatttatcaatagctttaatgtaattcctatcacaatcccagcaatgtttttatacattgctgggagtatacatgcatatatgtttatggtactctcaaacttatatagattggcacctgccctagaatagttaagtctcttgacaaagaacaataaagtgagaaacatcactccgcctgatattaacatttactaaacagttatagtaattagtaatgtgtggcattggtagaagactagacacacatcagtgtaacagaacagagagctcagaaatagacccacacaaatacatctaactagtttttgatgaaggcagaaaagcagttcaatggagaaaggcgagtcctttcaacaaatgctactgaacagttggatacacgaactgccaggcaaaccgtgaacctcaacctctgtctcatgccatatacaaaaactaactcaaaagggataagagacttaaatgtaatatgtaaaactgtaaaacttttaggaatatgtatagaaggactcctctgtaaagtacagctaggcaaagaatccttagagttgacagcaaaagcactggcctttatgggaaagcccataaactagacttcatcaaaattaaaagcttttgccatgtgttgaaacccacatgaagaaagtgaaaagacaagccgcagactgagaaaaaatagctgcaaaccatgtattctacaaagcactaatatcttgactacacaaagaattctccaaacttagtaagaaacatccgcttagaaaatgggaaaaagacttagacattttgccaaagaggatgtcagatagtaaataagcatctgacaaaatgttcagtatcattagccatcaggaaaatgcaaatttaaaccacaacgaggtgtcattacacaacttttggagcagaaaaagtggtgataaaaccaattgtggggacggcgtgagcatgaggaccacttaacatcatgggctgtgatgttggagaaccatgctggaaaacagctgagcagtttcctacaaaactaaacatacaaccaacatacaactcaagcaattacactcctaagtaatttccaagagaaataaaaactcatgtttacataacaacctatacacaaatgtcatagtagctttcttcataatagtcaaatactagaagcaatccaggtgtccatctgtgggtgaatataaactgtggaacattcataccttgaaataccagccagcaaaaaacgggaggaaacgattgcagtacacaaagtccagggaattttgctgagtgagaagcaatcatagaaggtaacacactacgtgcttctaattatataacattcttgcaatgacaaatttttagagctggagtgcagataatgtttggcaggggtcagctttaagtgtagaaaacagggagttggctatgattattaaggaaaatatgagggaactttggggtattagaaattacctgtcttgactgtggcggatacaggaacttaaacaggtagtgaaattgtatagaacttcataacaatacacacacacacagagagagagagagagagagagagagggagagagagaaacacaaatgaatacaaataaaacaggaaattaaatgagctgggtgtggtggcgcatgctggttatcccagctactcctgagactgaggcatgagaatcccttgaacttgagaggcagcagttgcagtgagttgagattgtgccactgcactacagcctgggtgacagagcgagactcagcctcaaaaaaataaaataaaataaaataaaataaaataaaataaaataaaataaaataaaataaaataaaataaaataaaacaggaaatctgaataagatcagtggatcatatcaaggtgaatatcctggttgtgacattttactgtagatttgcaaaacatttccactggagatccggacgaagtctataaagatcccttcgtattaacaccaggggttcaatgagcgattaggcagcatttttttcctcagtgactatcgattcgagttctccttgtcttcacttggcagatagaaatgatatctttgtcacaattttgtcaagaaacaatactggtgcattaaatgacagttcaatctcctctttccttgtttctttctgttatatttcattttcaaatttgattctgaacatggcagaactctggatgttttattatattaagacagcgatgataactatagtaatacaatattaccttctccttgtactgtacttttaatctttttaaaactattttttatctaccattctatttgatgcaacaatccattgagggtaaaaggcacaagagagggagtcagggatggtgcactgtaaatgcatgcatctattgttttaatggacttatctccccaaaatagtagcatccttcgatgtttatttgagatgaaaaacaaacaataaaaatctttaaatgcttttgactgatgaattctggaagagattcctgggtcttttgggtctgtaaaaacaggcatgcattttttggctcctcagagaaaatagccacagtgagtctacacctgtgatagaacagccagaacaactggaaatgactcctgctgttcactcagctgcctggagcccagattagctgaaatggagcaccaccttatttgcagcagcagctgccctcgggctccgattcctgtgggacctatggcttcttcttccctgtaggaaggttgccctcaagacacatccaatgggtccccaaggtccctgactctgctggctttcccagatagctccactgcagctgctagcccaaatccaaaatgctgaagcccagtggtttgtttatccccctaccaacagggttcttggaagaggaaacccaaaccacacagggtgtccagagagatctggcaatgtctgaactgtccagtactaatgacgaaggttgggcagccctagccatcctgaagcttgctactcaatcctccttgatcctggggagttgatcctgaacctctcacacacagaaggtgacacaaaagcacttacctggcataacaacattctactaaccaggccaagtaaccattactacaggagaaggctaagagtgtactagcattatacagaaatgacttggttattccagtaactgggccgctctcttcagacaacagtgattgatgtattatcagcatacttttttatttatttagtttttgagacagagtctagctctgtctcccaggctggagtgcagtggcgcgatcttggctctctgcaagctccacctcctgggttcacgccattctcctgcctcagcctcccaagtagatgggactacaggcgcccgccaccacgcccggctaattttttgtatttttagtagagacagggtttcaccatgttagccaggatggtctcgttctcctgacctcgtgatctgcccgcctcggcctccccaagtgttgggattacaggcatgagccaccatgcccggcctatcagtataaatttaaggcagattttaggaatagcatatataaatcgatacatctagtcacaaggagggtattctacatccaccaaagtatcgggtaaatttggtgtataaatatttagaattcttaacgtttatctacttagaataatggaattgccagatagaattttcaaaggaggtgcctacaaacacattgtcaagaaggcgggtccctttttaatgctgaaattagctgtgaatgtttttaagagttcctggaagcttacaaattacactaagtgctaaaagaatcccatggaatattttgtgatttcccagaaatcgtaaaaatcctcaaggcattgctgaaacctcacttagtaacattaccaattttttctaacaagatcccatcaacattttgatattaatggttttgtttttaaacttgtttgcatcccattagagatgtgtattttatgagtaatttactttccagacacagaagactaaaaaaaagaccctacaaacgcaatcaaaatatacttagaagaggtgactttttttttctaaactcaaaccaaataaatgtttagaaactcatagtattattattattattattattatttttctttttgaaatagtgtcttgctctgttgctcaggctggagtgcagtggggtcatcatagctcactgcagccttgatctcctgggcacaatcgaccctttcaccttagcctcctgagtagctgggactgcaggcatgcaccaccacacccggctaatttttgtctttgtttttttgtagagacggagtttcatcctgttgcccaggttggtctcaaacttttggcctcaagtatttctccctcctcggcttcccaaagttccgggattataggcgtataccagcatgcctggccaataacatgtcttttgaccttttacattcaaggctaaaaccgatagataaatgtatctggaagatagtatgcttcttgcagtataaaatgtaatacaaaatttatagcagtattagcactcttactattaataatgtagattcatactgctaattatatgaaatgtatatcagtaggctaattcctcctcaaggctaggacaatggcttattctctctctgcctcctcgctgagtcctagcataatatttggcattcaataaataattatttaaagaatcaagcaagaacgcttccagataagaggccgggaaagaaaagctaacaatggatagacttcaagtcaagaacagggttcaaacagttgagtctgtctatactgtcactggcattcaggctcaaaggcagtgccattatgtgaaagataatatacagaaaaataattgggatcatgtgattccagagttttaagaatcttatttctatttggtttgatttctaatcatgttttctgatttttttaaaaccgaaaatgtatttaagtcaatatctttatatctttattaccaacatcaattgtttatgctttcccccaaggcactacatgtttagtgattaactctgtgataacattaaagatatataaagatacacacacaaatacacacgtctgtgcatagtgtctgctttttaatggctcttcagcagtcttttaataaaaagagaatgataccctttgactcaggatcagcagaaaacaacagggagaaatgacgtctcagccatgccaggcagtgtctgggagcaagaagtagattcagcaaaaatggattaatccagccctaagaaagaaccagtatcctgatttgttaatccacacatctggttaggcagaggctaccctacttgctcacagatgtccctaataatattgactattcattctcatagagggacgggcattttaaaactgtaacctgtgcctgccacccacagaacgtcctgaattaatgaaatcccctggttaccaatggctaatagctgcaaaggccagagggaatccagggaaggccatagctctccatgcagttcctccacaaatcaaattcgagaacagtctcaatagatgtacttggaaagaactcaacagacatttgcaaagaaagttacttaactttcttttaagcctgacattctataaatatgacccaagttccttcaaccacctctcagggaaggtggattacagaaggagtcccttcatgtttttattcttttatattgtgccataaaaattaacaaaatgagaagtcattgccagaaataagaatttttaaaaccgtatttagggtgagctatatagttttaggctatttcattttccaaatttctcttaaaatcgagatgtaactagaattccatatttcccacaaaatggaaacccacaaaatattgagtttgaagtagtgaatgccagtctgccatgaagaggttttaaactgctgctttatgtaaaatgtgtgtcatgtgatcctctgacttcgtatactgactagtatttaaactattccagtctatctgtcatttctccaattagatgatagactccatgctgggaagaatgtttgcatataagtactcaaaagtatttgtcgatgtatcgcctaaaattatctgtttattcaaagagactagctgtgattctctgtgttcggttatttttctgtgatctggtacactaaggacatatatcagtggcttttctttcctcttctgcagctgattaaatgcccagctgatcccggctgcattatgtttcccaaagggcatctcagtttgattcagttggctgtttagtttttcatttacagattcaagctattgagagaaggcgctaataacacttctgtcaatgtaatacatagtttgcaattgctttcttaacaacaaatagcattaaaaaatgagtgtatgattttagatctttaataataacctaagggatttcataaggcattacctgcctgcatttatattttaaattttgcagttatttaacaatttttctcatttattttagtgacatcctctcttaaattaggtgttttggtaataataatacgtgtgggttacatttttcagctctccggagtgtttgcatgcattatttcatttttctatttcccacaggctggaaaagtttattatacatattttatagccaggaaaagacaggcagagagaaggaaaatgacttccctcagggtcatggggatagcaaatagctggagccagaaactctatctttgacttgcaggcccctttctatccactgtagtgctgttcccaaccctgtcccaggtcaaaggcaggcagtgtgtgcgacgatcgccttagaagcttgcccaaaatatagatatctgggccctcagatgtaggactctgtttttaaaaataaaaagaaaaaaatttttttttacctagtaatttgtcaacaaaaaagagtcattatttggcaagggtgcagaaaaataggatccttcatgttccactgaggtttatataaattttcaggggggataattggagaaacgtaacaatgtaaatgaagatgcctcttcatccccaaattcctcaatggaaatgttcctgaaggtatagcaaaaaagtatgccaatgtctacatacaaagatattcacttcacagctgcttatagaagtgaaagaatgcggtgagagcgtgagtgtcagatgcaaaagactgtcaaagggaaccaggtaaaaagcatggtaggtccacaggcgataaagactcaagatcctggagcagtatcacatcactgagttggaatccctgcctcaatgtacactaggtttgtgaactggggtaaatcctttaacctatcaaaacttcagcttcatcaatgataaagcaatgatattattagacccaaattcccaggattatagtaaagatcaaataaggtaaaatgtattatgcatttaacacagtgcatggtgcgtaaaagatacataaaagttagctaggacattactagtgttattctcatcattattataataagttgtggtccagcaacatgatttcaattatgcttattagtaatagttggaatgggccagcaggaagataagctagagggaggtgttctcttgcaaaatgtccaagattcgacgaatgaaggagtcgtgtccctggtggagtcctcttctgggtccatcgatttttaagggaatatacagaacagttggctagtgctttttcaatgtgtgaattatctcataagtaatcaataaataaggggataaggtgagtataacagactgcatctttttactagcatggaaatatgggatgctacccggggcaagattcctcacaaatgaagagtgttagggaaaccagccccacaccacccggcgggtaccccgagtccagcggagacaaaggagttagaaagagacagaatgagagtttaaaaggcgggtccaggggacctgaggatccggaggcttgctcacagcccagaggtcccggcctccacccaatttattggtttacaagctctttgttctcagggcaaatgggaggggtaggaagggatgaggaaaaggattaatcagtgaaggagaacttgtgagtcattcaacaaggtgtatgtgaatttcctccagcaaaggcgtgtgtctgaactacttaagatctttaacctattgggactgaaacgggtgggcgtgggtttcaggagaagccaagatgtttgattattctccattgcttcagtggagtgttatttccccaagcaaccagtggcatgccgctgagctcttctgctctcagagcataaagacatgaaggaaataaggagacttttctcctcagaagccgcccatggctccccatgggtgtctcacatagggcagaccagctcatctggcaccacagaaactctctttcccacaaagaggcatcctcagtagtatataagtagacaaagaaagcaaggtgaacacctgcagaacactttccattaatgaaagacgcttctggtttagtggtttcaagatctacaacatgaagagaagctatctgtggagttgcaaaggcagataagagcaggtatttcctttctcttaaaaacagagaggaagtacaccctcaaatcattttcctaattttcataaaccaggtgtgataaaatggacaaaaactgtctttgaggccctctctctggaagtagctgaagcagatgcccaggtcataaggctgcagaacagtctgtgatcctggtgaaaactgagaagtgggatcagtctgcaaatattcacagcaaggctgtcaccgtgtttgctaagactctggaatcagagttcttcaaaggtacactgagtcacccccaacacttttcccccccatgtctgttactttattacgcagttttacaggaagtctggaaaggtgtatggcattattccaaaaaagacctgtatttcccagactagaaagcatctgtacctctttaaaaaccctgataatataacatcacagggaagcagaggagagaggttaaaaaagaggtgttggctgggtgcggtggttcacacctgtaatccccaacactttgggaggctgaagtgggcaaatcaccagaggtcaggagttcgagaccaaccgggccaacatggcaaacgcctgtctctaataataatacaaaaattagcctggcatgatggcacacacctgtaatcccagctactcaggagggtgaggcaggtgaattgcttgaacccgggaggcggaggttgcagtgagccgagatctgaccactgcactgcagcctgggtgatagagtaagaacctgtctcaaaaaaaaaaaaaaaaaaagggggggcggaggggttgatttgaaaaatttattgttttttgctacctcatgagtatactaattttttgccataaacatatatgtttttaataattgaagaaaaacagtcgaaacagataacacatactcctaaattatactcataatgtgttctcatacaaaatgagattgcaggccactacattagccatagatggcactaagcaaacacctgaggccgaattacaagcctgtagcagaatctcatctccacccaccgtgccccgcactgcatgcataagagaagaagaagctcaaggacatactcacacgtacaagaccgatctggtgtctcccaccttcccagcatcaccaaccgtcagggtgtcatagcctcgctccagctcaaactcttcaaaggcaagcttgatgacctaaatacaaggtacgaaacagtgacttagaacaacaggtacttcccatgacttttaataggtattgcaaatatctagttatactgttaaattttgctccttaatgccaatgtcaaatgatcccagagctgctttaagtagttacatggataattatatatatttgatagcctggcattatagaattttatgaaattcagaattgctattactcccaacttatgtattttcacctctaaaaatgaaatttaacctctgcaacactttaagccaaatatctactaaatgtttactttaacattctcagtgcttaactaaatcaatattagcaaaagaaatgttggttatagttaatgacatatatttttaccatatccagaatgctctgcaataaatatttttaaagttctatatgcatacttcatggaattatccatattagcaccccaaaagactttatgaggatacaaagctctcctctatatttagtcttgcaaagcctgtaagttttttgtttgtttttttacaaagaatactttgtcatgatgagcagcaccaagacatctgtacaacaatggtttatgtttgatgtgccagtatattataatctattaacttctttctgtagagcacaagatctttttctcctgaaagaagaaatgcttcctttggtggccaatactatgaggaagaaaaagttaggctagaaccctgggtagtaaggagaaaaaggaaagaagataaatacatgatgataattagaggaatgatagatagatgatagattagatggatggtagaagattagcagatacagacagattagatgatagatagatagatagatagatagatagatagatagatagatagatagatagatgacagatagtagatagatgacagactggatggatggatgggtggatggaaaaatgacagacgatacacagatacatgaatatataaatgagagagagagagatgtaacaagagagacgcagagggtgtgagaaaggaaggcggaagagagaagggacaggaggaacagaaaccataatactggaagtacattttaataaactgtgttttagaatgaaacagaaattctgaaatagcgtagaaaagtatcaaatgcctgtttgttaagcttgaaagaaaagagtaagtggtagcatagagaagacagacttcccactaatacccaagtccatgtccaccattccaacaggctctaaacaggtgcttttccaagcaatgccaaaaaggaatacattacatttgctacttgaaattcttactaaaattattaatatagccattataatttatttaaaaaacctactatttcaaattgcagtatttgtatgaatacattattttagcaatctcatttgaaataggtgtcgaggttgatagctgttgcaaaccagtataaatactgcatgttaaacgtagcacctgatatttttatttctactttttgtttctcatgaaccaatttataagtgaccatcatctgataatcagacaattttaaaactgaaagaatcatcactgagacctgctggtttcctttccgacatgttaactcagtcctgacttgtttaaagttctggtgggaagcgatgataattcattaaggtttgtgtgtcatgtttggctgatttgcaatgtgtacagataggggtcacactatatgaatgggctctcattaggggtggaaaaagggccattctgtaattatttcaagccaaggcaaaggtagacagagaaagtctttgtcagtatttcatctcaacaatcagcaggtcctgttgtcaaacaccaatctttactccacgctgctgatgctcagtaaaaacagaaaatgcagccttggtcttgcatagacagcttttagtttgtcatatggcattttacaaatatatgcagctgtaaaatagaagtatgtgtattttaaccacatataccatcctttcagagtaaaagaaccagagatgcaaatgaaaactgaagacaaaaggataatacatttcaagttgtgagcaactttaatgacattgagccaaaatggttttagttcctacagcatatgcaccctccttatgtcttgcatggactccctcagctgtcctggagctggatgctccatatttctttttttacatataattatcttatctttccttaagttccggggtacatgggcaggatgtgcaggtttgggacataggtaaacacgtgccatggtggtttgctgcacctgtcaacccatcacctaggtattaagcccagcatgcattagctcttttccctgaagctttccccaaccaatgttcccgaaataggctccgatgtgtgttgttcctctccctgtgttcatgtgttctcattgttcagctcccctttgtaagtgagaacatgcggtgtttggttttctactcctgccatttttcttaagtgcctgcttaatgttcctccctcagctatggctccactgccgactctgtccaagaaagccagtctctttgccaaaatcctgcctatccccttcataacattccctgtgttggcagttttggttggtttgctgttctgcctgccctgcagagctccctgtaaggattgagggcagacaccatgtggcttgctcgtggagggaagcactggcctcaacctacaagaactcactgaacatcaactcctccaggccacagagctaggagtgtttatttgaaatctttctacttttttgatataggtgtttaatgctataaactaccctcttagcactgcttttactatatctcataggttttggtatgttgtatttctattttcatttcccagcactttgggaggccgaggagggtgggtcatgaggtcaggaattcgagaccagcttggcaaacagagtgaaaccctgtctccactaaaaatacaaaaattagcctggcatggtggcgtgtgcctatagccccagctactcgggaagctgaggcaggagaatcacttgaacctgggaggtggaggttgcagtgacctgagatcaccaccgccactgcactccaacctgggcaacagagtgagactccgtctcaaaaaaaaaattatgtttaaattttgttcttaatttctttatagacccattggcctatttcttcatagacccattggacactcaggaacatgtttaatttccatgtattcgtacaattttgaaagtttctcttgttatttatttctaattttatctgttacagtcaaaaaatatacttgatatgatttagatttttaaaaaatttgttgacccttgttttgtgggataacatacgatcagtcctgaagaatattcataccatgtactgatgagaaaaatgtgtattatgcagctgttggatgaaatgttctgtaaatgtccgttaggtccatttggtctacactatagtttaagtttaacacttctttattaattttctgtctagataatctgttccatgctgagagtagcaggatgttcaagtccacatctattattatattggagtctatctctcccatcaataatgtttgctttatatatctggggtctctggtgttgggtgcatatatgtttacaattgttatacattatttttgtctttgtctcattttacatttgtttcactttccatttatttatttatttatttatttagacacagtcttgctctgtcacccaggctggagtgcagtggtgcaatctcagctcactgcaacctgtctcctgggtttaagcaattctcatgtctcacccttctaggtatctgggattacagggtcaatatacccagccatttcacattttttcacttaaagtccatgttatctgataaaagtatggctattcctgctagtttttggtttctgtttgcatggactatctcttgtaatgtcttcagtttagtctatgcctttacaggtgcagtgagtttcttataggcagtatgcacttagatattgctttttaaattatattgtcacttggttatttctgttctggttgttttgcacatcctctattccattctcattctcttcttggttatttttgtggtttggtggttttctgtagtgatatggttttacttctttctcatttatttgtctgctctaccagtgaatattactcttttgtgtgtcttcacaatggtggttatcaccctttcactttcagatgaagggctcccataagcatttcttgtaggaccattccagtagtgataaatttttattagcttttcctcatccgggaataattttattcttacaactctaatgtatagctttgctgggtatagtattcttggctgacatttcttcttcttttttctttcagcattttcattatatcaccctgttctcccctagcctgtaacggttctgctgagaaatctaatgttagtctgggagcttcttgcttatatttgacttgactgttttgtcttgctgtttttagacttctctttgtctttgaagttttttattatgtatttatattgctatatcaaggtgtggatattttggaggtatatgtggtactttgatacatgtatacaaagtttaacgatcaaatcaggagaactgtgatatccatcacctcaaataattttttcttttttctttttcttgggaaaattacaaaatcaccaggagagaaggaagaattgtctttgacttttgatagtttgattataatgctctttggagagcatctttggcattagatctgtttggtgatctttgagcttcctggatctgaatgcacatatttctccaaaaatttgagaagttttcagctgttattttattatatagatatcctacacctttctgatctcttctccttctagaactcccataatgggaatatttgtcccctgcattttgttccacacattttgtaggcattccttattcttacttattcttttttgtctgactggcttattccgaaaatcctgtctccaggttcagaaattcttttttcatcttgatctagtctgttgttgaagctcttgattttattttttaaattgtattcattttattattcagtttcaagacttctgcttagttctttttgtgtaatatctctgttgaatttctcattcagatcatgaattgttttcctactttttgaattgtctatttttattctactgattctcacggcgtatctttaacatcattattttaaaaatcatataggcattttgtagctgtccttttctttgggatatggaattagaaaatgattttgttcccttgggggtgtcatgtttcttgctttttagacatttcttgtgttcctacattagtatctatacatctgacaaaacaatttctcctaatattagaatgtagttttagtaggaaaaaactttttcctgtagatgtgtctcatagtgtcagttgggtagggtgctttggtttgtattctgcatgagtacagtagtgcagtcttcatgatatttatttggttgtaatcaatgtctgcatgtttgtagctgtctgagtagccttggctgcaggtgtttgtggaagtgttggttcagctctaatgcagatggagactttggggtggccttgttttggggatatagaaggtcacatgagccatctctgcttctcagtggaatgagttttctggcagtggttggcctcaggtgggctggtccttgggtccctggggagcatgtgtgagcattcagcaactccactgcttggagtggggggagtgttcactgctggcagcagtacccaaaaggccagtccttggtctcctgcaagaggcatatatccagggtgcttgttggtagtgtgcctcaagaattcagctctcagggtcttgggagcatgcactttggctccccctgtcttgagagtggcctcccgactctgcttgacgacttgtggtatagggtacttcatggtcttgagtgctgggttcaggtttgtgtcactgagtgcagctggggtcatagtcctgcatccttctccttggctgtggtgggatgatggctgcgttctcaagatgtggagatgctactggccctgtgggcaggatgtactctgatagttcttctgtcctgaaaatggcaccatgctgcagcagcctgaggcccagagaacaagagaggaacccggtgtgagttctctccccggagcaaaacagtcatgtgggctgcaggtagctccctacccttggctcagggcctatgaggcctgtgggggcttttctgaagccctgaatacaggcatctggggtgggagtgtgacctgctggggatctcccacttaccttctccctacaatcgggagtccttttttggcactgaacggatcctacctgcgcacttcacgttcatctttatgctgccatcttgagtttccatgccttagagggtcttctttactctgttgcttcagtacagtgttctcccctagacactgcacttgacatgtgcttacctacttgtcattttggttcctctttgtgaaggaggaaagtgctgggcactctagctagacatctcgatgtctgctaagctttgcatgacttttagacatttctagatggtacgtcaagccactgtggccagtgagcatttagaaaaaaacagtatggagcttgggagaggttcacgaccagacacacagaaatgggggtccctaaccacagatgccacctaaaatactaagactctgtcagagtatcaaaggaaggcacgtgaaaagaagaggaatgaggatgagctgcagtctctttcatatttagaggtcaaggaattgaggaagaaatgacaaagaaaaaagaatctgtggtagggaggacaccaagaatatggtgttttgtgaaaaatccataaaactaaagatcttaaggaggagggagtgatcacatgtgttgaatgctactaagaatgtgaattagatgagctctaagatgagacgtgtgggcttgactggatggaggacatggataaccatggcaagaaagaacagcagagttgtaggcatggaagaagcgctaaagtggattggcagaatgggatgtgaggaagcggagtaagtggttctgcagatctctcaggtatcttaactaacatggatgaagagaagtaagaatgtgtcagagaggattttttcttttaatggagaatattgcaagagaataagaatgattcaataagtatataaatgattttgcaggaaagaaatattgttgctactttgattcaaataatatgtattttccttgacaaaatattaatttataaacaaaatgaaaagatttcccaaaaatcaaaaataaaatatactatatagtttcaatttactgaaaaaaattcatttgatatgggtccattcaaatagagagaccacttctcctgattcagttaaaccaaaagaatccaaatatatcaactgatctctatgatctttgcctctgtgcatgtgcatacacacatgctcacacacacaggcacagaaacacacatgcacacacatacacacacaccccaagaaaaatgtatgcatcattgggtttcttccttgatagcactatttttaagtttttccttttgatgttcttccgtaaactacatttgtttttctgaataacatgtttgtgtcagaaactgtgatggcaggcaaatgaataggaaaaatattttataattttccaagatttagaactgacagcacaatataaatcagtaccaagaccctacatcttggaataagataatttataaatgctttaattaataactgtaggtttgaaattaatgggttagaaatgacaactcagaacacactggaaggaacactggaaaactgacgctataatgtatctgattcattccacttcaaattatgtatcagaagaaaggcctttcaaacagtgaatttcctcataaaaaacatgataacaagtttatgtctggaaattattaacacggttgcaagaagaacgattacacattttaaaagaaaatgcacactttcttagaaaataaatattatcaaataattttacttgttttcacctgaggttgtaagggccaatcataaaacaactaaaaatgtaattaatgataaggagacaaactgaccaaatatatctaccatagatactggataaatatacgtttaaatttcctacaaaagaacacatacaacaatcattgctgatgggaatgcaaaatggtacagtcactttggaagatactttggaagcttcttacataaccaactatatgcttatcaaataatgaaataatcatatatcttggaatttaacaccaacagctaaaaacgtatgtccacacaaatcccagcactttggaaggctgaggctggcagatcacgaggtcaggagatcgagaccatactggctaacgtggtgaaaccccgtctctactaaaaatataaaaaaattagccgggcatggtggtgggcgcctgtagtcccagctactcgggaggctgaggcaggagactgacgcgaacccaggaggaggagcttgcagtgagctgagatcgcgccactgcactgcagcctgggggacagaccgagacttcatctcaaaaaaaaaaaaaaaaagaagtatttccacacaacaaacaactgcacatgtacgtttatagcaactttattcataatcgccaaaattaggaagcaaccaatatgtccttcagcaggtgaatggataaactgtggtatatccagacagtggaatattattcagggctaaaaggaaatgagctgtcaagccatgagaaaacatgggggaaaactaaatatattttaccaagtgaaacaagccaattttagaaggtgacgtgttgcaacatttcaactgcatgacatttcggagaaggcagaactatggagacagtaaaaagattagtgattgttaggggttagaagagggagggatgaagagcaggagcacagaggatttttaggacagtgaaactctctgtgtgatgttataatggtggacactgactttatacagttgcccaaatccacagagtaaatagcagccggagtgagccctaacgtgcactatggactttggtaattcagcatgaatcaatgttcatcatgcatgaacagcatgaatgcatgttcatcaaatgtaacaaacacaccatgctgaaagcatctggtgaggatgcttacagtggggaggttgtgcatgtgtgggggcagggggtacggggaaactatgtcttctgatcaattttgctgtgcaaactgctctaaaaataaaacctaataaattaacaaaaattacacatataagcttttatatctgtatgcaacacataccaatagcccacagtatacagtgtgaaattacaaagactgaatttcaacctagaaaaaagtactttgaacacacacacccacacacaaagaaagggagttagaaaaatatgtcattaattctgggatatccttgctttatctgagatgtttagccccacatataaacactaggagtctcttataaactacaattcaatgcactgctatgaagaagaggattcacacattatttcaaatgtaactatatgactattagcctatgctacaaaaagtcaaagctgctagtgattcagggtgggaaataaagtttgcacaggcagtgaaaagcgcaattcctctaaaacacagcagtcttgggacggcggcatcagctggcaggaagccaagaaacttggtatttcatgctaaaatctcccagatggttctctggacctttaagtattactgacatccccgccctcagggccctgccaagtcccttttgtcagctttaaatggtacataaattaccgtaattctctttgtgctgccctgctacagagagaattagtctcagctcaagacagctaaagaagctggatgtcccccatccactggaaaggattcctgagaagacctggcttagttttccctgtctcagcccacctgtggtttcaaaatggcctaaaaagcagcccccctctttccttgccctccatctccccccatccccccttgcccccccccaacccccacactcttcctagcccctggtagccactgttcaactctcgacttggatgagatcaactttttaaacttccacatgagtgagaatatggaggcgggggttagggcgtggacaagaagtggttgattttggggtatgaaagtccagctagataggtgcaatcagttccagtgttcgacagcactgcagggtgactgtcatgaacaacaatttgctgtgtatttcaaaatagcaagaaaacaggaatttaaatgtctccaacacaaagaaatgatgaatgtttgaagtgatgaatatgttaattcccatgatttgatcaatgacacactgtataccagtattgaaacactgcatgtaccccataaacaggtacaattattatgtattaattaacaatttctttaaaaaaacattttttttaagtgaacaagtacaatcacactgacaaaagagagagtctgggctttgctgcttactcaacgagagtcttgaaagaattgtttaacctttcttctgtcttatccgtaaaatgagaatgatgccgatttccctgggggatttctgggattcaagaatgcagtgcaagcaaggtgtgtacttcttcttggcatccagcagacacttgatcaatggcagttgtgttcattattatcctcatggcaacccttcataaaaaccttgtcatgtctgccagacccaggcacattctgccaccatttgaagtattctgttatttcaaatctcacgagtctttataaccaagaaaaactcatctgtcttctctctgactctgcaatttctaactccaattttatctaaaatgacctcttatcttttgaattcccggcaaattttatcacctgcacccttccttctctattgcagtagtggtattttgcttctcttaagtgtggttttcacaaactacttagatgaagaaattgtggatgcttgaggagtaaggtgagattcattaaatttcaagagagtagcaagttgagagtcatgtgaaaatgatagtggcaaatgtggcaaggaaaatttctgaagcagaacccgtcaaaatgccagtgaaatgggcagagatagaaaatgcttaagcacaacaacaaagattaaccagtgcaccagggaaagtaagcaaacaaaacagtgatggagaaacagttaaaaaaaaaaaaagttttgctgcataagatgggagaataagctagtgagaatttcaggagaatttctgtaacccctgaaataaagtaacccaagcatcacaggcagatttcagtaaattattgaaatctgccctcagatgtatgaaagagggtagagtaagtattaaaaaatgagagactgggaatgtaaaagtcgcaatgcaataatggatatagaataaaccagaacactgttagatgcgataaaatgcagaattaacatttacatcaatcaaccaaagatgtgtggagtgaccgctgaaactttgaaggagcaaaagatgaaaagaagatgagagaaaattatagatcactacatgaaagcaaaagatattgaagtttcttgagaaataattatgggcgcagaatcaataattagaaaaataatggaagatacactttcacgactgattaaagagttgagaaggaagataaaagtgcttcattatggcccctgtaaatgaaataaagctgtatgacaataataggaatacgtcacctcacagaattcacactaacaacaccagaagaattctgtacacaaacccagaagaacaagcagattatatttgaggaaatacaaatcaaagttagttttgtctttttttggtagcataacaaaaccgtagaggtactggaccaacaacactatgagcactggatagaagggaaaacgatgttctgcttagtatgtctacttagcaaacaggctattttatgtgagaaggaagagaaaatatttacagatttttaaatgtctcaggtatcgtatcaacacactccttatcaccaacttggctgaaaggtgaacttcaaataataagattaatttaaaaaacagttacttaaggaggttctttacaaatacactaaaaagaatgatctccaaaaagttatgtaaaccagaaaggaagagggttgagtggataaaaatacacgtatgtatatttattcttacatattaaacaatataatttaacaaatgtagaaagggcaaccaagttcctcctggggttgagccctggggctgtgttctcataaggaggtgtctcatcggaggccaggtgataggtgcggcggccagcagaggaagtgccagggaggcagctgaaactcaaggactctgaacacccccagccccaggacgagctgtcagggagacggccctgggggagagggtgcaggtgagccaggctctatgtctggcatcatctgtcacagacactacttaagtgcctcagattcctactacccgctatttctagacatccaaagagacaaggaggcttgccggagtttgcatgctaacaagaacactggaggtaggggagtaaacacgtttttacacatgtgtagagaggagaaggtgccgaatgggtaagtactcacattctcaccactggtcatggccagaaagggggaataagttacttccagtcactcttccaataatgctctatggagcagcagttacacagatactttacgtttcattcattccctcatctttcattcatcttcaaccacgcctctaaatatctctatgtctcccaaaaaagcatgctaatatttttcttaggaaaacttacatctgcatattcagtaagtttctggaataaataaactccgaatttggggtgtcatgaagataaaagaaaggaggcaatgattgactgtataggagatttcgagataattcaacaaggttgctcatggttggcagtgatttacttcctccacacctggattttttaaatgcttttcaaggtcttaaattttaaaaacaccataaaactaaaataaatataaaagtgtaatgacactatttgatgtcggataatttgaaaataaatattggcaacatcacttaataaatgtgttgatgttcacacttaactaatttaggaagttttgcttatctttgatatagagtttctaatatacattttcatacaagatgttgtaagaattgaacaaacgtatataccaagtgcctaacatagagcttggtgtcatggttacagttttacaaatgataattactattattataaaaatcatagaaattgaataaacagaatttacatagtggaaaagtggtgatttaagtggtttagaggggaactcaattgtgaatcatcatgaaatctattttgtaacattaggtaacctatacaatattttttttgtagaagtaaaaaggaaaacttctgcctttactcatctcattactaagaatattttttagcttcatccatgtccctaaaaaggacatgaactcatcattttttatggcagcacagtattacatgatgtatttgtgccacattttcctaatccagtctatcattgttggacatttgggttggttccaagtctttgctattgtgaatagtgccacagtaaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacattcccaccaacagtgtaaaagtgttcctatctctccacatccttttcagcacctgttgtttcctgactttttaatgattgccattctaactggtatgagatggtatctcactggggttttgatttgcatttctctgatggccagtgatgatgagcattttttcatgtgtttttttggctgcataaatgtcttcttttgagaaatatctgttcatatcctttgcccactttttgatggggttgtttgttttttttcttgcaaatttgtttgagttcattgtagattctggatattagccctttgtcagatgagtaggttgcaaaaagtttctcccattctgtaggttgcctgttcactctgatgttggtttcttttgctgtgcagaggctcttgagttttattagatcccatttgtcaattttggcttttgttgccattgcttttggtgttttagacatgaggtccttgcccatgcctatgtcctgaatggtattgcctaggtttccttctagacaaaaaaccaaacaccacatgttctcactcataggtgggaattgaacaatgaccaacctccttgtctctttggttgtctagaaatagcaggtagtaggaatttgaggcacttaagtggtgtctgtgacagatgatgcaagacatagatcctggctcacctgcgccccctcccccagggcaggtgagaacacttggacacaggaaggggaacatcacacacgggggcctgttatggggcagggggaggggggagggatagcattaggagatatacctaatgtaagtgacgagttaatgggtgcagcacaccaacatggcacatgtatacatatgtaacaaacctgcatgttgtgcacatgtaccctagaacttaaagtataataaaaaaaaaagaaaaaatagaatattttttaaagaaatactaaacactaagaatgaaaagattcagatgaatgaactgagacacttattttagcgatgtgtgagaaaattttaaaatcactgatttattcaatcactccttcagtcggttttattgtacttccagcttatctattatggaaaattttctgcgagttttatgtcatgaatattttaaaatttaaaacaaataaaattatcattctatttagaccgaatagaggacagaacgcctccgtaatgctccaccacctacgcttttcccattatggaaagagacacatcagctgtcactctcctacactgggaaacggtgacaaaagtgaccagttagagccatgagacaggaatgatccatggacccttgcacataaatttttaaaagtctgagaacttaaagtcctcatgcttagtatttctgagctcagacttaagtgagaatatctcagtgcaaatcccagctttgtctcttgcaagctatctgaccttgggcaagacactgtatcagcggtccatgtgccagtttcctcctctttacctggggacaaaattaatgcgtgctcagtaggattcttatgagaatttactctaagtattcagtagataaggtcaactcaaaagtttctatgtcaagaaagtgattggtttcggaaatctgggcaattagagaaacaatattatctggacccctttacaaacacagagatgaaaggagattaaagcatggacaatgactaaaaaatatatttaagcctttcccccacccatagttatagtaaatcattttacgttcactgtttctttagccaagtcaactttgtcataagaaaaaataatccattgctattaaatacaattttagacaattttctcaggacaatgttttggtgattctgccttctataggcaaggagtcttgcacaagtcgttgaactatttttcatttcagcttcctcatctttaaaatgaagaaggtaggctattctaccaagattgcctctaaattttattcaattccaattttctataactgtttctatgttagaagctatatctagtggatataacagatctaatctgggaaagggaagaagctataagatatcatcaacctaacaaaaagaaaacaaaagatgcttaatcatcttcaactgcagggctatttgcttcctattaattaacagaataatcagagtgatattttgttctagaatccaaggggtctgcttgatgccttctgtcctggagcacacgtctgtcagcccaccagccaggtgtgaggctagctgttcaggaagcaattatcaggttggacccaactctgtggccatggtaaaggggaactcatgccccagtgaagcgatgagggcaacgcttaagttgctggcatttcagcctctcccatgtgcagtttcttacttggtaagtgtgtcaaaaaattgcaaatgcatctctccaattgacgtatacaagtcgcgtatccacttctcccctctacatcagtgaaacaccggtaaggataaagaaaatgaattcattaggagaaagtaaatgattccagcctgaacataaggacatgaattgacagagaatacatatctgtgtatatgcttttgtgaaaacactgaggcaagtagggtgtgctgtactgtggggctggacatcagggagtcggcaggagaagtggccgactcctgccttctgcgccgcgtcccttgcctgcagcccaggcttctcactccacatggcctgcctctgtcttcccattcccgtcacaggaaagagcaacacagccggagcttgggggaggacagtagagaaagcacatgggtacttgaagtccaaatgtcttttgagcgcaggctctgttgctgatttggcctggcatggggtaagttactcagcccagtcccctcaccctcaatatcatcttacagggtctctgaaaatgaggtcttaggaaagaaaatcttagaaggtctttaaagaggtcaaatgaagcaacatttgtcacttgcttaacacattacgtggcacaaaataatgcctcaaaaaatgctggtgactctcttgcagaagaataacatacgataaaaaaatcacatttcagattatgtaagatatagaggcaggattactttttaatgattgccattctaactggtgtgagatggtatctcattgtggttttgatttgcatttctgtaatgaccagtgaggatgagcttttttgcctatgtttattagccgcataaatgtcttcttttgagaagtatctgttcatatccttcccccactttttgatggggttgttttttccttgtaaatttgtttaagttccttgtaggttctggatattagcccttcgtcagagatacatgcacacgtatgtttactgcagcactattcacaatagcaaagacttggaatgaacccaaaggcccatcaatgatagaccaaacaaagaaaacgtggcacttatacaccatggaatactatgcagcaataaaaaaggatgacttgatgtcctttgcagggacatggatgaagctggaaaccatcactgtcagcaaactaacaaaggaacagaaaaccaaacactgcatgttctcagtaataagtgggagttgaacaatgaggacacaagggcacaggaaggggaatatcatacaccagggcctgttggggggtgagaggctagggaatgaatagcattaggagaaatacctaatgtagatgacaggttgatggatacagcaaaccacaatggcatgtgtatacctatgtaacaaacctgcacgttctgcacatgtatcccagaacttaaagtattaaaaaaaaaaattccttaactggcatgttatagatttggaaatgatctgtacctatcctccaaaagaagagaaggtttactcaaaatctgtggccagccaggcacgttggctcacggctgtaatccctgcactttgggaggccgaggcaggtagatcacttgaggtcaggaatttgagatcagcccggccaaaatggtgaaacccctctctactaaaaatatgaaaaaagattagctgggcatggtagcagatgtctgtgatcccagctactcaggaggcaaaggcaggagaatcccttgaactggggcggtggaggttgtggtgagatgagatcactattgccctccagcaggggtgacagagtgagactccatctctaaaaaaataacataacataacataacataacataacataacataacataacataacataacataacaataaataaaataaaataaaaatataataaatgtaatatgcaatttatcgccacagaatttgcgtttttgttagaaagtcaaattaaaaaaaaaaaaacggttgttatatgatgatttttggtaaaagttttcacctgcagttttacagtcacagtgaggactcatgagtttacaacgtttcatttctccaggccccgctccctgggcattccccatcaccgtggatccactatgtggccctagagagttacttttactctgtgatttgacctcctcatatttctcatcctgcctggactgtggccccaaccacgctcatagcaccaaacatgtccttggcagaatttcttactatcctggcacagatgagtctgtccacctaatttaccaccgctcctcgcgggtccacgtgcagaaccatgctgcattctcatcttcagggatggactggaagcattcttgaagatgcagtgctgagtttagcaacttatttgttctatacccacagcctcagcctctcccctaatacagacttcagctcagaaattcaagattactcgtgtgtctctccccatagacaggcttttggtgcacagaatttgatttatgtatttgtaatcctgagcaatgtgcccatgacacctaaggatgctgtaagaggcactgaaagaatgaccacatgaacggctgggctggtgggctggtgggctggtgggtgagtccacagcagcaggagaaatgaaccctctcctccaggagcttactttaatttttttctttttttttttttttttttaagacagagtcttgctttgtcgccaggctggagtgcactggcatgatgacatgatctgggctccctgcaacctctgcctcctgggttcaagcaattctcctgcctcagcttcccaagtagctgggactataggtgcatgccaccacacgcaggttttttattttttactagagacagggtttcaccatgttggctaggatggtcttgatctcttcatccgcccacctcggcctcccaaaatgctgggattacaggtgtgagccactgcacttggtctttttaaggaggaagatgtaacacgtgggcccgttgtataaccatagagagccacagatagcaaaaatatagaaagaagtctccgtccctatgaaaggcattagcatgcttgaaagatcatttaaaaatacatttgaggttttagaattttccacttctaaaacggatagctgtgttttcatggtcattgtctagccctccttggggtgaatgcattgaattattattattatttttttttatatgcctttatggattcagctacaatgcctagactttactctggcaaactttgggaaaaaaatagttacatactaatcctccaactttaataaatcccctagttttcccctatttggaaattattttgttttttgtaagaggagtattttctgagtgaagaaatccataggtaagtcctggctttgtcacttgcccacagatttttttttttttttgagatggagtcttactttgttacccaggctggtgtggagtggtgctcactgcaacctctgcctcccaggatcaagcattctcccgactcagcctcctgaatagctgggattacaggcctgttgtgggatctcaccttgtgatcgtgtgagtcaatactccttaataaaatcctctttatatatacacctatcctgttagttctgtcctttgggagaatcctgattaatacactaatcctacgcaatgccccagaaaacatggtaagacttactgctctgccaccatcatctaagacagtctaccagccaatatgccagcaggtccacaaaatatagacacttggatatgtaagtctactgccctcatagtctgtgtgttagttaccataataggtcagctgcagagtgcagcttcaccaaacacatgagagatagacagcattttaattacgtaatagagtacagaataagaaaactgcattgcagatttggagagaagatcctggagtatgaaaaagtagataaacacacaaaggttataaccacagaataattcaggccagaacataagaaggggccattagaagtgagagtaggtacttgtaataagaaaacagagaaggtagcagattccaatccaggccttctttttatcgtacagaaaaataattttcttataatagcacacagttctcttaggaacaccctgtgttctttagtttttcaaagcatcactcaatcctcttctcttggcagataggaggctcaaatcaatctctccgtaatcacttctgtctcccaggaagctgtcatagcttgttccccaatccctcatgaagacatgctcttgtgtaaaggatactaaataagaccggctttcttagagtctctttcattttctcaggaagccattataaatggtgcaacatagagacgtcctcagtgcattgcagctagtagatatttttggctaggtggctgatctccctggtgatgttgtaagtcttcaggtactgcacacctagcaatacaacatgcaatctcttggaatgattacataatgtcttgcaaatgtggtgttatccccatctgctcacgggtcatccccactgaagaacccaggcttcaatttttggaattgactaaaaatggctttaatgacaatcacttaaaagtaatgtttcacaaataaataatatgttatagttgggggaatattcctaaattctatatttaagtgtatttgttttaatgtgactcactacttttttcagtgctagtcatatataacccaggctacatttcaaattttttttatcatatttgtaggtatcttttgttaatatcatttgaagctgaaccatgatattaatactattttttcagtaaaaataattgccttcataatttatactgcacatgatcctttagtgattaaactgtaacttacagtgggtacctatattattaacacaaacaacatattgctgataatatctaatgactttttaaaaaatcagagaaataaaataaattttattattgtttatatctatatgctaaaggctgcccaagcaaatgtatttgaattgataaatattattggaatatatcaaagtgccttttaaaaacaacattttatactgaaattaaagcctaacatttaatcaaatttataatccatcgactatattcgacatctaacttttcaaaataataatacagttaatgaacattttacacatttaaaaaatcagtcattaatgttataattcatcttgaatacatgcgaaggatcaagaagtagtcatgaaagtcctactctctatgaaattttaaagatttgaggaaattaaatgtcaagtacatttgacatcctatttgtccttaatataaataacagcactgtacctgctttttctggagtatgtggtgtaaataatgatatctgagctgatgctggcatgctgttccgtgcactcacacagctacagatcaccactgtgcaagatcaacaaaaactaaggctctttatgatcttgaaaatgttggtgaagtttagacacttggtgacaaatttgctaactagagatttgcaagagaggaatacacacaattatttccttgtttgttcacaagtaccactggaaaaataaaaaaatggttggcaactgttcaggagaatgagaaagcaggacatgctctcccattgccgttttcggaagtttagaatgtttccaacagaaaacttattactgtggcacgtgtacttggcaggccactggaaatgtggccaacttgcaacagaccaacttggaacaagtcaatcatcacatattctaggccaaaatgaagaatgttattcagcattcattaattcaggtgtatgccttccccattgacttcatttaacaactactttctgaacatgtaggaagtgtcagtcatgacactgggcaatggaattgcctattatacatacggaaagaaaactggacttcagcgtggggaaaattaacttctcatagcatatcttgaaatagtgtttggttacagcagaaggctaaaataatgaatactagtatgtgtttgagtgacgtaccaaactgttcgttgccagtcaatgttctaaaggtttaaaattagtaagtctactcaattaactcaacatctctgtggagatgatcctattagaactccctactgtagaactgggaaactggagctcagacagcctggttacttgagtgtggtctcacagaaagaggaggaacagaatgtaaatctatgcattttgatttcaaagacaatatccttatccactaatattgtctccaaatttgaatataactgtcctggaaagggacattctgcagcacttgcaaaacctaagactcaccagctgtgcataggtatggagctccagtaaatgctaagttctgggattataaagaatccaaagaaggtcaacatagcagatgaatagacttcttccaagttgcaagacagcttagtataatagaaaaatactgggatgtgtcaaaagccctggaatgcagactagttttcaaaatcgtctagccaggcctggttgagtgagtcattggagttgccacttcagtgtctgtgaagaggctgtagtatctatgctactcctctcattacacctttgtgagaagcacatcacattatcaggtcatgtctgcttgaaaatctttcagtggccacagaaatttactcaaagtttaagaggatgtttatttttgttgttattgtttttaattttaattattgtgtttttctataatgtattggggtacaggtggtatttggttacatgagaaagttctttggtggagatttgtgatattttggggcatgcctcaccacagcagtatacactgcaccttatctgtagttacataactaaaagtagaactaccatttggcccaacaatcccatcgctgagtatctacccagaggaaaggaactcattatttgataaagatacttgcacacacatgtttatagcagcacaattcacaactgcaaaatcgtagaaccaacccaaatgcccgtcaatcaacgagtggataaagaggatgcttctgtaagaatgagggtgaaaacacagaaaacagggcactggttaggtgtcatggtgagcaaaggagctggtgtggtgtcagatcaaggggacactggaaccgacagctccagggaaggggcatctggcggccttctcaggagaggaaggaggccatggtgtggctagctccctcctgcagtgtgctcctcatgctcatcccttctcatgcctgtcaccagatgtttgactctctttgcatctcagaattgccagtagaattaataaaatctgtgattagagggaaaacttgaaaagacacagagttgtgaatcacaagagaacaaaagatggaaagaagagggctggcagagaacaggcaatccaagtaaaatttaaggaaacaagcaaaactatagtggtgttattaagtgttttaaggaagctgataaacaatccttagtatccaagcaaagagagtcctctacactccaacctatgcattgatttccaaattgccagtgaaatttgcaggtaaagatagtttgataaaaaatacttagaaaatgtcaggttccaatgtcacacaagtccctgggagaatgggaggagaagtctcattccacactgctgtcctctgcaataccaaatacaggctgagggaataatatttactatacgatttttttggggaaaaaggctttctgaaagaattttggtctagctaacacaatttttcacttgtagacacaaacgaattcagtcacattttttgatagtataactcatagggctgagagattaattaaaatgaagaattcaaggctgggaaatttgtaacaaaaaataacgagcagaattcccttttagtctatgagaagaaacacccaacgacccatcctagaaatcctcaactgcaggcttacaaccccattcttaaaggagatttaaagaaatgtgaagagttcggggcctccttccacagttaatagcttcaacaagtcaaatcttcatgaattattaaacctcatcaataaataatcatataaatcatgtaggtgaacttaagaaacaactctagaaaattatctccctcaagaagatttatcatcagattcaagtgtttagaaaatgtgattataactataaaacaatatgactatagattataactacaaaacaatattaactatttctagaaaaaaaagaatggaaatataccaaaatgttgtatggttattagcgaactatggaccaatgattacttattttttaatctttttgtagttttaattttccttcataaatatgtttcttcaaataagagaaaattatataagagagaattatttcatgcagccaaaagctgacgcaaattcctctggagcttaaatgcaaacctgcgtaccaacatcatataagaaacaaccatttaattgtaaatattccagatgccattgtatttagaaatagacggagacacacaaaaatctgcttttaaaattctgacacatagaaacaatattgcttttgtaaaatctcattggtagactcaacaaagaatcagaaaaatgactaaaatgatcaatgattgccataaagtaaaatgcagtatctatgtgaaagtaaattagaatgcaacaatacagcttttcaaaataactcagaattgggagttaatgtagggtatcaaaaatgaaaggaagaaacaaataaaacaaatgagaaacaactaatcatgccccaaagaataatttaagtaagtagttggtgtggttttcaaagtccttgaggaatgtggagaagaacagttcattacatgctctgtttgttagaattaattactagatggaactagacaccatgcaaactttctataaatcaaactaataaatattattcacatcgccagtcatactataacaagacagtcctatttacagtgagtccgtaagacacttatcctgagagctgttgaatctcctcatattgtcccttttatttggtttcaacacaacaatgttatgtagcacttttaaactgaaatataaatgatctgtttttaaacaatttgcaagctaacttctgtttctatcgcaacattttaaaaatcctcttaaaaccagagttaaggaatttgacttttgtgcctcactgtcccctgtgcaaatatttgggtactgcacaacttaaaaagaaaaacatacctatttaataagctaaaaattccttaatcctgaacacgtgattaattatcactgaagggcaaaattaccaacactttttctttccctgcatataaacattttgtcctgttcatatttttctttctgaaaatacctgagtcttcaaattcaaaaacagcttctactgttagctccaaccccaaataaaaatttatctgcagaaaaagaagtcaatcttgaaagggtttctatggattatgcatatcaattcactagtctggtaattgcatgctggttcatgtaaaagatgaagtttcttgatcatctgagaggaaacacaggctcacaattgagactacattcaaactccagccagcttgtctagtatacagcacagtgtcagaaagctcattttgaccttccccgccatgaggaccaatgagtaccttggtagagactaccttcaaatcagaaagggatgaggcaatgtgccactcagctatctgtagcacatgcatacgaaagcttatcaagcagcatgcaggccatggctgcttcattaatttaatgaataaagtggtgcacgctatacaatggggttgtgttttctgtgatatgtgtaaagatagaaagttggctgtatggaacacttgcatcatttaataataaattaactgctacattactgttacctcttcttaccatggtatcaaccatcccatcaacctcccactaaaatagcaattattttactcaattaatacatttatagtggttttctacagtagtttacttttataaactcaacgctaatataatttcgctgaaagtcaggcacacttttttaaaacttctttatctgtgtgcatatatatgtgtgtgtgtgtatatacctatatatatatatatatatacacgtatagttgtgaaacttgctccacagtaataatagtaaaattctatcatttatgcttcttaaacatacttacaggcacagagaaataatttatatgagaattactgttaagaaaccagaaccgagaagaagagaatttcacttaaattataatttttaaaagtacttcataactatatgtagataagttgattataggttggccagagaggaagcaccataccaaacttgaagtttcaacctcctctattccaaaatgttgaagaactggctttgatatcagtgacataaactgcagaagaatattttgactaataattatgatcctcaaaaataaacacttcaaccataaaaagtatatcatcacatacagctaaaaaagcatatcttaaaaataaaacaatcttaaaatatcaagttactattgctagactgtagtcaacaaaataaaatgtttattatcttgtcaattttatatcatgttttagcttggttgtcaaatcccatcatttctagaagtgcgtacatttaacctttaaaactcacagacaacaccatttactgcttgctcattcactggctgtttcctggttcacctgcatctccgggtcctcttttgtttgtttatttgtttctttaagtctgtttttctaccttctgcttgttgcatggctgcccacctttttttgtgtgtatatcctacaatgacacttgcttatcaccagccagtctccaaaccccatcaccacatctgtagaggaaatctccactaggaaacatcaacacctcaaatacaacctctcccagcctgaaccccacttaggctttgtcacccttgtgtctagcactggaacctcctggtcactgagcttcaacatttgggatgattgttggttcctcctttgctcccctttgtgctccgtggaaaaccatgtgcccatcaaagtcaaagccctctctggagcatccattcctcatgttcttcacctgtcacccctagaactttatgcctccagtcacacacaacctctaattttactgtcattatctcctaaaagtcttcccactttctaccagtcaccattccagtccatcctacacactgaaaatgaatgtatttattaaaacaggttaactctatttttttcacacccaccacccttgcttaaacaccttccctggtttctcactgttgctgatttccccagggattcgtccaatctgcttcctccctgtgctcagagccaagttaatgacttactctctctcaaattcacatgtcttttcacctctgtttctttgctgttggcccttctcccatgatgtcagccctgttgtcttcccagcaacaattcagtgccaccatttccatgaagtcctccttgagcaagctaggaagctcactggccttgaacttcatggcccatagcattgttccttgctgtggtcatgccggtccctgtattacaatgatctgcctgagtatcttatctcatcagtaaacataagttactcccaagttggatctattactgaccatcattgctccttcttggtgtttagctaaatcccttgtacacggagcaaagtacatttacaggaggattaaacagtaaatgttataactggaagtgatgttaaaggtcatcaaccatgaccagaattttcttaatgagaacagtatgcctcaaagatgttaagtaaattctcatttattgtattcccagaacaaaatgcattgaatgacaaagaatggattctctgtatacacaccttcttagctttaagaaatgtatattatcatactatctattctaataccgcggaacagtttgatgccaaattttgtgttgtcaataaaagctgaggcaaacccaattaaatccatattcatcacatattggaaagtacaaaaatgcaattaacaaaactttcatttccacacagtgtaaacaagtatttgcattatctttcatctcaattacattagagtattgcctgtgtgaataatttttctccttatagatatttgggatgtttatctaaattgcattaactttttttaaccctcaattctgtattctttaaactaccactctgactgcaaagtcaaattattcgaagtgttcagcaatgtgaaaaatcgttatatgattaaattttttattattttatcttacataaaatattgcatatgatattactttgaaaacaataatttccattaagcaacagctttttattggcaactacgaagtaagaaaaaagaggagaggaaattgtaaaggatatcttttgacttaacatttaaaggaatgtatgtcaggaacaagtataaaaatatatattgtttccatttcgtgtgggggttttgtatctaccagcagcttcgatttctccaggcaaagagacagctgcatttacttttagatggcataacaatttacaaaatattttgtgagttttgtttactggaacattggtagccccctgagttataagtactttatgactgagaatagagaaagaaatgggaacactactcatgtttcaggcagcccacactccaagaagggtagatgatcacatggcagtactttattgcagactttgtgacatgtgagtttcagtgaggagtagatcagtcgtcccggtacattcacaccgatactgattctgcaccttaatatgtggcattcgggaactacaaagtgctctaccacaatgcccagggaacccaacacatttttcatggttacatattaaattacgtattttatttgacatataatttgttagatatatataattatatatttaatgtaaattatattaaatattacctttcaatatatttatatattatcatgtataaaatatcaatatatttatatattgacaaatatttaaacctgtctactcatttatctattttatatacatacaaaatggagatacatatatacacacacccacacacacacacacacacacacactactcttaaaaataagagttaaaaattgaattcaggtctctaactccacatccaatattatagttacatctgcacatttttcctaaacacgtagaaaattgtcctccttggcattcctcaaagtagatgctgggctacttggaatcaaatacaactgtgtccataattatcccgcatgctatggatcatagtaagacctaaagcatctaccatataggatttaaaataaagcctacataagaataacctatttctgtaattatttttgctttactaaattattttgttctattgtggcaacacagtgtcattctgagattacgtgagatggaactttgagggacaaagaaagctctcaatgagagatcaaagcgtttgcaacctagatgcagaaactgagccctagagagaataaggtgcctaaagtccaattcgcccacctgtggatggctggcagcagaaaggtgatctgacgtgaaaatatgcacacacacacgcacacccagacacatgtgcacacagatgcacacacacatgtacacacagacatatgcacacatgtgcatgtacacacacacatgcatgcacaccgagacacgtgcacacacaggcacagttacacatgcacacacacgtacacccagagagacatatgcacacatgtgcatgcacacacatatgcatgcacactcagagacacatgcatacacatgcacacacacatgcacacacatgcacacccagagacatatgcacacatgtgcacatacacacacgcacatatgcatgcacacccagagacacatgtgcatgcgcatgcacacacttacacatgcacacacatgcacagagacatatgcacacatgtacacgcacacacacatatgcatgcacactcagacacgtgcatacacatgcacacttacacatgcacacacacatgcacacccagagacacatatgcacacatgtgcacgtgcacacacacacacatgcacacccagagacacgtgcacacacatgcacacacttacacatgcacacacgcatgcacacccagagagacatatggacatatgtgcacatacatacacacacacgcacatatgcatgcacagccagagacgtgcacacacatgcacatactcacatatgcacacacatgcaacccagacaatatgcacacacatacacacatacacacccagagacatacacacaagcacacacacacgcacatatacatgcacacacacgtacactcagagacatatgcacacataaacatgcacacacacatgcacacccagaaagacaggcgcacacaagtgcacacatgcacatacacacacatgcacacccagacatatgcacacacaaccagacacatctgcatctgcacgcacacatgcacatatgcatgcacacccagaaagacatgtgcacacacaagtacacacatgcacagatgcacacatgcaaagacatacgcacacacaagcacacacatgcacacacacatgcatacccagacacttatgcacacacaaggacacacatccacacacatgcacatacacacatgcacacccagagagacatgtgcacacacacagacccatgcaaaaacacatgtacacacatgcaccaaagagacgtgcacacacaagcacatacatgcacacacacacatgcacaccgagacatgtgcacacacacatgcacatatgcaagtgcaccgagagacatgcacacagaagtacacacatgcacagacacacatgcacacacagagcctttacaacttcctttctattttaacatcactgtatttaagaacaaatttttggtggagttaaaaatagtaataaacttggtatcatgaaatgtaaaaaaaaaatgtttctaaaaagcacactgtacactcattaggcaccccaggaaaaatgataatgtatgtatcatcaagttggcatttattttctgccccaatcccttggtccaacgccgaataaactctatctgaaaagccaactaaagtgaatctcttatttttcaagctcaaagttacacacatagaaggctcaagccacatacagtgagtcttgagtctcagtagggtcttcttgtctgtgttctgtgtgagactcagccgtcagaaatcattcaggatttgaccttccttaggggagatagcatccctggaactgagggtccttaaaagcactcaggaactttcaaagcaacagaccaggttaaaaaggaattagcatttccagtgagaagggcagcatttcaaaagcactctgggaggcaggataaggatcaaaattctaaggtggatttaatttcaaggtaatcatagtaatatcccaggtactgagttcacaaaaatttacaagccaagccattttataactgacagcaggacatgaagagctatcctccgtgataagaaacgcagtaccctgacactgattttactctgaaaatattggtgaaagcgattgcctctcttgacagttcagggaacaagcagagggataagtctgtcactaggagggcatcgtatcttcaaaacctcttgcctgacattctatcaatctcatcatgatagcaatcaatggaattaaatgctgctctatgtacccagcttcctatgaaccactcagattttaacacctagttgtcgcaatgtactttcaaaggaaatgaatgggaacatcacgttgtaagaatttctaatagaaacttggttgcttaccactaagttgacacacggaaaaaatcaatagccccccaggtctccagaacccccattagaaaatgttattaacttgatctgtataagacagccaactgggcacctaccacacacaaatcgtattacatgcattgttcttaagccttacaacaattcttcagctctggtaaaatcagcacctctctaggacaagcaaacatgggatggagcttaaataatttacccaaattaaacaattaatagcctgggtatatgtagcttcaaagaaccatcaacatgctgaattgtcaattcagctttaaaaacagtctacattctgtttagaaattgaaagtggcaagtttcaattaattcagaaatgtggcatatatcatatttctgacattttctcatcaatcataagactacatcgtttttccttcctgaaccttctatagaatataaattgtcttaaaatataaagctaccaaaagaaaagaaaagcaaatagatataggcaatgtttaaaatatattttttttttgtggaaattggacactccaaatccctttggtgtgagttgagagtaataacgtcttcttcaatcctaaatatatttaaatttttaagtggcctaaagttagtatgcagtttagacacagcagatatattaccagaagctggctattctgtagaatttgctctctggaccaagcatcctacataaaacactcaaaagcaagctcccaggaatgggaacggccccagagtgtcactaatgcatcattgcctgtgtttattctagggcaatgtgtgatcctacaagtattagtaaataatttttccaaggtaccttcccgatcgatattttacactatttgcccggatgcaaaataaaagatctggcttcaaagccaaaattgtcacttcctagctgtatccccttcaataagttacttaccctcattcagtttcccttcctgtaaaacacacttcctagtatttgcagcagacgacgctggttatgtatgtaacaacctgtattctcctttgctttcttatttacccaatcatcattttctttggagaggtaaagtgctagtaattcacattcctaatattcctttcatctaatggtgtccaggggataagatctttgtcaatgagtctatgttgttgggtgcagccctctggagggtggggctatatccttttctggttgcctctccctactcagaatgtggctgggctgcagttgtcgtatgcatgccgggtcagtgccacgctgcaaagaaagcccagaaaatgccagaaggagcccagaacccagaagaagacaacatatgagccctcggatgtctctctccacgtttttataacacaaaaaaataaaattttaatataaaacactattatttttattttccactactcagaaccaaatgttaattggctcctaattggtacagggcgctgatagggaattataatgggagaaatcagctaatctgacatcatattcatttcttatttttaaaggcactcgtgccctttcaaaaagccattctaaaaggttacatagtgtatgatttcgtttgtataacattcttgaaatgacaaaattatagggatgggaactagattagaggttgctaaagattacagtctgtgtgggcgagggtgggatgtcactatgaaaaggtttcccaggggaggtctgcctggtgagggagctgggtggtatctcgattgtggccatggtcacaagaattgatacctgtgataaaatcgcacagaactctatacacacacacacacacgggcatctaagagtccatgaatctggtgaaatctcaaaccaggtctgcagctcatccccttgccaatttgctggctctgcttttggcttagagcaatgtgacccttaccactggtgggaggggtgggtgaaacgaagacaggacttctctgtactgttttattcaaccctttggatctgtaagtatttcaaaataaagttacaaaacatcctgtttaataacagtagatgtgcatctcttaacagagagatacatttagaaacaggtttctcagcctcagcaccacggacattacaggctggctaagtcttggttgtagggcagttctgtgcaggtcagtttatctggcagattctgtggcctccgcccaccacacgccagtcgtacttctccctgggtttctgacaaccaaaactgtctccagccattgccatttgtcccctgggtggcaaaatccaaaccacccccatataagaaccactgatacagggggaaatgaggaatactggaaagtgattctttattttacaaagggagctgacatagaattattttgcatggttaactcccctggtagaatcaaagtttgattttgttgcacaaatattaagtactgcattttgaattatgtgttgtggaaagggatagacacatctcaaatcaccaggttcttgtatgccactgaggtgttttgctaatagctcagtgccaaaattcttcccctctctatttataccaaaggaaaggtgacaggcacaagagaatacaaatatctaagagcacttgtcttagcactcgtgggggaaggaggatggctctgtatgcaagtctagccatgcctgcttctatgccttgcttcagcttccaaaccttgaggaagaagacatttccttaggaaccctgtgggctcttcttcctgataatcacatctcatttccataaaattaatcaaacaaagtgttttggttcagtaaactgtatacaacacacaatttgaatttcaaaatacaaatttatattaactgactaattaaatgtcttgaaattcttcttgatttctgggacatggtggctgcacctcacacaaaaatgtcagtgcatatggaaaagcttgagggattggaatagtgaatgttccaattgctgagactattaatttcctgcaaaactgaaggttgacagacagaaaacacctggataaaattattactggaaatagttctccatttaaacataagaatgccaactaaatgagttttaatactctgtatgtattataactgtgcatttcatttgcatttatctgcaaaaatatgataaataatataatccttagataattacatgccagtgaaaagtatgacagttgatatacatttatactgacatattttcagaagcccaaaatattatcaatctcaacagagctttcgaacaaggctcactttagtacaagctgtaacacagacactttcaacagaatataccgacttctttgaaaagtgaactaatcattatttcattaaaatatccaattgtgtagtaaagacaatacatacgctactgatttaggtcctactgtttgaatcagactaccaaagtcaagagttgtgttattaaaatgcaaaatgccagtagctcatatttcaatgcaagttcttttccatgatttttttgcattaatttgaagaatgcaaaataagcagctttgaagttgcacatggccaacacacttaagtgtactaaatcaattcaagaaagagtaactccctcttaaaataattgactatattgaaggagatggggggttgatacatgaggaattcagcaggaatttttgtaagacagaatcataaatttgggttaaaggaagaaattgggattatgtgactctggctctaatcatatagaggagaaattttaatgccagattatttaactaccttttccaagaccacacaatggaagagtagaatcacaggaatgcgatgcacatcttctgacgcctagttcgtgatttgtcaaaagtatagtgtttgctttgaggaagagtatcagcttctcagaagagcttactaagcaactcatatgtacaaatacatcttgggagatatatctgttgttttactcacaggaaacggaatttagccatgcaaaatgcatcaacatacttcgtttcctcttctgagcaatccctcctggaattttcccactctcagtgatctgtaagcctacattttcttggacaataaattaattatagcaagagagaagcagggcaagctgcttatggaaagccgaggcctttctagtcatagaatcaacatttgtaaatatatacacaataaatttgcccacgaaatgatgtgccatatgtcatttttgtttccccatgacaatttaattttatcagtgatagaagaatgagccgtgagtatacatgctaaatgctcagtctatgaccattttcataatccatgacactaaaggtttcaattttattgatcttttcaaaaagcaacttggtttaagttcattttctctgttgttttctctattcatctctcctccaatctttattaattccttctttctgcaagcttcagatttagtttgctctttttttatagctctttaaaatatattaggttgttgattcaatatcttatattttaatgtgatggtttacagctacaaatgtccctcttggccctgttttggctgcatcctgtaagttttggtatgttgtaatttcattttcatttgtctcaaggaagtttccaatttcccttgtgattttttcttcgatctaatgattgtttaggtgtgttgtttaacttccacatatttgtaaatttcctagctttccttctgctattaaactaataaaagcaaaatgtacagtgaatcttttcgttttgttttgtttttgttttgaggtggagtcttgctctgttccccaagctggaatgcaggggtgtgagctaggctcacagcaacctctgccttctgggttcaagtgattctcctgcctcagcttctcaagtagctaggattacaagtattacaggcacccgccaccacagccagctaatttttgtatttttagtagagacagtttcaccatgttggccaggctggtctcaaattcctgacctcaggtgattctcctgccttggcctcccaaagtgctactattacaggcatgagccaccatgcctgccctgctgcagtgaatcttgacgcctctcctttttcctatttttttttttaagatggagtctcattctgtcatccagactggaatgcagtggtacgatctcactgcaacctccacctcccaggttcaagcgattctcctgcctcagcttcctgagtagctgggactgcaggcacacaccaccatgcccagctaatttttttttttttgtatttgtagtagagaaggggttttgccatgttggccaggctgatctcaaactcctgacctcaggtgacctgcccacctaggcctcccaaagtgctgggattacaggtgtgagccaccacacctggcccatactactttaagaaaataagcataatttctggagattcacctaatttaaaacaacctaaaataacttttcaggtccctcccatttcctctggcttttattcaccatggatattaattattattatttgttgttgtgtgagtactagtaatcaaaacctttaactaaaatcttttttagcccctatccgacttatgcggcatttgctcagatgtgttttcattatagaatctggaattataaaacacaatagtaacattattctatatgtgataaacatcacccctcaaaaaatcaaatataaaaggtgatcctgtcattgtgagattattgaaatgccccagggtagcataaagaagaaggcagtgagagggaggcagccagaagttctgggagccctgccatgcagtccaggttccatctgtggtctggccccgtgggaggctggtccactccaggttatgtgttagcataggtgcaatacaggaagtagaacaaaaactatttatgcagataatgagggcaaagagtcctcagcagaacttcccttgtaacacaaaaaaaccccaagaaatcacttcttttctaacaaagagcagcctggaagatcgggctgcaaacatagataagcaagctagaagcttacacagggggatgccagcagttgcacagagagaaacggctacgtggggccaggccggtccaccatggggccccacctctcccctaatcagcacatgcacagtaagaaagaaatgagcaacatgcagtagcttaggctgaggacccacctgcaaaataaaagactggaatgggggatcccacagattcatgccctatgcagatggcacacctggtcctaaacagtttttcatgccctgtctagatcagatactgcctcatgattagctcgtctatgaaagcccctacattccactttgagatggcaacattttttttctgggactcctctctggagtagaaaggtgttcgctttgtttctcctatgaaatttctgctctaaacctcacccttagtatgtccgtgtccttgatttccttgggtgtgagaccaagaactctaggtgtcaagccagacaatgaggccacttcacatgattctgcatggtgtcactggctggctcttctgggacatcagccagggttttaagaatctcctggctattggcacacattttcacaccaatctgtgtgtgtatgagcgagtggtgaggatggtgagctagaagaaagatggacttgtggcaactctcctcctccttcctaaaacagctgtgtctgacatttccttgcctggtttttacctctcctccatatcccaaccttcccctcagatgatcaggactttagatcaccttatttgagaaatggacgtaggttcaacacaggatttgatgagtgattgcattcatgccgtttggtgttattgtagatttactacgccaaaattttacattctattactctgaaactgatctgcaattataattataaaaaataatattctcatccttattccaaacaatttgcttaaaataacactttcagtatgtcatatctattgatcaatatatagacaacataataatggtgaagactgtaaacttcttgacatataatctatatctgattcacatttgaagtcattaaagcacacagcacaatgacctacagaaaatataatttcacactgagatctattttttaatcaatagtaaatcattactaaatataaaccatgacatagcacatatactttcaaagtattatcatgtagagtctcatacaatcacctcattttatacattcccttctactcataacaaattaagtgaataatgtgttttaagggcaaagatgtctaaaatactttgagataaacagctcgtaattcatccaatgtacctttccatcaccatcttggcatgaaggaaaagcatgaaaggacttatttttgcagaggaagaaatttaaagatcaaattctgtgccaaaaattgtacacaaagaaagagcaccctaaaaccagatgcctattttctgtatttcattatttttattgataaggatagattacatgacatctacctcttacaaatgtttaaatgcccaatataatataattaactataaaccgagattgtacagcagatctctagaacttattcatcttacataagagaactttatactccttgaacagtgactcctcatttccccctccctgataacagtggtttgactctgtcagcgtctatgagtttaactcctttagattcctcatgtaagtggaatcatgaagtatttgtcctgtgagcagcttacttcacttagcatcatgtgattcaaagacatctctcactactatgtctataaagcaggttcacacactgctgttgaatgagaatctcagggaagcccttgcttccctgaatccactcatctgcatctggaatctcccagaggctctgggaggcccatgagcttcactccactaacacttatttcaccacacgtgcctccaccgtgatgtatcatcctggaactcagtactaagctccaaggtgcttgaggcatctcttttactttccttactcttgtaactatcacaaaacctggaaaacatgaaagttcactttttttctcccaagtagctgtacagttagagatcttagtctgtaggtatctacaatcgaaatctttcagatgtatcagctcgtcattcaccaagaatccctttggtccaccaatcacatgaactctctaaggataagagggcacatgaaacaaaattttgttttggcaatatttatattttaaatctacttttgcggaagaagaatattctatgaataaaagtcattgcttgaagttactagttttgacttcctttgaaatgattgttttagtatctgaggctatgagagcccatattccccgctctcactcatatgcactgtgaaataacaaatacccttgaagtaattccatctcttggtgtttcatcacttactcactcctgcaatgccacgccctttgcctaggtagtccagaagatctgcattcaattatctaactcacttattaatctttcttttgaaaatttattaatttccttcatctttaccttgatgtaagctccttggagacctgttttccacactcctctcagttctctttaaatgccgtgttcaggattgctttgtagactcagtttaatgcctcttgatcttctctcctttgttttgggcaaagtgcctatcagcatgtgaggatcacacttatgacaccctctctcatgctcagcgataagtagatatttttggctttctcaattacaaaaaaaaaaaaaaaaagaaaaacttttcaaaaattagtgtacaatcatttactttcagtgactgatctaaaagttgtgtttcctaagggcttttctgctagatgtcagttggtatcttgggaatgccatttccatagccaaacaattttagaaaaccattgtgtacatcctttttcattcttctagtcccagagcctttaagcaacaactgcataagcatccaggttgagcatatggcatcttaaagctaagattactttatttccttgttacaaatttctcacacaacattttctttgggtcacattttgggaaacgttgctcttttgcctagatgtattcatcaaccatctgggagctacttggtacaaatggtttagtccagaattcaagtaaaagatagccagggttactgtaagacatgtatttacttatttatttatttattgacagcatctggctttgtcgcccaggctggagtgcagtggtgcaatcagaactcaccgtagcattcaactcctgggcttaagccagtctcctgcctcagcctactgagtagttgggactacagggtgtaccaacatagtcagctaatattttttttttttaatttatatagagacagggtctcaccatggtgcccatgctggtctcaaactcctggcctgaaatgatccttctgtttcagcctcccaagctctaggattacaggcatgagccaccgcacccagccactgtgggaagctaatgacagacgacactgaaatagttattcaagcttttggccgtactttctatctttctatataccatgctgagtcactataggaagaacctgagtccagaggacagaaatggaaataaaagtgtgaaccctgacacctgcagcctgacctcaaggggtcttccctccggttccatccacattgctgcaaaagcctccatgttctcacttataagtgggagctaaatatgtatgcacatggacatagagtgtgacctgtaagaccacggagacttggaagggggctggtgggtaggaagaagaaggatgagaaattacttaatgagaaataacttaatgggtataatgtaccttattcaagtaacagataccctaaaagctctgtcttaaccactacaaaatctatgcatgtaacaaaattgcacttgtacccctcattgcttttttgttaatccaagtaaacttgattttaaccttcaattatgtagtgcttggcagttcacaccttcccacatgctttgaaaattcccaagggctggattccttgcagtttcctctcccaccagtttttgtatatgaagtgtggtatttggccctgttgtaggtagaactctaggctggccactaagcttccccctcctggtggatgctgcttcaaggctagcaggagaagcccccaccagtcggttacagttatatgacagagggccatccagggagggactctcccagcaacttgaaacaaaaagtgacctcctcaagccagcgaccacgctgtcatagtcacaggtcctggccatacacaagtagagatgtccccaagtagctgataaatattatcattgtttttatgataccaagctgtgatatccggatcatcaactgtcattacataggagagcacggggctttcagcagacgtatccagagcactgtaggtttgcttttcaagactcgaagcatcaatattaatttataaatgagctgagttaataagtttgtgtgtatgacagcaacttgtacttaaactaattattttacaacatatttaaaatggcagcctgtggcttcaattaatgttaacacttaagtgagggtgtcagaattccatgaccattgattctactacgtgcaactgtagaggaagaatgggcttagagtcagaaagcaggttcaccaatgggctgagtgaagttgggccaggtttcctctttgattaatggggattatgttttttcctctccagggtatcttcgaggattggcctccatgagaaggatgagcctggttcctggtagaaattcagtacttggtagtcactgtctccatcatgaatagtgtgaacagaaacggtaattcagaagtgtgagctgtcactaccatctagtggcagtggtcagaagtgtaggcacagagcaataggatctgtgccctcagagcagcctccctcctccggtcttgcaggtggcaggagccccaatacccaaaagtgtccattgtgtggaagggactaagtcatctcttcagcaccgggaatgctgttaggtttgtgccatccttgggtgttcggtcccacggtccgtgttctgtggctcagataagaatcccaggtagagaaaattaaatctagtttagaaggatttattgtacgattgccctagtcgtcagtagagtcagtatttactgggagctttcacatgcaacattgtgcaacaataggtcaaactctttttttcttttctttcttttcttttttttgagatggagtctttctctgttgccgggctggagtgcagtggcactatctcagctcactgccacctccgcctcctgggttccagcaattcccctgcctcagcctcccaagtagctgggactacaggtgcccgccaccacgcccagctaatttgttgtattttaagagacaggtttcaccatgttggccaagatagtcagtctcgatctcctgaccttgtgatccacctgccttggcctcccaaagtgctgggattacaggcatgagccatcatgcccggcccgcaaactcttgcttatatgactcatattcctatcacctgtatgagtttttattgttgtttagtgtactttttttatacatcataagttatcatgcaacagacacaaatactacacctgttgcattccaaaaattgatatgttagctaattgtaacataataaaatatgtaaagtgatttcctcaggaatttaagacattggttcataaatgtttggacaaaccccctaaaagaatccttcttttaaacattaatatttgcatgtttgttttagatagctctattattctgataatgtaatgatggaaattgtgtttcctttaatgaaatttatgtagcatcatttatttcaggcaaattacatatattcatttacaatactttgtatttgcaaaaatcatatatcacttcatacattatcaagaatcaaaagtttttaactattttatttaggacagtaaaacaagaacacttcaccaattaaagagtctcatccatagcacttggcacaaacttggtcaaatgttacagacacaataaatacttctaaattaattcaggagcctcttctcccatatttcattgttgatgttccttttacttctcttggatagagaataatgagtgtttctcctattaaagttgtttattcactcagggtatcgtttattcttctatttatcatatcctcattagagaaagggctttcctacaagactgtggtaaacccttttatgctagatgtgcagaacctgatggtcaatgacccgatcctatgcacagagtttttaaaagagtgtttcaagtttataaaccaaacgattgcacatggacttctagatttacatctttacttgaaaaattacatgacggatcaactacaccttgcatttcattcccactagcaccatcagctggaactgagtagcaatggcacacctgagatgcctcacctgagatgcttcaccttcagtggtgcacctgatatgcttcacctgagatggtacacgtgcgatgcctcatctgagattatgcaactgacatgcttcacctgggatgatgcacctgggattccacacctgggctggtgcacctgagatgcctcacctaaaatggtgcacttgagatgcctcacctgagatgatgcacctgagatgcctcacctaagatgatacacctgagatgcctcacctgcgatgcctcacctgagatgccccacctgcgatgcctcgcctgcgatgccgcacttgagctggctaacctgagttgcctcccctgtgattgtgtgcccacaaaagtgagccccattccccaccactcaacaaaggtatagagctttcctctttttgttgccagactggccttttcttccttagcaacgtggcatggcctgccatctttgattgccccttttccgtcacgtgcacttgcgattcatcagcagtcacacagctctacatgtatcctactcgggaagccacacttctccacttgcaccaagagcctggtggaaggcaatgtctcctctcacctggagtgctgctgcggtcttcctaagtgttcctagttgttctctgctcccactcttgcttcacctacacaccatgctgcacacagccgccagagcaacgtttgtgagaccccaatgtcatcaaagcatctcccttctagaaatcctgcagcagcatctcattgaagtgaaaataaaatccaaacacattaggacagcctgaaacacccagagatggcctctcctccatcactgagccacgtctcttacagtcttgccccagtccctttccctgcacccgcggatagcagggaccgcttgtctttcccttccacataccaagatgttctggccgcagggctcttgcatttgctgtaatttaggtctggaaggatgttcgcaaggctgcctcatgtgtatcattaatccttcagtcactctctcctgggcggatttagattaaatggttgtcttccccctactgcctacctcccacccccaagccaatcccagctctttctctactcctggttttgccttctgggcaacacctttactataagaagtatatacatattatttgtttccaggctaatgccttcacccattagattatacatcatgatgacagttgggtttatgtgtgttctaatctgcatctccagagcctaaaacacagctacacatgtgcattatattatgaagcccacaaaggttctcattttaaacgtgcaaggaaaagcgtgattcagaagttgtaacacttcgccaagaattgaagcgaaacacagctctgcccctctaaatcccagcaaggctccctcccccatccctcactgttgggtgaccttgtcacccactaagaaccaaatcaagtgtgggataacagtgtttaaaattaaaaacatatcacacattgaaaacaagaatctctagccctttctttatgataaaaaaaaaaaaaaacacaagaaagaaaatgcctacaaaaaaggaaagaaaactctagacgtgttaaggtgccgtggaaaatctggtggataattttgttcgaccaaacgaacttagaaaacggcttccctttgaatttagacacaattgcttcatggatagaccataacttctctgtttcccataaattgtagctagtttgagaaacagtcttctaaagcctgcttatatttgcatctccagtaaaacagggctgcttctgttgtgtctgctgctgtgtgcaccacactgcaatctctgattggctcataaataggcttctctgtgattctagttgcttgtagacttgtttacggtcacagtttcaatacttggaaattaaactgaactgagtgtaacacagtgacagtttagtcttgaaaaaaaaccttattccaatgttttaggcttattaaacaatgaattttaaccagcacttcctgattcaacttacttgcaaaacaacctcctcatttggcaaacagagttgaataggtgataactcttcttagaaatacctggaaatcttgcatcacaacagtgccctatacagaatctcctttaaaatcaagtacagctcaaggtggattcaagacttaaatgtaaaacccaaaactataaaaaccctagaataaaatcaaggcaatactattcaggacatagtcacgggcaacgaattcatgacaaaaatgtcaaaagcaattacaacaaaagtaaaaactgacaaatgggatctaattaaagtaaagagcttctgcacgacaaaagaaactatcatctgagtgaacagacaacctacagaatgggagaaaatttttgcaatctatccatctgacaaagggctaatatccagaatctacaaggaactcaaacaaatttacaagaaaaaaaacaaacaatcccattaaaaagtgagcaaaagacatgaacagacacttctcaaaagaagacatccatgcagtcaacaaacatgaaaaaaagctcaacatcactgataagtaaagaagtgcaaatcaaaaccacaatgagatcatttcatgccagtcagatcacaattattaaaaagtcaagaaacaacagatgccggcgaggctgtggagaaacagaaactcttttacactgttggtgggaatgtaacttagttcaaccattgtggaggacagtgtggtgattcctcaaagatctagaaccagaaataccatttgacccagcaatcccattactgggtatatacccaaaggaatataaatcactctattataaagatacatgcacatgtatgttcactgcagcactattcacaacagcaaagacatggaatcaacccaaatgtccatcaatgacagactggataaagaaaatgtggtagatatacaccatggaatgctatgcagccataagaaggaatgagatcacgtgctttgcaggaacatggatgaaactggaagccattaccctcaaagtaatgcaggaacagaaaaccaaatactgcatgttctcacttataagtgggagctgaacaatgagaacacatggacacagggaaaggaacaacatgcactggggcctgttgaggggagctggggagggagagcatcaggatgaatagctaatacgtgtggggcttaatacctaggtgatgggttgataggtgtaacaaaccaccatggttcatgtttaccgaaataacaaatctgcacctcctgcacatctattctggaactcaaaataaaaattaaaaaaatatgagaataaattaaatatatataataaaaaataaaataaaaataaaatactctaaaaatgggtcatgatttttacaggtagacgttcttcactaatcaaattaatcaaaatattttatttggacaccctataattagtactagttcagaaaattcatttttctttatcaacaattaaaaattataaaatattatataaatatatataaacaaaataatatcaactacagctgttctttttaaaaaacaaaaaatttgtgctgggcatgatggcttgcacctgcaattccaacactttgatgttaggagttcgagaccagcctggccaaaatggcaaaaccccatctctactcaaaatacaaacattagctgggcgtggtggcttgtacacccaggaggtggaggttggagtgagcctagatggagccactgctctccagtctcggcaacagggactccatttcgaaaaaaaggaaaaaatatttgttgttaattatctacttccacctatgtgcacccgtattatttattttactgtgctctatagtctttaaaaaattcaacagagactcttttatttcctatggaaatccctttaaagttacattattacaaaatacttcaaaactaagagtcttgcttgaccttaatattgatacttacctcttattaatcaatgactatttgtgacatactgtcataaattctttactcttttatgtcatctgaagatggttcattcattcagatggttcattcagaatcttcaatcattcagatggttcattcagaatcttcaattctgaagataggtaattagttattttattttacaaatatattttagcacctaccctgttccagataccgttctacgattggatgtgcgttagggaatgaaactgacagtctctgaccttgctttctttctcaggcagggaaaaagcaataaatcagtgactacatcctgtgtcagatgctggcagggactgggaaggaacacggaacagggttatagacaggaaagagcgtacgtgctgtgagcaggcctggcctccttgaattctatgctgtatggagatacataggaggtaacacaggacagttcagatgtgtttctccccctattcttgctcaaatgtctcaagaataactgtcaaatgtgctggggatgctgtaggttgaggtaagaaggagctgaatggaacagcttggactctcttccagtctttccccaggacaggatatccttcgatgctttagctaagcaagatccataaccctggggtacaaagcccagggagagctgctttcccgtgtccctcagctacggtgcaagtggggctcatgcggtggagacaccgtcctccccaggcagctctcctgagacttgggggacccgctggcagtgaatatggggctcctcttcctccctgctgcccatctgtgagtaaaatcccacttcatggcacctgctgtttgtgggtgtgttctgtctcgctgggctcagacaagttgacaaccagtgcaaagggaacctgcttcatgcatcgtgagcaaatctgtgcatcctgaaggatgatcccagacagagagaaggacaaaagtcaataccctgagacccaggcatgcttgatgcttttgagaaactggtaagtcttagcagcaagggaggtgggagaagcccaggatgtgacgtagagcagaggtgaggcatgttttacagaggacatcggagaacattattagaataatttatgtttttagggagtgaggtgaaaagtcactggggattttgagcaaactagagatataaactgacttttgaaaataatcactcgtttctgtgttgagaacagaatgaacaggggcaagtgcagaagggcagaaatgagttaggagagatttgcaataatctaggcaagcagtgatgattgccgagactggcaattaactgtggaaatgggaggatggctggatccccaacatgatggaaaatgaacagagtgtatgggtctgctgatgaatgtggggtatgagaacaaaagaaggattaaatataagtataataattttcagcctaaataactgaaaaaaaaaaagaattgccattttctaagaagaaaagagtgtgagaggaacaggttttgtagaggagacccagagtttgcttttagacatgctgtgtttgagatgtctgttggacacttagtggagatgtcatgtggacaattcactgtttgcagtctgagttcagagtctgaataggaacattttggtagaggttagcagatggattgtatttgaagctgcaggatcagagtcaggacagatgaagaaaatgaggatgtggaggaccctgagaactccagtgtttacaggaagagacaggaagtggccaaagcaaagcaactgagaaagcagaaagagtcagataggaaggggatcaagaagcagagtctaagtaggtaataaaacagtcttccacaggtgaagtgtccagtgctaaccacaggccaaggtgtgagaggtgtttgaaccagagcgactccatcttgagtgagggcttggtaaaacgagcctgggacgtgctgggctgcatccctagaaagttatgtattcctagcctctagaggttcatggttaagggaagagattgataacgtttactaaacagacccaaaattaaaagtgccccgacatcctgataccttgaaaaaagagcgttcttaattttgctttaaagaaaataatatagattcttgcaaaatatagtaattcagaaaattaatcctttatcacaaacccttgtagcaaagaacatctcccctgatcttttttcatcctatatacgaacaagcattttacctgggatggaggcgttctttctcttactctcgggaacgccttactctgtccatggagtagcttgctctttcccagttgacgttctgaataaacttgcctttgcttttgcactgtggactcgccctgaattgtttcttgcatgagatccaagaaccctctcttagggtctggattgggatccctttccagtaacaaaggcgggggccctgggaacggaccgtccaatctgacagcttggccaccactgcagacttgcctggagctattcagtgggcaggagccacagaagcttgactagacggggttcagggagaccaggatgctgggtggagacagggaatggagccaaatcttagaaatgttgtttgcttttctctaatgagaaaagatatgaagacaagcaggagatgacaagacacgtgctagtccaagatgccttacagctatagtaagtaaaatgtcaatatggttatttctatgaattaataccaacttaatgtttaatctgaaagtatcttaaatatcttagatctcttctttctcatgtgtcaacttgatccttcatttttgttccttttatgaaatttctctcagggaaatttatcaggacagtataaagttaatttcaaatatggtatttcctgaatacaaacttttccatgaccttaacaaagtataaaacctaggacaggtatcaaagcagatcgtctctctctttctccgtcattacttgcaatctattacagtaaaggactctacacttagcaaagagcaggaggtagaatattgtttccatgtgtctgtctatatgtgtatatatgtatgtgtctatgaacttttctgatttaaagaaggacatggtcttcatgattttcaaagttgcttttatccctagaattctctatagtactacataaactggtagctttattccaatacttaacatattcttctacaaaacagctgtaaaacataaacagccattgtgatgtctgatggtccaaggtggccatttctgaaaagcaggtgcaaaacagaaggtaaattttccaggcctaggtctacagacaattttgaagaggtgagtgataaagaatcatactgttcggtataatttcaccactctaatgtgatgtagactacaaatgaatcctgtctttaccatgaaggctacttatcatgggctctccactgccgtaacccaagttgagcaattcaggtgcatcatcagcggtggacaacttacagacactgcctttggcaaaattgaggacacttaactgcgaatcacagccatttgacaagtaatggtgctgattattttaaagggctactggaatctcaaatacagataagcttttgttaaaaaaatagtcacattctgtgaaaaggctcaggaagcaagttatttagtagcagagtctattggccacaaaaagcaaagtcaagcagttggtgcaaacttagtgatgtagcaataaaattatagtgaatgcatagtggggaatgctaggacagggtgcagtgggagaaactggaaaggtttagctcctaagccaaacaattagtcaacatattgatgagtcacatgacactgagaaagatttctctaataaaccaaaatgcagtttctccatcaagttgacatttaacagcccttgctaacaaatgtaaatagcagtaaaatccaagaaaatatgttttgctgtgcataggtgtctcaactaagcaaaggtcatcatgtatttgtttgtcttcatatatggaaaaaaacacttcatcttagagaaattgtgtaaggttctatgcagatagtgccctcaatggctggccacgtgaatttttcctctattattaaaaaaaaaatcccagtactttgggaggccaaggtggggggatcatgaggtcaggagatcgagaccatcttggcaaacatgatgaaatccccatctctactaaaaatacaaaaaattagctgggtttggtggcatattcctgtagtcccagctacttgggaggctgaggcaggagaatctcttgaaccagggagtcggagcttgtggtgagtcaagatcctgccaccgcactccagcctggtgacagagtgagactccaaaaaaaaagaaaaaaaaaaatcctgatactgtcaccatacattgttctcctcacagtactgagcaattgtcaaaagttttgaataatactgcaaaatgattaacattataaaacaaaaaaaaattactcatcaatgggtaaagattgtataaacagctggacaaatcttcaatcaatgtaggaattactgaagataaaaggagctgcagaaatcagcctgcacagttgtgtttcatgacatgaactttttgaacaggattctgcagctccctgaagaacatcatttacttccagtgatgttattactgaaatgaaagggaaggtgaaatattggaaaaacgatgttgcaagggaaactgtgaaaatgtttccactgctgcttgagtttagatggagggaggatatcagaggtcttgagctgttttgaaaacctcctggaagaagggaagagcaaaactgaacagcgtctcccctcctgtccacagatgtggggctggtcagggccccttctctgaatctgctgtttagctggagacctgacttagacagcaggaccaataacgtgggctacaggttggccaaccctcatgctgccattcacacaggctcctggacaagctctgggcttggcaaagatgaataccttgtcttacacaagaaaacagggccacatggctttgacttcggccttaaataagtgagcaagcctcttcttgtgttatgagcaccaagaacaaagacagaaagtcatactcgacaagaaaatgaaatgaatgtgtgcttatttcagtttctaagtgagaatgtaaaatttgtacggtcgaaaaatatcaaaaccatttagtttccacactgaagaggtaaaactgattcagtttttaaaacactacttcttgtacatatacagatgtataaacggatcagtaggtcaatgattgtccgtaatgttttccaacttctgagcatatatttatgcctgatcacgtctctcaaataagaaaatatttttccaaagtctcatacaaaattgagttttaggctttatttttatttacattgctttactatttaaatattaagtttactattttgtattgttaataaagtgggtttgtaagtaatattaatttaaatatactacaacctttctttggagttaaatctactaagcctacctatatgaaaaacaatagatcttattttggcttgagctagttatctaatagaaatgtgttgtgtttttcttgttgctctttaagatttatgaaaagaaaataaaatgattaaagacatgcaaacaaagttttttaaaaggaatttcgctaggtcattttttaaaatgtcattttaagaataagaagtactcctaaaattactacatgcaccatgccatatcctgatgtcataaagtagaaatttgcgatacaacttcaacctatttggatatggtaaagaaaaaaataactaaaagaaaggaaatgagtttataaacttcctggagaggggtaaccaccccatgaaagtaggacagtattttgaccaaaataaataggtccaccaaaaaaaataccgtgctcagaagagcactgataattattgctgtatgactctatcggtacatgtaacaatgttatggggggttcctgcaacctaggattcctttgccttcctcaagccacaagggctgatggagccatctcagtgcccagttctgcccttcctcactctctgtagcccttgtctattttaaaatgcttatttaattattattttttatttccataggtaattggggaacaggtggtatttggttacgtgatcgagttcttcagtggtgattcgtgagattttggtgcacttatcacctgagcagtatacactgcacccagtttgtagtcttgtatccctcaaccacttcccaccctttctgcctgagtcctcgaggtctaccctgccactcttatgcctttccatcctcatagcttagctcctgcttggaatgagaacatacgatgtttggttttccattcctgagttacttcacttagaataatagtccccaatctcatccaggttgctatgaatgccattaattcaacccttttcacggctgagtggtattccatcatacacacacacacacacacacacacacacacacacacacacaccatggtttctttttccactcattgattgataggaatttgggttgtttctaaagagtaagcccggccaagttgttttcatgcttaaccaccttctcaggtttctaagccctttcagagcaaagccacccttgctaggagggcaggcagggtgctccctgggctgggtcccgctccctaccccgagtccacatcctccccttctcacctggtggtcacacacactaagttctcgcgtgttcctgtgcctgtcctgtcttaactctgctcttgcagacacccctcccaatatacctgggtttcctcaccctctagccttgtttcaaggaagacctgctcctcgaagccatccctgatatcaaccccacttccctctgctgaagcctccatctcagagccacacattgccatgcagatgcccgcttccatgtttgctttgcttctagattgggtgtctgcaaactacagctcacggtccacatccagtctgtgcctgttttcttggtaaagcctcataagcatggtttctatgttctgaaagggttgtggagaccacaaaggcgaagtgtgccagtgactgtgtgtcctgcaaaatctaaaccatttattatcttgccctttacaggcaagctcaccagcttctgttctaggccaagtggtctcagatagacagatctaggccttattctactctggcctgatgatgggaggctatgctttgaatgtttatggcctttgaggctcacatggaaactcagcccctcatgtcgcagcagtgagagatgggaccattaagaatagcttgggtcgtcagggctctcctttcttggatggataaattcattcatggatgaatggattaatgcattaatttgttaatgaattactggattattgtgagagtgtggctttttaaaaacaggaggagaaacctcagctagcatgatgggagaaatctaggagaaatctagctagcccccttcaacactggacgccgtgtgctgccttgggcctctacagaaagttcccaccagcaagaaggcgatccccagatacagttccttgactttgagttttcagcctccacaactgtaaataatacactccctttctctataaaccacccaatttcaggtattctgttacaagcaacagacagtggagtaacatatgctccaagtgtaacaaatgtaatttgaataaataagtcaacaagcagatttattgaaagaaaattcaggcaattgaaataattaggtatcttggatctagacataaagagttaatatatgtgttgcttatgttttaatgaccaccttcttacatttaactctgatttttcttgtttcatattgaaaatcattctaagtaaaaggcaagaaaaaagaaagcaaagcacagagccgataaaaaagtgtcccattgggatcacccatgcacgtggcctcaaaatctaggagccatgcttcaccttttgatcccgattctcccatatgcagcccatcagcaggcattccaatgtctcttcctttagaatacatcctatgtctcaccacctgtcaccaggccactatggctgccctctcctgttttctccaataattcccacctttttggcatttcttggacacagcaaactcattcctactccagggccttgaccccgcctggaccaatcttcctccttccccatcttcacaacctccaaggcatggctcagcagacagccctcaatataatcttttaaaagttttttaattgacacatggcggctgtgcatatcgatggggtgcacagtaatgtttccatacatataaggtgtagtgattcactcagggtgattagcacatccagcatctcaaacacttatcttatgggtgcatcatccctaagttcctttctctgacctcatcagtctccacccctttgcctagtgctgtttcctttcttactggtttgctttccttagctgctatgacacctgaaatcttgctatttgtttgcttgcctattttccactttgcacctccttgaaaagaagcttcatggccaaccaggcttgcaccacatattcccacatccttcctgggtcacagacaggcacctcgtgaatacttgttggatggaagagtaaatatatgggtaaatagggtgtatgcaatatgcattcccatgttgccaatctctgcttccactcgaaaataggagtatggcatcatgcaaatgtgtctctgcttttctctcatcagatgacaaaccactactcaacttgaagtgaacagtcagacccctttctcaaaactctccagcaatgcattagtcaggatcagcctaaatctaaatgtaattgccactctcaccatgctgtgagagctcatggcagaacaaggtagcagttaagagagtagacttgacctctttgtgattcagttttcttatctttaaaaaggaaacactaatgtagcctatggcatagggcgttcaaagattcagtgagataatgaacataattacttaaagtttctaaagcatgtaaatttctcaagaaatattaactaatatcttgtggcatattttctgtactacaggactgtcatatccaaactctatatcaatatgtgaatgttttgaaagccaacacacactttagagtttgtgagtcattggttttaagcctaagagtagatgcagggggtaaatgctttaggttgcagtaaactggaattaactaatctgcacactgacagctaaggagaaaagaacatattttaccaaatacataacttttattgtgactgtttgataagaccctttacgtccctaaccactgcttctatattggtaaagctctcttttcagaattgtcttctaataaatatgtatatatatatatatatattttttttttttttttttctgaagatacattatgttctttccggtgctcatttaataccaagccagtgtatagtttcttactctatgtaataaagacatgactgatgatgagaaatagtcattgtagtctgtcatatcacttgtatactaaagtccgtgacaagctgcgataatatgatgttctctgtaatgtgatcatgctgagtgtgacatgcagtacctgcatcagtctagacgtggctttagctactgaaagatgaggctgccactgtgtctttaatgtgatcatgctgagtgtggcatgtggtacctgtgtcagtccagacgtggttttagctactgaaagatgaggctgccactgtgggagctgaggactgatagggatctcacagtggcagaaacaggaactcgagaagtttcatagcaaatgtttaaaaaatagagattttgcagatgcatgttctgtattgtgaaaacaaatggtaaaattctttgaacaatgagaggaaaaaatctcctttacatggaggcactttgaattcatcccatcttctaagagaaagaggtgagattttctgcacaaacagagtactgtctgtggaaaagacaacattctgatttagaaaaaagggctgaggaaattacaaaaaagtgtatcgacacagaaagcttgaatactaatctaaatatgcatcatccacatggcatgaaaaaataaggtcagcttattctctttttttttgcatatttctaaattaaagaaaactaaatctccatgacattttgtaagcattacatgctaaaataaacagttcataacaatttgtgtatttttaaaagggattgttgttaggcagttataaagcttcctctgacctgtgataactgcctttctatctcagaaaacattgctaaagagactcaaaagtttttttgaattggattagccaagataaacataaggtggggggcattgtggttatgcaaatataaggtattttaaggaattaagaggactcaagtgtaacgcgtatgctacagagatcctttctgttgcaagagtattcacatcaacattgttcatatactccatttgggtctgaagttttagactacgaaattatctacgtaaagtatgcttttagtttatatgaattttattgacacaagaacagttctgctttttaatacagaagactaagaaccattttcattaattttaaaattgtataatttatattcttttaaattaagttataaaagatttacttgtttaatacaaaagtaaattcttccactttcttgataattaatggagatcggaaatctgttataatttttgataaaacacagagaagatttatatttcagaaatagttcaccacatatttagacctgtcacgtactgtctgtcaattactggtagttttgcagaagaatactgaagagttcaatatattcaagcaataaaatattattcttaaaaccaatcaaccaaccagctaaaaaataaattgtggacaaggagaaaaaaaaaaagaaaggaaagacctactctgaatatctttcatcagtttcaggctgtgctaaatgcaatgtaatatcacttcatggatttatgagaagatacctaggtaggctttcagtaatgtagccatagttcggagctgcaggcacaccgtcagcacacgcttggtgaaatggagacatgagagccaatttcaggaatttttataataatttgagaagtcattaactgccttttttagataaattgtttcatgaaacagacagagtgtgacagacccagctgattcatgatctcatcctatgtctattcagttcctcagtttcttccctactatgaaaaaaatttgaagaagatattcctaagacagctgcgtcaaatcaaccatactgtagaagcaggattgctgccgtggcacagacttggaatatccaacaattacagctctaccttttatcagaacataaaccataactgtgatgtccctcccagcattgctaatgacagtaaaatcttgaaaacaacttgactctttgttaacttgggatagggaaaccaattttagtaggtccatagttacaaatattctgaagacattaaaatatgtgaagtagacatataaattaataaatctagagagatgtttatgttttattaagtgaaaaataggcaaataatttcacagaatatttataatatttgtatcactcttgaaaaggactgaaaacacacatatgccaaacacgtacacatacatatccacaacagtcatatttaaatggtcatgtaaaggcagacttctacgtaatggggcaaaacagaatgtaatttgtacattaggtgatggaattatgggtgaaatttgctttctctaggactgattttatttttcaaaaaaaataagtaaacattatagttttgaaagatgggatgtggatgtgtgtgctcgtagcttatattatgcgttcttcatgactgtatttaatgcatgtctaagctcatgccttttatacaagtgaaacatacacaaaaagaaggtagacaagaagaagtttttaatggatatagccatttaaggcaaaaaagattgtgtttttctttataagaacagtgaaaagacaagctgatgagaaaacacatttggaagtggtagggaatatcttaaatgggtccagaccagttcaacatgaagtcagaagagtgagaaataactacagaagacctgctggctggcgagggctgtgaaccaatttgggattgaggaggaagacaatgaagccccctctgggggtctggggagagcctggagctgggggagcagagaacagggtcacagacaccccacattgaggggaagggagggtggaagggaagcaaggccacataaatgtggaattgagataattggtacccccagctcctgctctgttggaagccatgaagaagctacagcccctctaacaaggcacagcatggccaggccaaagaggatctgagcaggtgggagaaatagcccatgaatggcagcaccttagttttcttgagcttgttagagttttttttctcagcctggctttgttaatcagaatgttgagagcttcagaacttccacagagggtcaatacttcagagcgggggagggagtaaatctacaaagtaagcagaagagatttcaacagtgtgtcaagtgagctgggtctgggcaggccaagagtgctgtgtgaacagccagcaggcagggagccccctgcagtggtgagagtgtcactgaaactcaacagtaacctggcaagcagccacacagggcaagtgggtcaggggtgttaaagagaagcccagacacctgggctcttgtcagaagcaggaaacaccacataagctgaggaggaagggaagaagactgtgcgtgaggagtcctccgccagggaaggctaaggagccaggagagccctcggcaagtgcagccgtaggacccgtgacaggcaaaccctggcaggcgctattaaattatgagcaaaacctaggccagaaaacaagcagaatggggagaaatgtgtctgggaggtgtagggaaagatggacgggagcttttgtgagcagtgcttgtgaaatgtgacagggcatttagctaggagtcatgaagccaatgggatgatttaggcagtatttcaatactgaggctcacagaggttttcattctgttcttgggacacgttcagggtatttctggtgtggtcattgatgatgacagtctgaacgctgtaagaatttagccaaatcatcccacctgctcttcctgatgagggctggtggggtcaggtggccctggcaggtcagaaggtggaggtgaagtgggatgctgacaggtttaaattctatgcactgagccccatttgcaaaaattccacagctgggtgaacttaaacgcttgcttcactgaagcttttgtgtaagtttagctcattttctttaattctacagaacaaacttattttacatataaatttaaagtaaatatggaagtacatgtacacttgaatctgataacttaaatgtgagggtgcataaaaataaaatatgtgtctatcatatttgagttttctgttcatttcccattcatttcattctgtatctctaattttagatagttagatagatgtatggttaggcagacagttgtatggttatagacaaaatcttcggtgccaaaagtttttctatgaaatatacatagtggagcattttaataatactgtttagggttccagaagtcagtcaaatgtgatattaaaacagctcccagaaagcaaatatttgaatagctctggttctcccaatgttaaatgacagactattaaaactggtgatttcaatcccattcaaggacagaacaaatagaatatagaggaatttgacattaacttttcgctctagatgttcttaagtatgtattattccatattccactaactacataagactcctcacaaaacccagcagcacaaaacagaggaactattcagaatcatcaatttcctaagtggattttataaacatgtaacacttaattatgaagacttttgtttgttacagtagaatttaggagggatcctttccatgttttttggtacccattaaccaccctcacctccctacaacccccactacccttcccagcctctgataaacatccttctactatgtccatgagttcaattgattttattagctatctacccacaaagatttttaaaatttataataattaatatatatatatatatatatattcacacacacaaagaatttatgagggatcctgtgggttgagataatttgttcagtccttaagccaaaattatcaaacaaaatacaaacttctttttcacacgcacacacacacacacacacacacacacacacacaccctctctctctttcagaaatggaaaagttcaatatcactctatcattgcctttagggctggtacaaaaacattgtcgtgggggctgcctgtgccacctgttaacgaggataatggtaattgcgtctctctactgtaagcacctttaaatgaaaagtatgacttaacatttaacttctcctctctcaaagctttattagctttcaagcctagctgctcagcctctgatcatagaaagactgccaaaagaggcgaccttggtggatgcccctctcccttcactgccatagggcttaccccctctggacagatctcagcacacttcgtacttcacaggaaagccacaaaaacaatcatcaggtcacaaatgcagttttcaaacacacacataaagcctcacttagagaactgctaagtcaagcagaacccagcacccagtcctttgcagtatcctctttgtaatctgcactttggtggaaactgcagggtaatggcactgtcaaaaaacacagaatggcaagtgcaatggaacacaatacaggcggccaaatccattccaaatattacccacgactgagcttcactgccacaaatatattttgtgtgttacattcagaagacacttctatgaaaataatgttttgtttctctggatatgtattagtacaacatatttggccatttttaggacccaaataatatgtagatttgtgggattcgtggcttggagacagctgtacctatttttaacaaaagacctttaattatggcagaccatcgctgcctctctagtggggtaaaacattccaaacttggccattattactatcatttattcgtgaccatttatgggtcttcactatttgccaaacgctgtgcacaagactggaaattcaaagaggttttagacataggcttccttgaaaagataatttaaacaacatgtctcattatgcaccattaagaaacaaacaaacactctttaaaaagaggcacagtgtttccttttagaggtgagcaagtcctgaattggccccaacagcctctcactgcttgaggctttctttcctctgctttgaggccctatctcctgccttctgcggaaatgcttggagcatggagataatcattttacaattctctccacagtaaaacacatcacagcttcctctacctgtggatactttccccttagtcccctagtaggtgacacaggttttggtttgcctaggacagatagagtctttggttgtttctaggttgattattaatagcattatcaccctttactccaaaggtaacttaagggtaataatgccattggttcagcatttggatcagataataagttatacggtcaactccctaaataaatagtttgttggtttgcaaaaacattgtggaatgtgtgctactactccaatgatgaatggtgcctcagtggtaccctgtgtccactcctccaatgatgaatggtgcctcagaagtaacccgtgtccactcctctgatgatgaatagtgcctcaatagtaccccgtgtcgactcctccaatgatgaatggtgcctcaatggtaccccgtgtccactcctccaatgatgaatggtgcctcaatagcaccccgtgtccactcctccaatgatgaatagtgcctcagtagtaccccgtatcccctcctccaatgacaaatagtgcctcaatagtaccctgtgtccactcctccagtgatgaatggtgcctcaatggaactccgtgttcactcctccaatgatgaatgatgcctcagtagtaccccgtgtccactcctccaatgatgaatggtgcctcagtagtaccccgtgtccacttctccaatgatgaacggtgcctcaatggtaccccgtgtccactcctgcaatgatgaatagtgtctcaatagtaccccatgtccactcctccaatgatgaacggtgcctcaatggtaccccatgtcgactcctccaacgatgaacggtgtctcaatggtaccccgtgtccactcctgcaatgatgaatggtgtctcaatagtaccccgtgtccactcctccaatgatgaatagtgcctcaatagtaccccgtgtccactcctccaatgatgaacggtgtctcaatggtaccccgtgtccactcccgcaatgatgaatagtgcttcagtagtaccccgtgttcactcctccaatgatgaatagtgcctcaatagtaccccgcgtccactcctccaatgatgaatggtgcctcaatagcacctcgtgtccactcctccaatgatgaatggtgtctcagtagtaccccatgttcacctgccgccctgtagttgctcaaggtgtctgaaaaggaaagcgtcctggggcagcaccacgattcgaggtcccagagtagcccagtatgacggcagaattggaatgaaaagataaatgactagaagtgggactgccgtggtggtctggtgacctgtcatgaaagattggtgacatgtaaaggaccatggagaagtgttgaaggatattatgctgaagaataacatcctctgattttaactttgctatcaacgctgttgaaatacaggtgtgtgtaccctgtggcaggaacttccatgagctctcttttagcatatggtatgtgtttgggcaataagtatcaatatttcaaatgtgcaacaacattaccataattccaattcaaagaatttgtcctatggaaataactgcccttggtgtgaacatgaagatcgccatggaatgattgtttgtgatttcaaagactaggcatggtctgaacagaggtttaaaggagtaagctgatgggaagaaatactaagtagccaaaacaaataataaagttcatctgggaatatacgcaacatattgtaacgttgccaagcaacctgtaaatgtgtggaacatcatctaaaatttaaaggcaccgtgaagaagaagaacgaggaggagaaggaagaggaaaaatggaagatgataaaggaaaagaattgggtttttgtgtttataaacacagagatacaagtcttaaaaataagtacccacaattacaatcactgattatcttgagattaaagcatttcaaggtcttcactttctgcttcgtatttgactgtattatatcatgtttaaaataatgatcacatattgattgtattttatacatatatctacatttttgaaaagtacatttcaaatttattgtggaagataaattagaaaatggagagtgaggagagacaaacagctatgagggattaaaacaaaacatatggcaagactactaagaggcccctagagtggacacagtgagaatggaagaggggttgaagacaaaagatattcaagaggtgaaggaattattgctcagctggaggtgacagaggaggaaagccgtgcggaatgaaggtgggttttctggatttcctaacaagatgagtggccagcgtaagggatttagtgtggagggaatttggtgaatgagagacaattgatttttttctggatctgttcactagaaaagacacccagagattccaggacccattcgaacttgtagtgctgggttcagcaaagttgattatataacttatctctgtaaggcacaggaagagcccttgaaataatggaatgcaaagaaattcaaggtccaaagaagaaattatattaatagaaggataatattaacagtagtactgttaattacttagaagcatttccacatgcatcatttctctgagaaacacagaaatgataccattagtgaaggtacctatcattatcatcaccacagttatatggcatatgaggacattgagagtcaagaatttcagtgtcttttctaagatgaaatagctgcaaaatgggcaaagtcaagatgggatcccaggtctgtgaactccagactgattcttctcatgctgtattagtgccctagaagaaacctagaccttgaaagcatgtatttgagaaaaggcagctcctctgagttataaatgactcttaaaatgaatgggagaggaagaaggaatggaaaggctagagaaaagggggaatgagatggcgggatgatataaaaacctagatatttctattgtcttttactgtcttcatggaaaccatgaatttctctcagggtactttttgacataaattagtggaacctaattatcactagcagcctttcaggagaacttttttggctatatatctccttgatttgaccctatcgagctagagaaagcaatttcatttatccttctgtaacacaatggcttagggtaaagggtcttttgtagaatttcatcaccatttactgattgattcttccagttcctatttacttccatgttacagacgcctcacgttgtatttagaatccagattcacagagcatcccaatgggcagtgaaaattacagtgaccactcattatttaacagcaataaaacggcaggcagtgaatacacacatgaaaaaatgcccagcatcactaatcatcaaagaaatacacattagaaccacagtgagatgccacctcacaccagtcagcatggctattattaaaatgtcaaacaataacaaatgttggcaaggatgtgcagaaagcaaatactattggtagcaatgtaaatgagtaagcctctatggaaaacagtatggaagtttctcaaagaactaaaactggaactcccacttcactcagcaattctactactaggtatctactcaaaggaaaggaaatcattctacgaaaaagacacccgcactcctctgttcattatacactattcacaatagcaaagtcatagaatcaacttaagtgtccaacaatggttgatcagataaagaaaatgcggtatctttacaccatggataccacacaatcataaaatgatacatttcttggcaatatggatggaacagaatgtcattatcctaagtaaaataatgcagaaatggaaagtcaaataccacatgttctcgattataaatgggaaccaaacaatgggtacacatggagataaggatggcaacaacagacactggtcactccgaaagtgaggagagaggcaggagagtaaagcttaagaattgcacattgggtaccatgctgatattcaggtgatgggtgtactaccagccccgaccccaccacgatgtagtgtatccatgtgacaaaactggacatatacccgctttaaaaaatttaacaagtaaaattaaaaacagaaaaagaaaaaaaagtagtatctataaagttagtcactgaggaaggagaaatgtatggccctccaggaaggcaggggctagcattcacagacagaggaagccatgcccagaggcttctgcataagcgagggatgcagatgatctcccgtgagctgcgtgtgcctgtgtgcactgcagggcttgccttatctgctacgtcagaaactttgtgaaggaggagtcctgactttacacatcactaccacccatctcataaaacactctgcaggtttagagtaaaaattcggtaccttcttacagatgaacataaccatatgagggaaaagaaaatccaacccacaaaaaaaaaaaaaatccactgtaaataatacagtagtaggtggggaaagatggaaagtgaatgttaaaataatgatgtagaatagagatttgtatcatacttgttaaaggaactctagtggcatggaggccacaaaacatcaactgatgagagagttttagaatctagaaagacttgggaaccctcctttcctctatctgcatcttggtcagtattgctaatgggacacacacacacatgcacacacacacacgtacacacatgcatacacacacatgcacaaacacacatgcacacacacgtgcacatacacatactcacagcatatatatgcacacacacacattaaggttgaacacagatgagtgccacagcaatccaaaatttattttagcctgcttggcaaaatcaaaagttccccacttaaaactctcccttaatatgcttatttttttaactcagtaaaattttatttctagaaatttttctgaaggcaaatatcctggatctgtgaaacaatttatccactgggaatttaaagacactattatagttaataatgaaaaaaaatcacaaagagttacatgttaaacaactgattggttaaaaataataataatacggagcctattggagggtggagggtgggagggggaagaggatcgagaaaaacaactaaggcgcactaggcttatttaccgggtgatgaaataatctgtacaacaaacccccatgacacaagtttaccttttaacaaacctgcacatgtacccatgaacttaaaagttaaaaaaaaaaccaaaccatccatttagtaattatttttaattgcattctattagcccaaaactcttcacaagataatatgaagtcaaagagaaagtagaagcatttagaatgcaatgccattctttgcttggtcatgatctgggtgggaggaattatacagggttgtaatttttcttcattttataaatattttcaagaatttatttcttccccctatttcattgtcctaatgtatttggcactgtgtgactacgttttatttagttgggttttttgtttgttttctaatgtcttccttctaaagtgacatctccgcacaaaccgggattttagtgacttttctcacactccttcccagttatctaaaagtgtgtaatttaaacaattgctgaatataaaaggttttgctttgttgttactcatatcattactattgtatttaagtacgacaaatactaaaaatgagaaaaattgtaaaaaaaagttcaaatgcataaaataggtaacgtattaaaaggtaaaaaaaaaaaaaaaaaaaaaaggaccacatctaagacctgtaaaactaactgagctccaaagaaaataggtatttacacctccctgtatcttaaaccatataaatacacacctcttactcacaaaaaaacaaaacaaaaacacaagtaaaaacattttttaacctggcctggcacagtggctcatacttgtaatcccagcactttgggaggctgaggcgggtggatcatgaggtcaggagttcgagaccagcctggccaatgtagtgaaaccctgtttttagtaaaaatacaaagattagctaggtgtggtggtaggcatctgtaatcacagctactcgggaggctgaagggggagaatttcttgatctcaggaggcggaggttgcagtgagccaagagtatgccatcgcactccagcctaggtgacagaactagactccgtctcaaaaaaacaaaaacagacaaacacaccaacatatttttaaacctatttttcatgaatactaatgttcattcttttgggtacattctgagtatacgatcattaaagttctgtctttttaagctacttttattttgatttgtagttgtatatattttgggggtacacgtgatattttggtacatgtatatgatgcataatgaccaaacagtgtaacaggaatactcatcacttcaaacatgtatctttccttgtgtttggaagattgaaattattttcttctagctattttgaaatatataataaattatcattaactataattttcctactctactattgaatactagaattttttccttttccctaacttaagcaacttttattaagaaaaaaaagaaacggagtaaatcctgtaaacttttctcccaggatgttttttgaatgttttgtcgtcctcagtgtccataaataactcctacacaaacctagacattcattcactcacacctgctaaatagttgcaagtctattgtctacagctgtgctgttattctttacctctgtaacactttacgttgtacactgataagggattagtcttcttagaaatgctggctccacagtatatttgtgtgtgtgtgtgtgtgtgtgtgtgtgtgtgtataatacatgtttgcaagcaaatcaaaagcatggcccttgttctccattttatttctcagctccaagaggaggcagtaaaaataaatctatttagttctgaaagttaagaactgaggtgttataagaaaatcaatccagcagaaagtggagaatgtacgtgcccttgtggcagaaaaaccaaccaaccaaacacacaaaaaacccaaaaaaccacaatcgatcttgaaaggggtgatgacagaggtgtgagagggaagtagtcaccaaaaccaaactcagtttatgaaaaaagttgcaactgttaagcagcagtaacgggtaagtcatagacaatgaaatagctggcacacagagacaaatatgttggagagttgacaaggacacaatcatggatcaacgccataagattaatgatgaatagctaaggaatgctgggcttaatacctaggtgatgggaagcaaagcaccatggcacacatttacctgtgtaacaaacctgcacatcctgcacatggacccctgaacttaaaataaatattgaaaaaaaatactcttacttaactctgtagtgcaagacagcaaaaaaaaaaaaaaaaaaaaaaaaaaaaagagagagatcaagaaagaaagaaagatacatagatagacagatagatagatagagagatagacagatagatagattaatgatgacagccaagatgaactaagggatctgtcaaagcaagttggccaggcgtcctcctttccccagtggcatgggagaaaagtgaacagggcagttggtggagccactgtgtctttgcacggggaaaggtctgattgaataatggggaggctcccttcggtgttataggaaagggtggtgtgtctaatctctacttctccaccaatccgtgaatcgcctccttaataaagtctactgaaccatatctattccaatcacatttcaaaatgtcttaaaccaatatatacaacataggtttctatgttaaccttttaatacttcaaatgcaagtgaatgcctcttcttcatctctctgaatttgttaattcaagttctttaaaaaaaccattgaatcataaaagaagttaaagctccttccctaaaacagatctgataaacatatcaggattttcttgcaagcattaagtttaaagcaaatttttcttatttactagcagttgttcattaagaaacgtgtagtgtaaaaacacaaattgctgtgactaattacataaccctgagatatctctcaaatatattgttttttttttctccccaaatgacatgcaagcatcttgatttaggttcatatcatctttcatagttagaataaggctctagattttcctgcttccagttttgtgccatccgtgatgcggaccaatcttcccaacgtatacgcattctcatgccattcctttcatcaatataatacattgacaccccatttcctttgagaataaaacataaactctttgcctgtcatacgggaccctgtttatatctttctgaccctagtcatttaaaataaacagaaagggaaggaggcggagaagaaggagagggaaaagatggaggagagaaagaggagaggaggcaaacaacaaagagaggagaaaggaaaggggagaaaagacaaggaaaaggaggaggagagggaagaggaaggggatgagaaaaaggaggatgaggaggaagagttgaagaaaagaataacaagaaggtggaggacttagtatttggcaaataatattctaggtgctttaaatcgattacatattcctcacaacaaaatttaaaggtggatagagttaatacaaaaggaaatacgaacggacccaggacatacagccatcccttcactctaggcaccactgtacctagggaccaccgtaccgctcctcctgcacctccaccagcccctcctggtgtgctgtcagtgtgctcagccccggtacacccaacccacctcacctccctttgtccatagaggatgtgaaggtttattgaaaaagaacttagattttcaagaaaaaaaaaccattaaaaagtgggcaaagatatgaacagacacttttcaaaagaatatatacattcagctaagaagcatattaaaaaaaggtcaacatcactgatcattagagacatggaaatcaaaaccacaataagataccatctcacaccagttggaatggctattattaaaaagtcagaatttaacagatgctggtgaggttgtggagaaaaaggaacacttatacactgttggtgagagtgtaaactaggttaacctttgtggaaggcagcgtggtgattcctgacatctaaagacagaaatccatttgcctcagcaatcccattactgggtacatacccaaaagaatataaattgttctatcataaagacacatgcaggtataagttcattgcagcactattgacaatagaaaatacatggagtcaacctaaatgcccatcgatggtagactggataaagaaaattggtacatgtataccatggaatactatgcagccatataaaaagaatgagattttgtcctttgcaggggcatggatgaagccagtatccttagcaaactagcgcagcagcagaaaaccaaatactgcatgttctcacttctaggtgggcaccaaatggtgaaagtacatggacacaaagagggaaacaatggtcactaggaactactggagggtgcagggtgggaggaggcagaggatcagaaaaaacaactgttgggtactgggcttaatacctgggtgatgaatctgtacaacaaaccaccatggcacaagtttacctatataacaaacctgcatgtgtatcccttaacctaaaataaaagttttaaaaataaaataaaaataaaaatataaatgaagacataaaaagtaaataaaaaacaacaaaaggaagaaaggaaggaagggaggggagggggaaggggatgggggaggggaaagagaaagggaaggaaagggaagggaaggaaagggaagggaaaggaaggaaagggagaaagaaaaagcctataatacctatcatctggtatcagctcaaattcccagccttgtttaccgacaatattcccaagcaatgcaactgtacagaaagactggttatttcccctctctgaatttctggaacgtccaaccttcctccacatcctctgagacctctctgcccccttccctcacaccctctgctacttgcctttcttgaacatcctctgcagatccgtcactatttgctgtattaaatgattctgctttctcattatatagttggactccttatcctcatcactctccttcttccttccacacatcatcacacacatgtgttgacatccccatggacgccggagatggaaacccaccaatgactgtgcaggcatccagcatttgtgggaattcatctgatgccttagaaaagttggtactgacagaagccactattagaattacatgtgcttcagagtattgatttacttaatatgtttaaaaataattttataatttccattataaatatataataaaacaaacttataattaaatacttgaaaattcatatgaaagtctttttgagggttataaagtactgatgttcacttgccaaacaaaacaattgttgtggatgtttgagtatttatttccctaatcaaagtttcacatattttgttttactcatcagaacacctgtcagatccatgtgtgctgttgtcaatggcagaatttccttctttttatagctgagtaatatttcattgtgcttgtataatacaccttgagtctgtacagtttttgtcaattatacatcaataaagctggaaacaaagaaaaagaaaactaaacaaagaacaaatcagtaagatgtactaacgttttgagttttttaaatcctcagagtttttaatgagctttaatagcaacaaaagtattgcacaagaagctcaaattagaatcagtagctgaaattatgtcaccacagaatgtatttaaaatgtgtgtgtatatcaatgtatttatctttatatgtatttgagagctatataacagaaacttttaacttagaacacacacctctcattccagctgatatactgtatatgtgtatatataggtgtgtgtgtttatctatgcatatatatatacacatatatatatgtatgcatgcatacatttatacctaaaagatgttagtagaagacaggtcttccatgatatatttaatctttccaatgaagaccctggggataaactttataaaattattcagtagaaggtaggtccttcatgatacatttaaactttccaatgaagaccccagggataaacttttgagagaattttatcttaattactataacacatgtctcacaatatatattactttttcaagaattctgattgcaggactcatcaagagttctgaaaatagctggattgtcaaatgtgtctacaataaaacatatttatacatatcatataatattactttgcattgactttctaccagaataccctggtatgagctgttccaattgtttaaaaatctgcctctccactaaaggaatcttcttgagaggcctttcattttataacttcctgaatagaaaatgctagtttcttctaaaagttttagattttctaacgatagatatttcgtgttccttttgacatgatatagcatgataacatgtgatgtgcattattagggagatgctaagattccgcaagtaattattttgcatgaggagttttacataaatacttgcaataaactgaccatggcagcacttggttatacaacagtcaaagccgagataagactaggaaagagtatgaatcaagagaggattaaatgtttcaaaaaaagagaagtttgtattgactaagagagaattggcgtcggaaactgcttttctgtcctatcttatttcttaaagtttgcagaccaggtcaaacacacaaattgaagtatgcaaattcttcacatccaaaatgcttcactgatgcttctggcaagagtcattgcatggaaactttatgtaactgtttctcttttctcttatgttcaatacgtaatacactttcatcaacgtgcacttaattgagaaacccacttacttggaatgtctcccaaggaatcaaattaagcctaattatacttaatggcaatggctgctgcttaatttggatggtaattctgcttaattgagatgccttcaggtgtctaagtggtgctttgctaagagtattggttgtgcgggtatgtcaacctggaataccttgtttcttctctgaacatttctccgagataaatgacaaagggcaaataattttctgaagcaatataacacaaaataactgaaatttaatgtgttaattattaagtcctcacaatcaagaaaatatatacaatgtctgcataagtgtacacaaagatgagagagaaaaaataaacttctaaaaggagagaagagaattgtataaacccaagctgcctaaattcattactggtcattttatgttttggacaagtttaaaagtccactttaagaaatcaaagaacatacatcatgagttttaatggatgttagccataaaactaaagtaaaaggaagatactgtgattggaatcacatcatatgcaaaagatatactagtgttaattccaacctctttccttggtgtctggcttgcctggatgtgatggatatcactggtcaccatacactaaccgtcggctcctcttcctggcttctagatatttctttccttggctccgtggcaattggaccacaggcatttgacgcaatgggatatgaaggaactcagcagacaaattctaggaaatatgtcttccatctctagccaaacatgcctcatttcattaaacatgaccaaatcgggaactaaagcctcaggtggttgcagacgtcttgagaactgaggggaaatattgtctccgctctagagagggggcaggaaaaatgtcaaacacctgagctgcaatgctatcacggagctactgaatacaacctggaagctccctgactctgcccctttgttatctaaaataaggtatcccccaaactttcggtttttagttggctcttctgttagttacagccaaaaataccctatggaggtagaaaataacctgttctttcatttatttatggtggaaagcaagcaagctaataaagcgttctcacagtgcaatgggacgacaaggagtttcactttccgggatcttgacttcctctctgtcaagtagtaaaaggtttaaacaataggaactctaagcttctttttagatagaatttcaattattctagtatgtgtaggaaaataatagaaactaaaatgtgctataggcacatctttcatatagaataaaaatatttatgattattgatgtataatctggatttaaatgaatttggaaagtggaaactgtgggtattccactccagggcaaaacacttcagtcttttaaaactctgtaatggcacttacaggtggaagatcattctcacgacagctgaggcaaaatttacctccaactgactatgagagaaaaccaacgccatcaacaaggctttcttggactatattctgctttctgcatgctgtcatcctaatttctggtttcctcggctaacaacacacctgtgaattctaaatgtgcctctgcccattccatggacttggatggacagtaggcaccttgctatctctgtgcctaatagcatacacatctcctacataaagaaattggttcctgaagtctgttccctggttaaaggtacggagaacatatattgttctgaactggaaagattttgagaatgcagtagaggcattgttagtaactgttcaaggacagcagagatttaccaagactcctctgcgacagaagcaagaatgctcacctgcctcgagtttgactctcacccacggcgtcatctctctctctcctgtttcccacacccacggcacctactggaggcagctgcagggggaagcctgcaggggtgtgaggtccaagggaatccggtgttctgcgctccccgagctcgggggtcctgtgttcctccctccccatgcttgagggtcttgtgttcctccgtccctgtgctggaaggtctccagtcttgctaagtctccgtctggggcaatttcccctgcaccactccatggtgtctgctctgtttcagaccttatcatctttcatctgaagtactgtattagattccaaactctgcgtctcacgtctccttctggaaaccttttagggtgtacttccgtcctctccaccgaaagggctacaggaagaagtgaagttactgcgtgttcaagttcgtctcctcgtggatccccctaaagcgcagccttcctaaacggtagcccattcatttgacttcaaaagacgcgaaagaaggggatggaaagaaattccacctgtgagtggtatactgagtcggtgtccctgcaggcatttggctccatcctgctagggatggctgcagagctgtgagaattcacctcagagttttctgcccgacccattacaggggcgcattcgagcactccttctccacccaggaagggcggtgggagccccctctcagtccaagtggggctgtgtcaaaaggaggagaagactcctgcaggctttgcaaactctgagggcagagcctggggcagaaagcaggagcttcagggagcagttgagggagggctgaggctctgccactgtgaagcgggctaagagcagggaggtgggcaggagaggggcttggagcaacctcatcacaggcagcagacgcagggagcttcctggagagcccctgattgctgtgtttctcctgcccagcgtttctaattttatgtaatctccactttcacacacttttaaaatttgtgatagattcatgcaattctcataaaactacctggaacatacacaggttaactaaaccattcccttgatttgatctaattaattccttttagctatgttttctttaaaagaaattcaagaagagttccttctgcctctcaaattgcagaagtaacataattctgtattttgaaaatgtcgcaatgggatacttctggtctcgatcacatctcaatccctttaatataaaatatttgcttttatttgagcccctatggaaatgcatgtaatctatttactcttaactcaagtcaacacctaatatagcccccaaacaaactcaattgttcagctatttcctctgtaaagttctactatctaaccttcagaacttttctaaattctcaatatcatatgattttctggagaccaaacagaatattctaattatttaaaagtgtgtaaatgcagaaattagtaaacataattatcaataaactagttatatactatataattttaattcaaattgaaataaaactcttttttgttagacaaattaatgagatggcttagtaaatagttaacaaattgttaataagtgtttttttctatttatcttatgcttgtttctgttacactaccagtattagcagcttataatagataatgatattacatttacttacgcaacatgtggatttatctgtttttcacaactattctctaaggtaaatgctattactatatctctttgcccaaattcatgcaactactaagtggcagagctggttcttaaagtgatgattgcaagtactgaaaaataatagtttcttggtaaaaaactgagtaacaaaccattgagtagcatatagaaaaaacaaggtttgtaccactgtagttgatgtcccagggtacaacacggctctagcatactgagaaataccagaatcaaacttggaggcttttgtcacagcaaagagagcccagaaattcctcagtgtttcagaaagcctgcaacgccctggagttttacccagctctgctcattaaagcttgaatttttacataaataataactgagattttagaactaaaataagccaaccaaaaccaaaggcatctgtgatgaacactttacggaatctaaaatcagaacatttctcttttagaactggcaacccaacagctttgagaggaaactatataaataagatggatattttgacaaaatgtaaaaatgaagagatgatcacttagacacagaactgttagtaataactcaataattggtaaatagtggggttcagtaaatttaatattactataaatataattattttaatattacataatttagtgaaatccatacctataatagtttcctcacagttttttttaagtgaaatcaatatgaagatgtctaccttattttttcttcctactggcaagcatctatattgaacttaaaaggagttaaaaaaattcatttgatagccaatgaaacatgattatgagtatgatttctatcctaagatttaaaatgtagtaacataattgcaaactatgtatgcaaacttacagagaaataacagtattaccctctattactaccctggaggaaatatatattttacacaaagtatttaagaaagaggaaaacacgctcagatgtttaattcttgaaaaacgtatatagcttatgagaagaaacacatgaactgtagaaaacaattcaaaagacagaattgttttttatcttttcttgatatggagtcttgctctgtcgcccaggctggagtgcagtggcacgatcttggcccacttcaagctctgcctcctgggttcaagcgattcctgggcctcagcctctcgaatagctgggatgacaggtgcctgccaccaagcccagctaatttttgttcgtattttttagtagagatggggtttcaccatgttggccagactggttttagaactcctgacctcaagtgatccacccactttggcctcccaaagtgctggcattacaggcttgagcgactgagcccggccaaaagacagtatttttgtgtctgagtatagtaggagcatttctaacacttagtcatactatgcataaatactgtggtatttaagaaagcttgtaatatagtggatgagacctgagttgaaaaagacataagagaaagcactatgatacataaaggaggaatgtagactttctctccagaagcactaaatggcaccacagtgagaatactcactttgcatctgaatctcagactgctctgcaatgaatgtggcatctagacacaggatgcagctggaacttttaaattcaaacagtaaagtgtaagcacggatagcatttgctgggctgtttgcttcaacaatagatcctataagagtgctgtgtgcattaaccacaggggttggaggcggagccttaccttgtccgggtcggtggtggtgatgacccacacacagtgtgcattatcttcatactgaaccggataattaggggaggtaatgacgccgctgggcccacgcagattggatccacatgttctcgctggaaacacatagaaacgacgttattttctacaacattgtgtcagtttggtaaagacataacatttatgggaaatttcaagttagctattatctaatcacagtaaaaaaaaaaaaaaaaatggtgcatggactccaactggggcatggactccagtcagcaagtggattgctcagccggcaggacttttgcttggtatctgcagtgttacgctgggacacttcatttttcccaaaggcctatccactcaccaaaggatctaacagatgacagcctcatgtgcaatgtcaataccaaagtagcccatttcaaatcccagtgtgactcagagtgttcacgtaggtgtcgttgttcagagagtctccatacacacctaattgtgtgcgactgcagtaagatagagggaaaggcaccgccgagtgcaattcaaccagagttaccatctcagctacgtcttacactgtctgacctccaataaattgtgtcttttcaactttaaaaaagggttttggagcagatgatctccaaagtcactttcgagctttagattctattctacaataaactataccaatttctttacagcacaacgcaaataggaacttaaaatttattgcaagtttaaagaaagaaaataggaatggtgactttaaaaataaaaaaaatcttaaagttgaaatgaaagactgagtgaagcatagaaattgcataattctatatatacaacttagtctggaatacaaaaataatttaattggcctccagtttatgaaaggagtttttttttttttaaatcaatacacatattttagaaatataatgtcagcagagactctggttttaacattcataatttaaactgggtttcagaaaggagcagaagaaactaatttcacaagaagaaattaatgtaagagaacttctgcttcattttcctaagacatcctatgacacaaactgacaaaaatttttcataggaaggattaatcctcgtcatagcccatcctctattttttcattccttgagtttaaccctttcttcaagtcagttattattctagcagactcagctacaaaactcagcacaacaggacttgtgacttaacaagggctactttgtggggggacaagaattaaccactgaacgcaggttttccaaagggactcaagaaccagacatttctctcttccatgcatgtcaaaataataataataataataataataataataatacaaatcatggctattcctcataatgcttctttaatctgtaatctactgtgactgttcatctgagatctctcctaaatggttatgcattccctgaccttaggaactgtcctctttctgcatttacctgtccctcctcagcactgtgtaccacgctgcagtcctagacatgtgaaaatgggacaacataatttgagacaactgttcagttgcttcctacttactatggaaataattagctaaaattgacctattctacattgataagtgtgttaaaattaacttttaaaatgctggcatttactgtccaaatgaaaaacaaacatgggtaaaacataactgggtttccgaaactcagtaggtgtgtcattggtctaaaggtcactggacaaaggactggatgaaaacatggacccctcttatacactaatatctcactctctaatgagtctgttttaatgagctgttctcagagaggatcataaactttagatgtgaaatcttaaagccctctaatattagcattatccaactagaaaacctttgaaaaaagtgataataaactctgagttgtaatacctttatgttgcattttcctactttttaacacttcataattaacagctgttataaacatcatgtagcgttcataaatatttgctgatttaattgtgaagcaatgtaaccatattggcattgtcggcctgcatttcaagcttttaaaaagtacatctgaaaaacatctgcaggggaaagtcatttgttacaatcctactgacaaggtgggctcagcctgtcattggcccagatgttcccagccggaaagatccctaaagctggccccgcccatggctttgtgtcctaggtgcctgctgtgaagctggcccctcacttggcttatgaaaattggctaccagcatctcatgaaatgcatctcatgcatcatattttatttgtgaagtaacttttaataaaatatgcataggaagccagcccgtcaccacattttcaggcctatgaagtaccaagtttcacacaaagcaagtcatggacccagttccttcagagacattctttaccaaaagctttcaaattaacccatgtttctttttttaatttagaaatctctgtccgtctttgcaacatattttaataaaaaattgtttattttttgtccatttttttattaagccatcaaaatggtcatctaaaatgaatattgggaatattcagaccagagatttgtgtctgatttgttcatttgtttaactttgccaattagaacaatttttagcatttgattgtttcctcaataaatattagcatagcttctgaataggtgtaacagccttaagtcacataacctaactgtaattatgtaattctaaccctccttcttaggacattgttgaaagcttgtgctactttctcaatgtttgcctttctaaatcttctccaacctaatcatctgcttctttaccatctgatgatgcgccccctatttggctcgttatgatttatttagttattgcctccttgcatctagggttttctactagtcagaatcaccctcagtttttcaaatggcaactaccgtaagttcagccgtgcatgtgtagagaccttattaaacaaccaccctgtggcttgagctgttgtgatttctaccagccgatgtccacacggtggtgaacagagtgtctgttgtcccctagctgtcctgcagctcaccttattacctgggccaggaaagcttacattaatttctctgaatttcatagtggagagagaagagccaacatacagtcctccatctagcacacccactgtcttccctccgtcagcttccagcaccagaagggtataatttctcatgtctaccatatgttacgctttaaaaaattaggtatttggaaaatagaaaaagaagagttagagaagaaaatgggacaggctgagaaagaagagatgacccagggctgagctttgtactgagtagatccaatgagtgagtgtccttgctcagggagctttggtgatgatctgttagggatgcctgctgtcctcccttagaaatcctctagttagacgggaagggcacagcagcctgcgaggcaggaagaataatgggtgtcgagaaaatctcggcagtgcacgcaggcccttgcaaaggaagcggatggctgccattatcttatctaaaaaccatatccgtgttgctttgtcgcctattggggggctgtattgaatacaaatttatctgatgttctgggaggtcacgaaacgatgccataagttctgactcagaaacatagacgtatgaaagtttatcacctgcctctctcttcactcatggactctgctggtttttcacttcatgcaaagaaccgattgggcagctcctcacacaggagacagccgagggaaactgttctgactgggactggacaatttcatagcatccctggaggcagggaaacttctttccttcccttagcttctgtgctaaacaggcattcaattagtcaacgaagtatgtgattaaccagcataattaagtaactacagtataccagtgccaagccagtttttaaaacaagatctctctccgtaagttgccatcgtggatatctgtagacgcacgtttacacaaactatagtagaatgcctctttctactcttgcaaaggccttgcctcttggaaatataacatctaatagagagtaaaattcaccgacatgcttgataaaggtacttggataataactacgacctaatgtacacctgatgttacttgcttggcagttttccagacctgtaaactcaaatttcacttacatcttttctgtctccccagtaaaactagaattcacagaatgataaattgaaaatataaaacgtcaggagggaaagtggaaagggagaagaaaaatgaccaattttggatgccaatgcatgccattttgacatttatccacttaatcaatgaatatttgttaagtataaaataggtttgtttcatgcaatttatcttacttaataaaagtaataacttatctgtttatttaaatgcaattccaggaaatcttatggttctatagtaactactcaattaatcaaattacttgaaagaagaaacattctaattgattaaatttaaattagtgggatttcaggagtcgcattagaagctttttttaaagcaaatttataattacattggatagcctatttctcatatgtttttaggagaaatcatttttatcaagcacaaattttacgtccagattgtgaaccataatgaagataatatatcacagaggctaagaacttcctttccttcaccacacctggttccaggcctggcttaggtagtcagtagctgtctcatcttaacttatttaattttaagccactcagcttatttaattagaataatcataactccacttatgattgctctaaggattgaataaaagaagacaataaagcatttactacatggcctgacatatcacagcaaggccagtgtggtggctcacgcctttaatttcagcattttggaaggctgaggcgggtggattacctgaggtcaggagtttgagaccagcatggccaacatggtgaaaccctgtctctacgaaacatacaaaaattagctgggtgtggtggcaggtgactgtaatcccagctactcaggaggctgaggcagaagaatcccttgagctagggaggtggaagttgcagcgagccaagatagcaccactgtactacagcctgtgtgacagagggagactctgtctcaaaaagaaaagaaaataaaaagaaagaaaaaaagtatacatgcagtgctcatcatgagttgaacactgagggtatggcggagagagaacaaaactaagtttcttgccttcagcaggaaactaacaaacacatggacatataatgtcagaaggagaaaactgctttgaagaaaggcagataaaagatttgtaaagtgagggaaaaggcctgctctgtaagaagtggttttggaaggacgtgggttcagatggcatttgacgaacggcataaatggacagtcacagggatacctggggggaggcggatactccagagaggggaaaccaaatgcaagaatcctaggagagaaacacccctggcaagctctaggaatgtaaatagcaccaacttaaggttagctttcaggttctttgatgtcaatagagtatgagagtagtataagatacaaaactatattattgccaataacttagtaaaaataataaggagaaaaatatattttctcccaggtgaccttcaggtaaaaagtataaagcttcaggagtcaggaaacagcagcagaaatttctccaaattcacaggaattaaaaattaaccgtgtgttcttctgtctaaatctctgagacagtggttacctgatcaaatacacaaaatattatcctgacactggatctataacctggtataaagaagagtcatctttcggggtaaatgatcttcttattactctttaaaaggtcatttctacaagggcagaaaacaccaatggaaaagaaaaagctgtaaaagtttttggtaaatgatgagttcacaaattaagaataatttttagctaacctcatctgaaattccaacgcaataataactttattccctgactctgcctggctccaattagctcacaggtaaccacagttacaactggcaataatactttatttctcttagagggcttttcatctcagggagcaactcaaaatattaactctacagatcaaagtgcattagcattaaagaagttctctacataaatcgcccctaaagactgatggaatgaagtaccagcctgaacattttacttaaaaaaatagaacgatatactcttctctccactttgtttgcttattttaaaaatctactgccagttaaagatactcatacagttttaaacagctcgtaatgtcttaccctgcaaaaaatcataatggttgttttcatattcctaaatgaagtaagcgtaattccaaacaaaatcacttgtataattactgagctatgacaaccattcatctgtttggtaacaggaagaaaaggtaatgttgccccccgttctcagagctaattagctaatgtaagcattggctaaccacaccagcctccagatggaaggatcacttctgactcactgcaatttatcgaatgcttccatcagatattcctgctccagagaaggcatgatcattacttcagagttacagtcccttcatgaaaataggaaccttgagaatcagtccttcctggatgcacctcgctggaatacctttatgctcagaatggacctgatgttcagaccaggggcattttattgcatttcatagacggttgagttgagaatatgtggcagaaacgatcattatcaggccacctttagaggctaagaatgaatcaggaaaattcaaaactatgatgctgtcttttttttttcctttttagtttttgagatgaagttttgctcttgtcacccaggctggagtatagtggcacgatctctgcttactgcaaccgccaccttcgagattcaagtgattctcctgcctcagcctcccgagtagctgggattataggcatgcaccagcatgtctagctaactctgcagagacagagtttcactatgttggccaggttggtcttgaactcctgacctcaggtgatctgcctgccttggcctcccaaagggctgggattacaggcgtgagccaccgcgctggccaatgctgtcttttctgatactattttttgtggtaatggaagagtgacaaatgaacttggaaaatggtccctgctgtaccgaacgtgtcaacagcaaagaacgattccctgtagtctgttttaggtaggatttatccattttcctggacactgtagatatataacgttatctttttataaaaagttataaaagctccacttttataaatgtttttcacctcttctctaatggatgaatccattatcggaagcaaattgagacgctacttaaaaaagggaatggtgacatactcagggttcctaaaagttgccaacctgaggaacttacgtattttaattgaagaaagagtgttctacagagggatgccagccaggaagtggggcacaactcactgggctcatttctcctcttcacaactacaagggtgttgatggtttttcatagtgaggaagaaaatcataactgtaaatgtctaaacttgcgctgtcatatgtggcaactgctagccacacgtggctactgagcacctgaaatgcagctggtctgagatgagctatgctctaagtagaaaatgcacactggatttccaaaacaaagtatgaaaaaaagaaaatatataaaatatctcattatcatatttgtattaactatatgttagcatgatactatttgggagtatttgggttaaataaaatgttattacaattaaattcacctgtttctctttccctttttagtctagctactaaatatttcaaaatcacatacatagtttgggaaataaacacatacctttcccagttactcaatccagcactaacttaggtgctcctgtgaagggattttggaggcataattaaactaccttattaactgactaagttaaggagattattttgtctggcctttacataatcagttgggaagtcttcaaagagggcttagaatttcccttacagagcaactcctgcctgtggacagcagctttgacctcttcctggggagcctggcctcatccctatctttccttcctaacagcctgtctttcagaattcagatatagtgccagccctaccaatcatgtgagccagttccctgatctaagcccacacatttctctccatcctagtggatttgcttctctgcttgaatttttactcacagagtcaactgcttggacatgaggtgttgctgaagcaaatgtgggcacagctttggaaccgggttgtgggtcagagctgcatggttttggggagtgtcatagagaaggcctcaggtgcctcgaatagactgctagtagaaatctatcttgtaaggatactcttgatgggacttggaaagagctagagatattcctggaaaccgaaagaggtggcagaagcttagcagaagtggttctgtgattaggtaggaagcagggtgttcagcgacaaacacagatggacagctaaggagagttgcaggccatgtgtccaagaggccacttgatttcttcttgctgctgatactaaaacatgataggaaagacataaactgaggggaggactatcaaacaaacaggaatcagggctgggtgattttgaaacttctcagcctctgcagatggcaaaagaggctgccatttggaagctacagctgcacaagcattctagacaggaaaggcagagcgtgtggctgcgcagccatgccctgaaacctcagagtgactgtaaggtcagaacacaagtattaggtcccagaaaggatacttttcaagaaattgagggtttcttatccatcttatcaactgatgcaactagatagataaggagcattgtccctctgaagtgtcagcaggagtccaagatggagaaacgattatctcaaaaatatgtgagagcatggcctttgtctaactgagtcaacactagtaaaacccatccactataaaaacacctccttaggaattatttccagcagtataagtcattatttcagacaaaaaattaagtttattacttcaaatacatttttacttcttactaaatttattagaagtaataaacttaataagaactaataagaactgaagtactattcaatgttgatcaaagtatatctaacttaagcagaacgagggaatcatcagtaagaacagaagattgacaaagccaggcactctttgcctgtggagttgaaaggaagaggcagagtcttggcgattactagtaacgttccagaaaactaaaccaaacacaccaaacaagagagaccctgcgaaaaaagtgttctcttccaaaatatgatcaagtgggacacttgaattgacgagaacaggaaaccacaaagaatcctcttctaattatctctaagcgtgagtagctggggggttgagaaggatgggagaaatgtctccaccttcagcctggatggagcagctgtttcctaagtgataagcacctctgagtgtgtgatatctttgggataggatactgagaaagggctttgagtttaagatgagagtcagggccaagaaaggcaatgtcataggtaaacatataaaatcaaataatataaaggcaaatatttaagttactctaaaatactgatttaaaagtaacatttaaaagaatgcacatttactatttgtctaaagtgaactttaaaaataatgaagcctatttcccggatataagagcaagaaaactattgaaggatttttttttccccaaaggaaaaataatccatgtgactcgttcctcctgtataattgggaggcttgtgcatcaccagccctagtgggaacatgaattttagtacagctctttgaagtgcttaagggtcttatgttagaattgaaaaatgcacaatcaaagttgtctagtgacaaaaagaaggggacagccatgtgcatttcctggaccagagattgctgactctcctgaagggtctccatttaagaggtgacaactcgctatcagctgggccatacaccctccctccccttccggtggggcgggtcctgcaaagctgtatcccctgcatgtgactgacccctagtggttatagggaccaggtacaatacagtaaatggggccaaagagtattcttagcttagaggacgatagtgacgtgtttggtaactagttattttcacaggctgcaatgacactatgcttgttgtaccttttttaataactaaaatgcttaaaagtttaaaatgtataagtccattcacgtgaaaagactatatggaaagataaggtattcttacatatgaagctttcctttttagtcaaactagggctttttctcccaaaactaccagtttacataaatcattttatggccaaaattcaaaaacaaaacctccaaacccagcatttctttaattttattattattttcattttaaaacaaccaaaataattttctgcttttcaatatgatttctgtaattctggtaagaatttgtgtatacttcatagcagtaaaaaataagtaatttaacctttgctgacttcgtatgttttattagaaaatgatgatgacaataatgatgaatattttactctgctaactatgttagagattaaagatcatttattaataaaatgatgatttgcaatcaggctaacaattccttttattacttacataattaatacctaaaaaattcaacctcactgcaataggaaagtgaacatttttaggtttgcggggtgcacagaaacctttccggcaggtccagctgtgggacatatattcacacacatgcacactgtttgtgtgtattgatagataccaagttatactcagtatgtgtggatttgctcacatctatcctcaaatgtaaaacacaaaaatattcttggaaatgttagcctctcagcaaattccaaggaaaggtttctgttattacccacatcactatgaaaacatacattactaccgaattctactcttcccatacacaatgcttcatgcttaaattgtatattcataaaaatgccaaccttaaagaaagagataatccaggctttacccaccgcaggtgccttacctcggcagatgggcctgtggtcactccaagcagcgagcgtctctgtaactctctgacaggtgatgcttttagatccctggagcacgtaattgtcctcacatgaaaactgtacatttgcaccaaccctaagccgttaaaaaagaaaaaaaaaaacccaaattatttacagaagacttctttaggaaaaaaaaaaaaatcagcaaaatggctgctacgatcttgttcagttaaaacagcctaagacattaagcaactcattaggtagtatgtatagaggcaaccctgtaatttagcaaaggttataaaatcaaaagacttgggttcagattcctgttgtgccagcttcagaactaaacaaacacatgaaccttaacttgtcatgactaagacagaataaaatagcaaaaatgacttcactgaatagtgtggctttaataagaaaataaatgtgaagaaattttgtaccctgaaaacaagaggaagttggatgtcattcatcgtgaataaatattttacaaaaacaagaagtaaaaaagtctaggttaagaaaatatgtcagtaaagactgtattttgctatcacacatgttaattatatttaaaagaaagctagtgatatttcagaaattcttataggaacagaatattttacttttcttttgtttgtttgtttgttttgttttgagacagagtctcacactgtcacccaggctggagtgcagtggcacgaccttggctcactgcaacctccgcctccggggttcaagctattctcctgcctcagcctcctgagtagctgggactacagatgtgcacaactaggcccggctaatttttgtatttttagtagagacagagtttcaccatgttcgccaggctggtcttcaactcctgacctcaagtgattcacctgcctcagcctctcaaaatgctaggattacaggcgtgagccactgcacccacctgtgttttagaagaaagcaatccatccagcctggatttagagaaaaaactgccctggctccagagctgcatttgcaaacatggagctttacggttgtaaacattaacaagacactgtcacagaacacaaactggacagctgcattcaaaagtgtgagaggcagagatcaggtttgaacaccacccagttacttcttctgagcctggcttctggcattgaattaaatgtaggcttatttaactctctgacaagcgcattgttacaagaggaaattctactcatgtttttagtttgagaaaccacgggttgatgttgaggaaacagaattgaaataaggagatgtgaaggaaaagaagcacagttgtcagtgtggatggatgaagttaatcatagagacaagataggggaaacataaatagatgctttcctttcttgcttagtggaaaaaaaatccatatctataatatcagagtgaatatcattcaagtaacatcgcaccagcatcccccacggcatctatgtaacactctctagggattgccatggatgtcggcaacagccatcaaatcagagtcaaagcaactgggaaaattctaggtaaacaaaattaaacacatttcttttctaaaggggcatctcatcttaataaaacttaatatgcaaaagcttattttagaaaataatgaagagaattcaaaagatgtagacttttccagatttatctgtctaggaagttctttttttcaccaggaatctaggacaactagagttctatggaactaattttgagaaacccggcatcataagaacataatatgtactaatttgaaatgtgaaaaatacaaaaaaacaaaacccagtcgtgattcccattttcattgctagccatcacagttatttaagatatctgtaattgtagacatattctgccgccatcgtttttgatcattggtctgtgtttaaacctcatttaagaaattttcttttaaaaaattgttatatctttgtgttttctattccaggtatcagtctccagttctttctgtttacctacattttaatattcatagttttcatcattctttcaatatattgtcattgaacatctgctatgtgtcacactctaagtaccaaagcggcagaagtgaatagcacaaagccacaatctcatatagataacataatagttaagaaagaaaaaaataaccaaaccaaacataaagaaaacaaaaagtcataaagcaccatgaagaaaataaataaaatgacatgagagtcctcgggtaggaagagttggaatttcagtgtggccacttcttcaatgatccccttaacctgaggcactgatattcagtgtaatattccaggggagttcaaacagaaagggagggatgggggaagcattgcttcaacttagcaagcactatatttcaacgactgcagcacaccaatccttagtcatggagggctctctgctcctataacacctctatctttttcatgcatttttttcctacatccaaccaatattcctttacgtatcagtagcaaattgtattctgttttgagaaaaacaatcaataagcctaaacccccaaagcgcagacaacacaggcaaaaacagacaaacgagatgacatcaaactaaaacccttacgcacagtaaaggaaacaacaaacagagtgaagagacaccctgcagaatgggagaagatgctggagaacaaaatacctgctaatgcgttcatatccacaaatacaaagaactcaaacaagggaatcacaagaaaacaaatcacccatgtaacatatgggcaaaggacctgaatagacatttctttaaagaagacataaaaacgaccaacaggtatatggaaaggtgctccgtgtcactaatcatcagggaaatgcaaattaaaaccacagtgagatatcaactcacacctgttaagatggctattatcaaaaagacaaaaaataataagtgttggtgaggatgtggagaaaagggaacccttgtacattgttgttagaaatgtaaaatatgtaaattagcatactcattatggaaaatagtataggggttgctgaaaaaattaaaaatagaactactacatgatctagaatttcacttctgatcctatatctgaaggaaatgaaatcaatacgttgaagagatatctgcactctcatagtcactgcagcgttactcacaatagccaagtcgtggaatcaatgcaggggtccaacactggactgagaaatggataaagaaaatgtggtgtgtgtgtgtgtgtgtgtgtgtgttcacgcgtgtgtgtacacaatggaatactattcagccttttttaaaaaagaggaaatcttgccatttgtgacaacacagttgatcctgggggaaattatgctaagtaaaatgaaccaggcacagaaagacaagtactgcatgatctcatttctaggtgaaatctggaaaaaatagaactcccagtagcagagtgtgggtatcaggggctggaggaaggagaggaaacaaataatacaaaatttcacttaggagaaataagctcaggagatctactacacagcatggtgactgtagttaataacagcatattgtatacttgaaaattgtctggagagattttgaaagttgtcaccatgaaaaatgacaaatatgtgaagtaatgggtatgttaattagcttgatttgaccatttcacaatgtattcatattccagactctcatgtacaccataaatatctacagtttttctcaattttagaaaagaaaatatcaccactctgactaattgatttcatttctggcaatatatgtttatcatccaaaatataggaaatttctggtgatattcttcagaagacattagagtgtccaacaacaggactgtgcttgactaaatttttttggatatatttgaaagaatgcaacatcgctttataaaaggcaaatataaaatatatgtagcaataaagaaaaataaaaatgacatgtagtaatatagaaaaagaaaaaaggacaatacaaaattgtatgtactgaaaataactatgatctatctatatttatatctaaatattaggaagataggcacaacccatttttgagcggtagtatcacaagtatcacaatacaaatttttgtttatatattcaaatgattatattttttcctgattctattactttataatttaaaagttaaaataaaaacacttaggctgtttctattagaccgttcctttcttctcacccatcaaggtagtcatgtgcactctccaggacctgaactcggctcttactcttctcagatttccaccaaaggaaagttttcaaagactagttcagtggagagcggaggattgctcctgagcttccacaatcatcacctggtatcacaagctagtccagaaatctctgcgcacattcatattcagtacattgagagtacagtatagaacacattccataattacgatcatgaaacctttttgcaaattatcggaaaaagccatcaatagaatatggaagcttctctaatttcaaagcattaaaaatattaacaggagcaacctcttcatttgattgcagctggcaaacagagccaatgtgggtaaacgccattccagcagcacagccgaggaggagactccacgtgggaataaatcaagttgaggcagaaactaaataagaccccaattctaatttattaattcaatcttttgctctcattttatctaacacatgaatcagttcaatttccaagccatgtgtgctttcgatgtcgaatatataataaactaagttttcactgatttatgattactatatttgaagtaatataaatcagatataacatcagataatctaacttggttttctggaaagaagtctcagaggaaaattccaggagaaaaaagctagcagtgcctttctattggcaagttactttagtccgccctagattaattacgttgcacaactgagacaattgttagtagttagtaactgtaagaaatactggagaaccgattttgtgtaagatcaagatacatggtacattgacaataaatatcacacagcaaaagttaactcaaacaaagcagcaaaattttgacttttcaattaaatacaacagggaaacatacattttctgcttcttcaatgcttaacacttctgaaattgctccgtatttgatttcggaagacatttatcaccatataattcactttacctcagtataaagactctttctaagtgagtaaactatttccaaacacgctttagttgtaatacaagcaatttctaaatatggttctcatagagcataactatttgagaacttattaaacattggtatcataactatttttgaaaaataatttgaggtgactcgaagattaaactaatgttcaaaacaggaaatgggttgacttagctgtccgctgtttaccagagattacactaatctactgactggctaggtaaggatctcctacctctcttttcaacccacactgctcagcgtctactgaatctgctgatgcaaccaatagatagatgagagatagatgattgatagatagatagatgatagagagattagatgacagatacacagataaacggagagacagatgatagacaaagagatggatggatggatagatggaaagatggaaagatggatagacagtggatggatagatgataggtacatagattagatagataaatagatgatagatgaatagatggatagatgacagatagctggatggaggaatatatggattagacagatacatagatggatagatacacagatgcatggatagatgaatggatggaaagatagattgatagataaaagacggatggatagatgataggtagatagatacataaatagatgacagacgaatagatggatagatgatagatagatggaggaattgacggattagagagacagataaatagatggatagatacatagatggatagatagatgaatggataggtaagtagatatccatctggttaggtagatagattgacagatgacagatagatggacagaaagataaacaagtggatagatagatacatagatggatagatagctatagaaagacagatatatatctttctgtgttaaaaagtccacttcaaacatatacttcagtactcataaatataaaaggaatatatatatattattaggtatcgaaggtaggcatttaaacatttttgcatcttcagcaaaaagaaaaaatacattaggtaaaatgtttttcagtctcaagcagcagaaaacacaaaaatttgaggaaaccttttcttcagcgtgacattcaagcctggatttgccatatttgtccttgtaaaatggagatggatggcatgggggcagtagctgcagccacactttatcaaaggtttagaaatgttgcttgaatgaaagtatttgcttaagaggaacaaagctgtgagcaggaggaagggtgaatgctgaagggtctatgtgtgtgtttacgtgtgtgtgcacatccgtgtgtgtgtgcacatccgtgtgtgtgtgtgtgtgagtatgcacagctttgatttttcttccccctgtattttactaaaactctgaggacttttgtcctagcacagcacacgttaaaagttacagacttccaaattcacagtgggatccaggtgtacatcatgaaataggtgtaaaggagatgtgatggtaggttctcccacttcctgcttctccactataagaaataaagtcaaagcccacagtgtggaatcgatgagttgcccaaacagcaaaggtggtggcctggccctccccgcaggcaccccatcccaaggagaagtcagaactcctggcctgtgcttggatataggcaggagaggctggaagccctggctggggggtcctgcccagtgagaaggaatggagctgagtcctgcttaaagcggtctggctaccgccagaacttgtcactggagctgtggtgataagtgtgatggtggcgtggaggctgtggaagcccagtgtcatgtttccccaccatacttgggaccaagacccaagctgggtgaggagacagaacaagacagaacccccgcgttgtgtctgtgtgttcaggagtaatgcaggactccttagttcccagctgtggcctcatggagaagcccctgtgtctcctggtgcttcatagagtctggagaaggtgggaggagcccgtgatggagaaggtcaagcccatgagcctcccccaggtccacctgcctccagggcagaggcctaggaaaggttatgactgggagtgagtggcacaggcgggatggaggagagatgcctgctctcactaaggccaaaatgccctctccacagcccgggcccttaacgtccttgagagagagtgaagggatgtccagatctgacttttaacctgcttcactgggaaatcactaattttaactcttttaagaatgaacagataaagttttctgactcagacaaaatgaggatcccacaaaagaaattaccaatcacagtacaaataaaactacattttatacatcagaatttatagacttattaattcaacttcatatatccattttaacttactttgcaaataacactgctatccttattatatatgggtcattctcccatctttgccatctctttctccctatctccctctctctttctctatttttctctttccctgccttcctccatcttacttgattttcacattaaaacactgctttttcccaatacgtagaatcagttatatggggagtttcctgaacaaggtgctaaaaagttttctggaaacgctattagaaagacgacagtgtttttctaactttagagcaacagagtgacgtttgattcaagaaaaggaatgagagaggaaaaaccaaccagaacacctccaatatctaatattcttcagcatcttgaaaacatttagctgctcctcactcttcactcttttccatgggcctctgctatgcccgacctacaggggtttggcactcatttacggccgtccccaaatgcaccagacatgaggcgagccctggaccgtattaatgagctgctagtgtaagagatacttcatcaaacagctcttggtcaatatattaaatctaaattgctatgggaatattaacaaaaaagaactgatttgcctttagtaaaaagataagaagaacttatgctggaaactgaaatttgggttacgtcttgaaagatgcatagaatgtattttttttttccaaaatgagtatatgtgttatggattaaaaaaccaccacagcaaaaccctgttggtaacaaagctgaggtttgttcagacaattgcatataacttggtttgtccaggaatgtttttcaaaggttatttccattaccatggaggctatctcctaccttcctgttttgaagttgcacggtgtccttccccagtagatacaatgacttaggtttataccctctgcctccacctcacctcccttctctcacttctgaggcatataacttagttcctttattgctccatctcaggtttagtctcaggatattaacacaaagcacagaagtatggaagagtgggaggcttgggagaagaggccggttgggaaggtgttaacctccgagggaaccgcggtgtgtcattcaccttgaaatctctcacagcttccagcactgctcatggagcttctgagagccctgcaataaatacctttggaactaatgtgagcaaaaaccaggaggcagaagcaggaattcagaacatctcctagatgtggaagaagcctctgaactgaagggctttaggaagaaaaacacaacccggcctctgtgtgcagtctctcagcatccacgcggcacgtgaacccttgggaacattcatctctattttaaaataaatgctttaggtatcctctccgattgtcctataagggagtttttacactactcagatgggaacttggacaattcaccggatggcctctgctgagggatgccccttagggacacgatcctaataagcaagaccaggaaggctgggaagaccatttgcaagcaagccagccacatgctagggaaacaatgtcccattgtgtgacttgctcagcattccagaaaatgccatcatcggagagatgaatgtgcatctgctgtggatattgaaatgccttttattacccgtttgactttcacacataatgtgtcttttctgggtcattttttcttttcatagcggcaatttttagactcatttcttcaagccttaaggcagtttaacaccactaaaaatgcatcagagagtagatggaactctctagcctgaggaaagaaaggaaactaatattttatgtgatttttagatactgtgtgttagcaatagcccaacaaagatcccttaatgacaatcaaaatataggatggttccagggtataagcaacagtaagcttggagtgattggcaatttccagctgtgactagctctcagaagcaccgcattgacaatgaggtgtgaatttttgtgtgagggaatttgatttaaatgttccaagttatgttataagttcatgtaaacctgccatttgctaaacaacaggactttgtcatgcgaagtagaaaaattaaatcctcacgttcacccacctatctatacaaaggcaaaagctgtttgcacactgtgtgaacgtggaagagggtttggatgcagccaggactgtggggaatcatggcttgggaaggagctttgcccgcaagcccctctcccatcttcttctcttttgtgtctccctgagatccaaggtgaaagcccctttgcctccttcctgacaatttatcagggctttgaggagagcaacgtcagtgcctattttccacgtgggcttaggaagccagaggagactcttcgaactctagaccaaaaggcgttttgcggatcatgctctttgctctgtagctcgagggaggaaacagtgaggagtgtcggaggcagagacatgggagaaggaagcagagctccagcagcctgcaccaccgccccggcagcctgcaccaccgtccagctcacacctccatcatgcatcagcctcacacaatagcagcagacatgagtttgttttacttcatgaacatgcccaggcagcagctggagctaaccaggtacagcatgcagggaagtgacatatattactaaccactcaggtcagggcagacctttggggcctccacgataagtcaacaatggaggaggctgattcccaaatcacagatgagaacgagagactcagagggccctctgctcagcatcatgggatgctggattcaaatgggctttctttttttgtaacttgggaacttatcacttaaatccgtggttgatcagtaaacaatcctaaatacacagagactgttcggcaaatatttcctcccgggcttatatctacacttggcaaaactttgcaattttttttatttatccttcacatctggttgtttgtaattgaccagcaaccacagtatccaggcttaaggagcaccacacaaaacaagagccaggagggtgggcaagagaagaaaacactgctataattcagggcacacacaaacacacacactcacacacacatgcatacatgcataccagtaatcacatgagatccaaaagcatgtttacaagacactaaaagatgtgaatatacttgcaccctacagaagttggcacaatgcaagcgctcagcaaacatgcctcagtttccaagtgcccctcttagcagcacacttctgcctgccttgtttggtgcaatggctcactctgtttctgtggccatgaatccagaacccaggtgctgatgccacccagagccaggagccctgcaagatattggccgataaaacagagccacctcacccaaacgctggctgcactgagcctgctgaggctctggcttcttcagcagacatatgggatgcccaaaatcagagggaatcaatgccccaggggtcatactttgagaaggggacacaggaactgagaggactcatggtaaacatcgggccccaggggtacacccaggctgtctagaggcaccggtgagacagagcatctccctgggctgattctgaagctgagcacagcttcccagcacgtttggcatctctgtctggttccaatttccctcactctcgcttcactggaattaaactgcccctaaagctgatttctatggaatcccaaataaagtagggaactactttcaatgcaagccccaagacctagagaagttattttcaggtcaccaggctattaaatagttgtaaataaaatgcagctgagataaaacatgagccacatgtttttctcaccacaatgcaaggtactgaggccaagaattgtcatttccatatcatacttcttacaactctgaacacagttcttaaaatgtctttgcccagcacatatacaccatggaatactatgcagccataaaaaatgatgagttcatgtcctttgcagggacatggatgaaactggaaaccatcattctcagcaaagtaacacaagaagagaaaaccaaacattgcatgttctcactcataagtgggagttgaacaatgagaatacacggacacagggaggggaacatcacacaccggggcctgtcggggggttggggactaggggagggatagcattagcagaaatacctaatgtaaatgatgagttgatgggtgcagcaaaccaacatggcacatatatacatatgtaacaaacctgcacgttgtgcacatgtaccccagaacttaaggtatattaaaaagtttttctttgtatatctcctctctttatcatttgccctacttcagcccaataaaacactttcttcttaatacagtttatttttctctaccttatattaatcttgggtcattcctagaaataaaatcatatatttcctaacgcatttaacaaaactaagtaggaccaagccaatctgagaaaagggatcctgtggatatcagaaaagagggtgtctagggaagttaatgctaaaattatactgtgctgtgtagatgcatgaactccagctgtaaacatccccagaaaaacagacctgctcggcttcctcgcacctactttcctctatgtagttatgcatttgatggctggtatgtttgctttaacttcttgtcatttagatccagcccttaatgctcacgtcagtctctaggagagaaaggcagggaaagattttccctcagggtttttacacaggctcttcttccttctgggaccgaccgccccataggctcaagtggggacatcctttccttcccatcctccaagccctggctgtgacgtctcccctgagccttcctctacgctctgtctacaacagaggaggacttttctgttgttccttcttttatttgtcctcatcccaagagctcagtacagttcctgagggcttgctcattttgctaaggaaatgaaagaatgaatcagtagctgaagggttgccttggatgctaaaaacctccctagagatggctccaggtagtgatttgtaatttccccccgccccttcttttgagaacagcagatacaaagcacagaaaagctgaaattgggccaggtgcagtgactcacgcctgaaatcccagcactttgggaggccgacacaggtggatcacaaggtcaggagtttgagaccagtctgaccaacataatgaaaccccatctctatgaaaaatacaaaaattaactgggcatggtggagtgcacctgtaatcccagctactcaggaggctgagagaggagaattccgtgaatgtgggaggtaggggttgcagtgagcagagcttgcaacaatgcactccagcctgggtgtcagagcaagactccgtctcaaaaaagaaaagaaaagctgacattggattgcaattgcttactgctgtgtgtgtgtgtgtgtgtgtgtgtctgtgtgtgtgtctgtgtgtgtgtgtgtgtgagatgagggatactgtatatatttaaaggtcctaaatgataaacaaagtgaaatgattactgcagtcaagcaaatgaatgtatccacctcctcatgtggctacgtgtgtatgtgtgggtgctgagaacacctgagatctaccctcttagcaaattctcaggatgcaacacggcattattaaccccaactcagcatcattaaccccaacgcagcattattcaccacaatatagcactattaaatacaacacgacattactaaccccaaagcagcattattaaccacaacgcagcattagtaaccccaacgcagagttagtaaccccaacacagcattagtaaccccaacgcagcattgttaacccccacacagcattgctaaccacaacactgcattattaatcacaatacagcattgttaattaaccacttcatgctatacatcagatccctaggtttattcatcctatgtaactgcagctttatgcctttaacaacatctccattttcctttgagtatctgctgcatgcccagattggcgccaacctataccttgcactcctctcttctttcaccaggtggtccttcccgcttggcatgggcaactcccacttctttcctcctgtctttcatcaaaatctgctgggagcaacagatctgacaaattctttcatacacaagaaagtgtaatggagtgagatggttgactaccttccccttccagaggaagcaacatttcggcacagcaggacgtcttaaagcaaagtgtcggtctctacaattcattgatggcaagctcctggcagcatcattgtgagggcagggaaaatgaccaccacaagaggcacctcctcagctcatcactaagggtagagctggttctgaatgcttgctgaacacttaagaaaagtctagcaggtaaagagagcgaggaattaatttaagacacacacacacataactgcaggtggcatcagcaagctgaaaactgacaaaccattgcttcccgaatctttccaggtatctgtctgtctttctccttttctccttctcctccccattagtataaataggaagcttaggtaaaattcctcataaaatttagaatttggtgccaaagggcatttaatgctgttgaagggtggagtgggtggatttattacctttagatcctagttaaattgataaaccatctaactagctactctatttcccctagaatatgaatacagaaacttaagaggtctctaaaccagcagttctcagcaagggtcaagtgtatcagaatcattcagggttgattggaaaagggacgccaagtgtcaaagactaccactcagagactatgaaatgtcatcctggggatagggtgctcccatttactcacccagcttgccagtatattctctacgatggcaagcaagtattattgctggtggcagtggaaaacgactggtgaccccagatgataagagacagaaaaccattgctctggtctaaagcgaaagtctgcaggggcggtaattttactgagggatccaggcacccacctctatccccactctatcacaggattcagtcataaatagcagtcattgttcttccatgaatgttttgtaacattcatatgcatgttttgcaacattcatatgcatgttttgcaatattgcaaacacagtattttattaattaaataaatgatttcaatacaataaaaaaatggttttgctatgtgattgaaaatgtggatagagaggaaggaattgattgcaatgtcaagaaatgtaaagaactattccaagggggtctctgtactaatctctatgtgcaagaatcagctatgattggacatttttcattcatcccgcatgatatcgtggcagcaagcttgataccaggtcatacatgctagaaacctccatgactcctgtatatcactgctagatgtaggtttgcctctggcttctgagatctaccagtgctgcatcattgtgtccgtgggattcctgttcatgggagctgctcattggcctcacatctttattatttttccaagaacattatttgatggaggccaagatttggtaggatttttgctgcggggaaacaaatcagctgtccttattcttccagcttctgcagacatataggagctgtagaaggcagcagatactgaaagtgttttccaacgatgaggtttccatatacattatcagacgatgtttatgctatcaaacaggtttagaaaagcaagcccatctgtatttagtcacctatctctaatctcatatcacggatgacatacaccaggcaggccaatggttaccaacctcgcttgcacatcagaatcacagcaggcacttataaaaggtctaacattgagttacctacactagtcaccacaatctactgtagaataagatgctgcaaaattttcatggctctgttcagcagcgtcaacaaactttaaggctaatggaagcctgtgaaatcattggtaatatgcagaagagttatcaactataggaacaatattaaagcagtgaacattgaataacaaccagtgcattgatttggggaccattctccctgctccctaatgtttccaattcgtttaaaaactcttcagaatctcaaatgattcattctgtttccccctacgtcttcaccagaaatgtgttgaagcaaaggagagagttagtgttcacagatctgccctagagagagagagggttatagcacattctgtctatagtgatcacgttcccaggaacaggaagtacaatggtggctgtcgggagatgtgggtaggggaggatgggaagttatggctttatgggtatggagtttcagttttgcaggataaaaagaattctggagatggatggtggtcatggttatacaaccatatgaatgtgttaacaccattgaactgcacacttaaaatggtcaggatgctaaattctatattatgtggattttatcacaattaaacattctctttaaaaatcttcatgactggtccatcttcctgaccaattaaaccagaaccttcggggtaactggagtgtgtttaattgcacagtttagagtccccaggaaaaccagatcactttctctctagggcagatcaatgaacactaactctcttctttccttcaacaaatttccggtggaggcatagaggaaagcaaaatgaatcacctgagattctgaagagattttaaaggaattagaaaaattagggagcagggggaatggccccaaaatcaatgcactggttggtcattgaacgttcactgctttaatattgatcctaaactcttttgcatatcactgatgatgatctcacaggcttcttttagcctcaaaggttgttgacactcctgaacagagccatgaaatttttgcagaatcttattctaaagtagaatatggcaaacacatggctaagagtcacagggtgttataattctaatgtatggaagaaataatcacatctcctatttcaacccattcttttacaggaagaattacacacacacacacacacacacacacacacacagaaaaagtgttacagaaggtcattttgaagagcatttatattcaaatagtccccgagatggcatatctgatgatcatgacaaactgggcttttgttgataattcatcaactatgttttgtattttgaagctaacaaattaatataggctcaagtaacaatcacctattttctcagaagactatttaaatgtgtattttattttgatgaaaaaattacttttctactacagatattgaaaagactgtgtaagagagagggaggatattccaccagccctatttggtgaattgcttatcagaagcaagtttagccacacaaatatgatctgaaacattcagagtgtgtcatttttcaaagggacataaaggcttcaaggagtgtcaatgggatattattgtttgtggtatttcttaagtagttcttaaaaaatgcagttgatgctctttgaaagagcagtaatcatcggcaaatatttttcctactctgcttcagtttcctagtaaccatgaatcctccttcaaaagctacctgcctgccttcagttacaggcataggaatatgttatgttccttaaaattttttttaagttgtgaaaacactttggacaatggcaggggacttaggcgcggcaggctcaaatacagcacgtcaggaaaggcttgcgagctaaagcctcctttctttatatgacaaacctggactgagcgcccaatcccactttgtcctccttcaccttactgttttctccactagacaagagagtaaaaatcacttacagaaatgaacactggttcaagaaataagatcatgtttgagtttcaaaaaataaaagacagttctttgtcttccacttagggacatggaatggaaacggattatgtcacaaaggggatttttttccaacaagaaaccaaacttgaatgtttttaaaattccctcttgtattcattatagtttccaaattttcttaaaaaaccccctgatatatgggcttgattctaactttacaaatgtttcatctattagtaaactaaattttttagttgatgggaagaaggaataacaatcataatccaatgatgtccatactttctactttttcttctagttgtacataaatgatctagcaaatggccaaggcttaatgcttaatacagtatatgatgcaaagaaacagcagcttttttattgggaataattatgttcttacaagtttacctgtaaatgaaaattttgcatactgaatcaatatttattgttgccttacaacctgtaaatgtaaatgcattcctgatataaaagtaaaattaaataacttagtgaataatggctgaatgcttccttcgaagcaggctctgtactgaacactggaaacatgatagtgaataaaacaaagttcttctctctacggggctcagaatcttgtgggcagatagaaaatatataaacatgaattatgcttagtgaaatcaaattggaagcatagacgtgcatagaatttctggctggtcagtgctagaaagtcaaaggccagagggagggaggctgcggggggggaccaaaggtccatttcagattgtgtggccaggaagtagcacggaacaggtacctcatggggtgatgctccgaatcttaagatctggattttctctggtcagtatataacacatctcttagcattgctgagaggacagaagatgtcaacatatcatggaaaacacgagaaggatcatagaaatgaagacgtgctaaagaggagagccaataccacataggataccaaccgagatatcagtgtatgcatctgctctaactttataagtatatgaaatctataaagtatataaatgatgacaaataaaatagtaagcaagaaaaggaatcaaaggagccaaaaagcaggtggaaatacaggaggggaagagctagaggtccctagatatctctccattattctctgcatcaggagagaaacattataacatcagtgcccttggacacatgggcataacctgagtgtgcagttttattgcttgtggtatccaagggcatcaacgtgatagcatttctctcttgatgaagacaacagtgagagttatctagggggctctagctacctccacgctctgtgttcacctgcttttgggcttgggcttgtttgacacttttcataataaaatttataatgtgcctttggtttccctcatttcttcatcatttaaaaaaatgattcaataacacaacttaaaagaaagcagttcttttgtttttttcttttgaggagtcactgctggagtgcagtggtgccatctcggcttactgcaacctcagcctcccaggttcaagtgattctcctgcctcagcctcccgagtagctgggactacaggcgcatgccatgtctggctaatttttgtatttttagtagaaacagggtttccctgttttgactaggctggtctcgagctcctgatcttgtgatccacccgcctcggcctcccacagtgctgggtttacaggcgtgcgccatcgcgcccagatgaaagcaattcttactgaaaagaacaccacatttactccctggtttctacacagtccataagtgcaattctttacattttcatgtaacaagagacaggtgcctctgctctcgctggagttgacctacaatggagaaataataaaaccaatgcagcaatactataataactataaataaaattatcaatacgctacaaaaaattaagataactgaatgtggaaactagaaatgagcagttgtttatcacaacacatgggctatggatttgtttctgcttcttattatgtaatttttttccttaatgtacttcagtttctccttccgtttgatgacacataattcataaagcatatttcaaaatagaatgaaaaataaacatggtatcctcgagataaaaatatgctaagacaaagaacagatgttattagcatgaatagtaacatgcacataccaaggacatacattaactattcagtttttaagtcataaatagcactctttcaacccccaaattccctttagagcctaggttatgactctaattttaattgttaatctattctctgatgagcagtgcttaacttaattggtttagcagactattaatgaggttatgtccatatatccctagagactggcttgttagcctcagtttaatccattcaacagaggagtcttctgccttgtgtggggtccggtcatataaaatcaaatcaataaggcgtctcccctttcctacaaaatcacatgattgtaatgagatgatagtaacataaatacatgtataaaactcaaagatgctaggaaacgttgaaatcgggaaatgacaagaagctgggtgtaaagagcccctcgttctgcagagagaagccaaccgtgtgggtgggggaggacagagatgggccaaggtgcagtcacttgtcttttaaggccaggatgcagtgtgagaaatgcattgttaggcaatttggtggttgtgcgaacatcacagagggcccttacacccacccagatggtgtagcctgatacacagctgggcttcatggtacagcctagtcctcccaggctatgaacccatacggcatgttactgtactgagtactgtaggcaattgaacacaatggtaagtgttcgtatatctaagtatacctaaacatagaaaaggagcagaaaagatatggtatgaaagacggaagatgtctcattcatatagggtactccctatgaatggagctggcagggtggaagttgctctgtgtgagtcagtaagtggtgagtgaatgtgagggcctaggacatgactgtacactcctgtagaccttagaaacactgtatccttgggccactataaatttattaatgcttttctttcttcaataataaattaaccttaacttactgtaacaattttacttcgttacaattttttttttttttttgagacagagtctcactgggtccccaggctggggtacagtggcgtgatctccactcagcgcaacctccacttcctgggttcaagtgattctcctgtctcagcctcccaagaagctgggactacaggcacctgccaccacgcccggcaaatttttttgtatttttgtagagacagggtttcaccatgttggccaggatggtctcgatctcttaatctcatgatctgcccacctcagcctcccaaagtgctggcattacaagcgtgagccgccgtgcctggcctaccgtgttacagtttttaacttgtgagttttttgcaataatactcagtttaagacacaaacacatagtacagctgtacaaaagtgttttttcttaatatttttatttcacaagcttttttctattgttctttttactttctaaaccttttgttataaactaaaacatgaacaagcgcactagcctaggcctgcacgacgtcaggatcattaatatcactgttttccacctccacagcttgtcccactgggaagtcttcaggggcaaggacacacataaatgaagctgtcatgtccaatgatcacaattccttcttctggataccacctgaaggacctgcctggggctgtttacagttaacttttgtgttttttataagcagacggagtatactctaaaataacagtagaaagtataccattgtaaatgcatgaactactaagacagtcattgattctcattatcaagtatgtgctagccttttctgtgactggcagcacagtacatctgtcttacatcaagactgccgcaaacatgtgaggactgctctgtgctgggagggagcagagctaggagatcaccaggcaatggaaatctttcagctccattaaaatcttaagggaaaaccatcatatatgcagtccattgttaggcagtgtatgactggatattctatttacaaaaagaacaaaaaattttacggagaactattccatatcagtcggttttgcctattaaagcccctcctctgtatctccattaactggcaatactcctttgtggaaagactcaaatgagaagaatcagcatggctggtgttggtgtggcagaaaggagatgatacttgaggaagaacatgactaagaagtaaaggaagtagccaggcacagtggttcatgcctgtaatcccagcactttgggaggccaaggcaggcggatcacttgaggtcaggagttcaagaccagcctggcaaacatgggaaaaccctgtctctactaaaaatacaaaataattagccagccgtggtggtatgtgcctgtaatgccatctactcaggaggctgaggccggagaattgtttgaacctgggaggtggagaggttgcagtgagccaagattgtgccactgccctccagcctgggcaacagagcaagaagccatctcaaaaaaaaaaaaaaaaaaagtaaaggaagaaagacaggacactgaaggtgggcaggtgccacctgcagaggaggtagtgtcaggacagatattgcagctcatgcagaatcagggctgtggccacatggagctctttatggatagacatgaagggggccacattgtggaagaaaagagaaaagggacatggaagcagttgagaagctcaagtttcagagaattcagggagctccctaagttcagtttcagcatctttgaaatgttcttaaaaggatagaagaatttgaaattatatattaaaaaaatatggctgggcgctgtggctcacgcctgtaatcccagcacttagggaggccaaggtgggtggatcacgaggtcaggagtttgagacgagcctggccaacatagtgaaaccccgtctctattaaaaatgcaaaaaaattagccgggcatggtagcacacgcctgtaatcccagctactcaggaggctgaggcaggagaattgcttgaacttgagaggtggaggctgcagtaagccgacatcatgccactgcactccagcctggacaacagagtgagactctgtctcaaaaaaaaaaaaaaatcataacgtccagcagtgtgcatcacggccaatgctagtctatgtggatccgtggtgccaattacaacatgacacaccccttgcagtgatcaattaaaccaagattgtccttctgctcagcatatgcaatgcatgctaagctgcagggcttggaatgctgagctcaagggcaaatttcaaccataccttgactcctcattggctactttgtgaagtccgcacactacacacccctttccagcggtcctgcatagtgagtgtaaaaacttctattataattatctgtgttacaaactaccaaggtcaatagaagctttgatatcagtaggatccagctctgactctgacaagatatagcactttgttaggttagcgttctgaatttcaacgcttctacttataaacatgaggataattacatctgcctggacataggctacatatcctgttagcacagaaagacagatgaacaatagatgacagtacccacccataaattctcaataccaatctgagctccctccctcagatattggtatttgaatacttccatcaatcttactgataaatattcaattgtgatgaatacactttgtcttttagacagtggtctatggtgaaaaatactgtcagcaaactgtccccaaactgacttgaattcaaataagcaagctttgtattttatgctttattttcttcgggtattttatacataatgatagaattaatatttaggttgtctacggaaaagggatttctcaagaacccagaataatactataaatgaaaccagatgaggaatattttaccagcctaaaaaagtgaactctttttaacaaaacagccccaagttacatatttacaagggctacactgcaaatgagctcatctacgcatcttggccttgttggttgttagtttggattacatgttagtcattagttttgattataagaatttaaaaaaaaaaaaaccgaattacctttcattaaagagagtctcaaaagaaaagactgttaaaaagtatcttccctttttttttttttttttttttttttgagacagagtcttgctctgtcccccaggctgaagtgaagtggtgcgatctcggctcctgggttcaaacgattctcctgcctcagcctcccaagtagctgggactacgggcgcacaccaacatgcccagctaatttttgtatttttagtagagacaggatttcaacttgttggccaggctggtctcaaaatcctgacctcgagattcacccaccttagcctacagcacccagccttccctccttttaaaacatcaacatttgtaatgaactgattatatgagaggcccaccatgtgtcatttcatctaagtgtcataaggcatccttacttggctgtagtccagcagcttccatatgaatacaatgggttttactatcccatggaacataaatagtagatataaacaataaatcgatatgtgggctgggcacggtatcagtaattccagcaattttgaatgtcaaggagggaggactgcttgaggccaggagttagaaaccagcctaggcaacacagcgagaccttgtctttacaaaaatcttttaacaaattaattgagtcagtggctcatgcttatactcccaactacacaggagatcgaagtgggacgatcatttgagccctggagttcgagattacagtactccaggctgagtgacaagtaacagattgtctctataaaaataaataggtcatataagtatataatataggtcatgtacacatataaatataggtcatgtacatcagatgcccatgatcactacacaatcctaagctaccagtatagatgacattcacttcaattcaactcaatttttcttgtaacatagcaaatatcttactataatgtttctttcttcatatgttctttctcttaactccaattataatttttatgctcagtagaattgcatacttaatgcatctctttttaaggtgtgccccacagatgcctggaaaggtggaattttagaaggtctgtgaggtcaaaatcattttacaatactctaaggtgttatgtgccttcttcactgagttgccttttccattgacagtgcagaaacaatgatgggaaaaactgatggcgatttcgcaccagtcaagcaacagcaccaggcagtaggagagaaaaggtgcagtgtcacttaaaccaaacaccgcatgttctcactcataggtgggaactgaacaatgagaacacatggacacaggaaggggaacatcacactctgcgaactgttgtggggtggggggaggggggagggatagcatcgggagatatacctaatgctaaatgacgagttaatggctgcagcacaccagcatggcacatgtatacatacgtaactaacctgcacattgtgcacatgtaccctaaaaacttaaagtataataataataaagttaaattaaaaaaaaaaagaaagtccttgagggagcagggaaaatgattgttttaataaatcataacacttgaatacgtaatgtgtctctagggcttggtgaagcctgagggagctctggaggaacaaacatctatgtaattgtttgagttttgagttgagctggctgcttgcttttctactgaactcctcttaatttaaagaacgatagaccaactatcactgctaagattggagtatctctcacttatttataaaaactgaatgagtcttttacttcaaggaaaatgacaaaatttgagcccatgacaaagttaaagttttctaattttcattagtaataaaattgtaattttcatttgtaattttctaacgaaaattagaaaattttcaaaagctggtatctatcatcatgagtttgacagtttttcaatgctttcagatcctcctaatgaaatacatggtaatatcaacaaatgtatttttgtaaataatgtataggacaatgtataaatatttgaaagaactcataactcgatgaatcattattttcaaatgaccaatgtatgaggtacaaaatcatgcatatacaaaaaattaatttaggacagaagttcagccaataaattttgatgtaagaaaataaaaaatgtttattttcaaaaccccatatccaaattgcatctaaaatttaagatgacatcatttgccaatttttgttatagtatcaaataatatactcagttatttgaaaagatttttaaaatactaatttccttttcagctatatgtacaactggatttttaaaaatatttaattaaaacaatgttgtgcaacagattgaatatagaaacatatataacaatccatatattatagactaacaataattcaaagaaagctaaaatggctatgcaaatgtaagacaaatttgatttcagagtaaaaaatgttactcagggtaaagaaagtcatttcataacaaaaggtattgaagaaacaaaaatacacagcaattttaaacatttgcgtacctaattacagagcttcaaaatacatgaagcaaaaactgataaagctgcaatgagaaatagacagattcacaattttagtagatgatttagataaatctctctcaatcacagatctgacaagtgttaagaaaattagtagggatcacaaagccttgaacaacactgtcaaccaacttgatctaactgacatttatggaacacttcacccaacaacactaaaatatgtgttattttcaagtggtcatggaacatttaccaagatagagcatattcttgcccataaagcaattatcaaaacattttttaaagttcagatcctttaaagcataatctctaaccatgcagattcttagaaaatgttcagtatatggcaacaaaatagaaaactttcaaataaatcatggaacaaaaaagtaatcacaagggaaaatagaatgtaattcaagctgcaggaaaatgaaaacacagcatatcaaaattgaagagatgcagccaaagcattacttagaggaaaattgatagcagtaaatacccacatttagaaagaataaaggtcttaaatcactgatctcagcttcaactttaagagactagaaaaagaagaacaaatggagcccatagtaaacagaggaaataaattaataagaggtcagagcagaaatcaatgaaattgaagagaaactaaacaatacagaaatgtatgtaaaagtaaattgtatttttttgagaagttcaataatattgacatgttaataggcagatggaacaagtaaaatttttttaaaaatatgaatatcaagaatttgagctgtgaaattactactcatttaaaggataataaagaaagataagaataattttaagccaacaaatttgacaacttagattaaaatttataatttcttgaaagatacacactatcaaagctcactgaagtagaagtagatcatctacataagcctgtaagtagaaaagaaattcaatccgtaattaaaaacctacttgtaagaaaattccaattccaggtagcttccctggtgaattattccaaacatttagcaatgaaatattaacaattatacacaaactcttctatggtattccagagaagagaacatttttcaattaattttgagaccatttttactctgacaggaacaacaaagtctttataagaaaagtctacagcctatcataactcataaaaatacctgtaaaaaaactaaacaacattttaacaagtcaaattcaacaatccataaaaagaaaaaaacatcattacaaattaatattatttcagaatatgagtttttaacttagggaaattagttaagccctcatattcacaaaatatacaaacaaaaaatggtcatgtcaatagatgtagaaacttttgaaaaaattccaaattcatgtcagattaaaacacacacacacacacacacacacacacacacacacctcaaaaaattacaaacagaaggatacttcctcaaactgataaagggcatctatgaaaaaccaacaagcaatgtcataactataatgaaagccagaacactttccacctaagctcaggaataaaggcagagatgtctcaccatttctactcaatcttgtaaaatagtttcttaccaatacatttaaagaagaaaaagaaataaaaaaaatccgattggaaagcaaaaattaaaaatccttttatttgtagataacaaaatcacctagggagaaagttctaggaaatctatcaaaaaagctactatataactagcttgtctctgttatgtatatattcgtatacacatacacacaccatagacgatacaaataacattttacatgtgtatttaagagaaaatttaatctttcaaatcatcttcccaggtgttatggcatttgatttctattgctacaaacatagagacatataaacaacatagtgatttcccaaaaaactaggaaagtgacagattgaaattctcttctgagataagattctacagaaaccttatctatattctttccctgacgggctatacgtctgcacaacctagattctccctacaccgccccccgagccagatcaacacagccctcagacttaatgttcatcctgaatttaaacctcttcttcagaaataagtctgatctgagaatgaaatggagtaaagattggcttactcacctaggatatgattaaaacttccatgattgcccatgtgctaagaagacattggcctgaatattcacaacttccctgttaacttttaaagcttaagcatttcctctgtcatttttttaaaacatgaagtgcaatttgaagaatttgatattctcagatatgagttaatttgttttgtttttagaatacagctctgcaaaattcaccaaagaagtttctaggtttctgggatgacaggatacaagatgggcagttcctctgatacacaaagtatatatcacacatagatgagtttctttgtgccacgcacagttttagtcactgaggatgcaaagataagacactctccattctggagacgcttaagacaggtgagaaaacagatgtgtgagcacatcgtgatgatgcactgttgtcaactctgacaaaggggcacagaaggaaagggaagggaagcaggaagaagatttttcctcgacaagagggacatgaaagacatgactgttgacacaaggaaggaatacatagaatggggagcccttggaagaatgggcaattttatttcgttgctttgttttcaaaagagataaaattcctgaatgacttcaaatgactgctgttttctaatatgatactggaaaccagcatccttctgttagctgccagctggtgcatccacacaccacactcactgcattgctaataactgttcacaaccaactcttcctctggagaacttccttgagccaaaggaaggaagccatttattgacagacagcaaagtgggtacaaaaggtgaggcctgcttgtcagtacagtttgtgccccagaactcgccatggaaacagactgaagtgagtctccagtaaaaacatccttctgcttagctctttactccaattctattccacttcctctactcccctcctccagagaccacttttccaataaatcacttcaataagaaatttcatctcaagctctgcctcaaatggatttcagcgaaaacacaaacttcttaatatattagtcaagatgtgtaatagttaacctatatccattccgacactatttcttcacatctatactttgtatgcttttcatgtaaaacaatataccattttaccaacttcaatatagacacactacagttttcttatttttctattgcttttaaaacgaccgttgttactccaatttaactaaaaaacattccttctttcctctctaatagtagcagtacttttcttccatttgtagcccacttcagcagccttagctctgtgaacctttttttggatttttttcaaaaatggtgacattgtaagaaggaaaaacacatatcttgtttctctttactattttattttacagctgcttctaataattgcatccatcttgtaagatggaaaatgttacatttcttgaactcactgaaataagtgcaaaaatctaaagtaataggactattataatcactactgtattcataatgtagcaacagaaaatcagtatctagttcaccataatcctagtaaaatgatatgcattttctgaataaactttactgactgatactaacatgcatcattcctaaagttttttaatgaaataactatgaggagataattaaatattttaccttctatctttaaacattaaaagaattggaatatgacatttacatggtttggctctgtccccacgcaaatctcatctggaactgtagcatccataatctccacatgtcatgggagggaccggtgagaggcaattgaatcatggggtcagttaccctcatgctgttctcatgttagtgagtgagttctcatgagatctgatggttttttaagaggattttcctccacttcgctcattcttctccttcctgtcaccatatgaagaaggatgtgtttgcttccccttctgccatgattgtaagtttcctgagacctcctcaaccatgctgaactatgagtcaattaaacgtctttcctttataaattacccactctctggtatgcctttattagcagtgtgagaagggactaatacagaacttttaacagattataaacaaaaaacaaaatctctgaagacaaattgtgattacacacatttagagttaatgattaagaagttttatctttacctcaaaagaacaaaagagttaaatttaactgcaagctgaaataatatatgtcttaaaaataacatgcttttttccaccactattgtatctcttacctgaagtcggaacctgctcttctaccattttctggaatcccaggatctggacacatgtcagagaccaatgcaacacctccttggctcactgtaatagacagaaacattgtcaaaatgctgtatagttattgaggaaatacccagataaaaaatttattctaggcattttcagttctttaatgataatgacttaaaatgtgatctccaaaggaattaagacaccttaaatacattcaaataagtgtttatattctgattggtgaaaatcaaacatgtgttttccagtgaaaggatgataatctttggttttatttctctcatttttaagatgtcaaaatttaataaaaaatctcatttggtccttatgattacttttatgccaggtcacaattaacagcatgatcagaaaaacagcattatgagaaaaacgcatacacttagagagaagaaagtcttcacttattcccatagatgacaacagagatgatatttactaacttctatacaaaagatactttaaataacattatgtatattttaaacattgaagtgcttatcattgaactaaaacccataatggtttctttgttcaaatgcactgatttatttctcgaatttcatggaaaaacttttctcctgttgggacttgcaccatcacagaataatttctaaagaactcatttgtttattggatagagtagctctcacttcaacattcatttcatcctgtataatttgtctaatcaaactaacacatttctttttttttctcccaggaatttgcttagcagagggcttgggacccaattcagtataatgagatgtgaggggaagtccacaggagtacttctgggaaacattacaggatgctaataaagtgcatatctattttactctgaaaatttctgtgtccaggtttcaaatgtagaactattgctgccattttcctataatccaaggatggagacaacagcatgtatgcaacagaaaagatgtgtcaagaacctggacctgctaccttattgttaaggcagaaaatcaaccaatttaggagcaatgtcgcaattctgaacattctgttgtatttattatagctgatttactatagcgtaaatccaatgaatagctgattctattatttgtagctgaaaggtatacatataaatatacattttctcacaaatattttaaataattccgtgagaagaaaataatatgtctgggtatatgtggaactcgtgaagcatttgattaaaattaccataaaaacaacagtaatcatatcaagtttagcttagtttgtttgttttgagacaggatctcactctgttgcccaggtgggagtgcagtggcacaatcatggatcactgcagcctcaacctcccaggatcaagcgatactcccgtctcagcctccctaatagctggtaacacaggcttgtgccaccgtgcccagataattaaaaaaaaaatcttttctagagatggagtctcactatgtttcccagactggtctcaaactcctggctcaagtgacactcgcactgtggcctcctaaagtgttggggttacagacatgtgcaaccacacccagtcaaaatttatcttttactactaaatgagaataaatttgggtaacataatccttcattaaatacaaattctattgaatatattatgtggtttcattcttagtaagtacttcactattccaaacgggttaagatattttttaggtatttttatttcttttttaaaataagttttttttaataacatctaaacattattttgctgcatgatgtgacaattatattgaattccaaaattttattttctaaatgtttaattttctcaatattatatcaaaataatccagcaagtttggtgatagcatcagtagatagtgagacagaaagctccagacctgtatttccctatggaaacaccaaagaaatgactaccagaagattaaaataattttacaggagcgctaaatgacagtaaaaaaatctgtaacaaccaagcaaatgcccaatgaagaaaaagatgttcaaaataggactatatttcatgatgtcttactctcccttgtttcataccatgacttgcgtggcacagtgcagttgagaggaagcggcccagtgaccagtttcctctctaggtatgaagaagcagagagaaagtggctggcagcacgatggtcgctctgtgggctgcctgagagactgagctctgtctttcctgacttgcaggtcagatgaggaagggcggcataattgggatctctggctagcagccatgaaaggctgtgacaagcactgctgtatagaaaactgcagcaagattgcaaacccatgggtacactggggtaagggattccaggcagaggaatacaatagaacacatatctaaggtcccaatgagaagatgaggttagattctttggaatattaatatgtttaaaagcagctggggaaaaaaataaaaacaaaaatacagcaaaatgtacacacaaacccagacaggacatgtaccccccaaaaacgtgaaaacacctaaagtcttcagtccaggttgatctcaacgttcagaggcccactaattagtgaacattttctaccgtgttctgcaaacatggagcacggtagttaatttttttcaaatgcttatttttttttaacaaaaaccacaaggcatacaaagaaagagggaaacatggccattcaaagggtcgaaataaatctctagatacagtcactgaagaaatatatgcatcagacttgctagacaatgaatttacaacaacaattatagatatgaatttaaataaaggaatataaactttccaaatttgaggaaagacatagatgtacaaattcaaggagattaatgaacacctagtaggataaacatcaagagatccacagcaagacacataataatcaaactgttaggagccaaagaaaaagagagaatcttaaaagcagaaagagaaaagcaagtcctcataaacaagggatccataataagactatcaacaggtttctccatagacatttcacaggttagaaagcaatggataggctgggcacggtggctcacacaacgtaatatattcaatagaatttgtatttaattccaacactttgggaggctgaggtgggtggatcacttgacgtcaggaattcaagactggcctggccaacatagtgaaaccccatttctactaaaaatataaaaatcagccaggcatggtggcaggcacctgtaatcccagctacttgggaggctgagacaggagaatagcttgaacctgggaggcagatgttgcagtgagctgagactgtgcccctgcattctagcctgggcaacagagcaaggctccaactgaagaaaagaagaaaagaaaagaaaagaaaagcaatggataatatatttaattgctgaaaaaatgtcagctgaaaattctacatctaggaaaaccatccttcaaaaatgaaagggaaattaagacactcccagataatcaaaatagagtgagtttattaccaatgtatgttccctacaagaaagtccttcaagttgaaatgaaagggcactacacagtcacttgaagcctcatgaaaagaaaagggtccctagtacaggtaaatacatgaaaatatatataaaaaagtattatactaagtttgacttaaaacccccatgttcatttcctacagtatttaaagataaatgcataaaataattatgcatttacgctaatagttacattatatataaagatgtaatttacaacagcaatagcataaagtaagggagcagacttgtaaggattgaagttttcgtatatgaatgaagtaaactggtgtcaatttaagatactgccatcattgtaggatgttatatgttatctccatggaaaccataaagaaagtatctatagaatatgtaaaaaagaaaagagaagacaatcacaacgtgacactacaaaaatatcaactaaacatagaggataacagtaatgggacaaaggagggacaaaaatgctgaaagacatatgaaaattgaataacaacaaaatggtaaaagtcagagctaccctttaaataattattttaaatataaattgatttaacgccctgttttaggctgaattatgtccctcctccccgcaaagggttacaccttgaagttctaaacaccagtacctcacaattgactgtatttggagatagagactttaaagaggtaattaacttaaagtgtcatccttaaggtgagccctaatccaacatgactggtgcccttctaagaagggtaagttagcagaagaatacataaaggaaagtccatgtgaagacacaagaagagagtcatccacaagacaaggagagagcgcttagaagaaaccaaccctgcccaaaccttgatctcaggcttctaccctctagaattgtggtaaagtgaatttctgttgtttaagccactcggcgagtagcgtagcactttttttatggcagccctcgaaaatgaatcaccccaaaccaaagacataggttggcaggaggcgttgaatagtaagttaataagtaacagaatgcaactgtatgttgcccacaagagactcactttaggcgtaaggacacaaagaggttaaaaacgaagagtaatcaaagtcagagagccagaaagtagaatgatggttttgccaggggctggggcaaagggaaagagaagaaggaatataaggtgttattgtgtaaagtacttcagcggagtatgatgaaaatttacagagatgaatagtggtgatggatgtacaatagcatcaatatatttaaagccacagaaatgcatggtttttacttttcttttcttacttttttttctttttttgagacagaatcttgttctgttgcccaggctgcagtgcagtggcataatcatggctcactgcagccttcgtcttccatgctccagcaatcctcccaaatagctgcaactacaggtgcatgccaccactcccagctaatgttttattattattattattttattattattattattattttgtagaaacagggtttcaccatattgcccaggctggtctcaaactcctgggctcaaacaattctcccacctcgacgtcccaaagtgctggaattacagtaagttatcgtgtccaaccagaagtgtatgcttataatggttaaaaccagcaagcctgatgttacttctgtcttatgtctctctctctctttgtgtgtgtgtgtatgtgtgtgtgtgtgtgtgtgtgtgtgtttgaataggtctgtatttctaacattctgatactctactacttttctcttcaagcccatgttttcacagtctgcactatgtgctggggtacagttctcaatgagtaagcagtggtctactactagctctctgaaatttatcttgtaaatgcatttagctttaataatttcaaaatgtaatgcagattgttacttctgccacgtttattctttctgccatcacaggctggatgtcttctatactacctcaagcaaaatcattattgctgtggcaaattaaaacagcttcatcaagatgaacgactatcattgatgtttgtcagaaataatagactctagcttggtagttaatgcacttttccacaatacccaaactggttgaaaatacaacacaccaaggcttacaaaggcccacttgcatgtctccttttctatttttctcacaaggaatagcagttaaaagaaatggcagaaattggagctacctgcccaagttgggcaaaaacactctggatctttttaaagataatgccaaagtcacttactaaaaaaaggttacttagttggaattctgtgaaggcgcaaaatgatttagacaagcctgaatggattgcagatggtagaagataacaaaaagtgattagagattaaatgtaaaatacaggcgattttctgaaacagagggagttgtttcgtgtgataaacagtcagaaaaagtatgctgacacactgtatgtgcaaggaaatgatagctccataaatcccaactatgtattccatccacaccatgagtcattgattcatctagaaataaaagctccaaggttggaaagaatcatggagatgaaaccacttcaagaggaatccttagtacctcagagaaacattttcaaagagaggaattactgggcttaatatcactttaactctaattttgttgaattatatcttttcagatctcatagaacacatgacatagatagtaataaatatgttaaatgtaagtcaaaaccctgtagttaaaaatcaaaactgaaaatatcaatagattggttcattacacaccattaatattaaagaaagatatgtaattatgcaagtggatgatcagatataaattagacagtttgtaaaagagtttaaatgaatttgattttaaaagtataaattacatatattttcaatgactttttcaaagcatgttgatttataatacctcattagatctgcacaaaaccttgtgactctgcagggcagtaaagaaaattcttcttcatcaaattaccctgctgtttgaggacatgccatgtaagtatcaattaaaactcaacatgaatttctttgtagcaaactatagaagtagatcaggtgccatcatgaataaagcaagtgtctgaaaagaagtataagcaacgacatctatgacagagattagaaacaaatcaattagtggagataagatctatatgagtgaataatcagaattaattacaaatgaagcgctaaaaataattacaatgatacaaaattaagcttatgtgtttgctagaaactcttagtatcatttacatatgtttttaaatgtaatccttataatcaggctatgaattgttaatattaaacccattttataagaaagaaaactgaggccagagttaagaatgagctgactccagggccgggcgtgggggctcatgcctgtaatcctagcactttgggaggccaaggcaggcagatcacctgaggtgaggagttcaagactagactgaacaacatggagaaaccctgtctctactaaaaattaaaaaaattagctgggcgtgctggtgtgcatctgtaatcccagctactctggaggctgaggcaggagaatcgcttgaacccgggaggcggagtttgcagtaagctgagattgcaccactgcactccagcctgggtgacagaacaaaactccacaaaaaaacaaaacaaaacaaaaaaaaaacctttctgtactctggccataattaccttatgagacattatgcgttgaagggctttgtaaactaaagagacacttttggttaataaaaacttatttttatttcttaaaagttgccttcctttcataaaatttaattaataataaaaatacactgagcatccaaaagaaaaatgaagaggtgttttcatttatattcccaaccaaacatacacatgggaagccatatggtttcaaccacgagtctttagtccaaaccatctgttagcaaatttccttcagctaagaggaaagagaaagactttccatggagaatataatccacctttagagaacaagagccacagattggcttgaatgttaaatctctatgtaaggtgtcattttaagttaaacgttgatttatatttggaataaataaaccaatataagagccatttagataaactcacactttttagcacgaaggcacttacgattgattattattgtctattttcattgttggtacttgtttcttcaaagatgtacagatgtatttcagttggatcagttttgagacaaactgtaaccatttaagccttcagagaggtgacgtatgtttttatctgcataaccatcaggaaagtggttatacaaaacatgttctcattgaaatttttagtagcagtctccccagtgtattgatgagctttgtttgagtgacagcccactctaggatatgtgtttgagggacactctagacttcagaccttcctgctttactcagtttgaaatatgtcaacaatgacagctttttacttcagcattttgtagactcagtattatctcattgaattgaaaagtaatagctctattttaataaatttctcctctttgatttgcaggaggtttatatctcagcaagaatgaaactttgtcatgccacacccttcttcaaaaactaataacttgattagatgacaatttgaacaataagaaaatgttgccatggtaatcatttctttcttgcagccataagaggataattttgatttacagcatcctacgagacatttctacatgcataacagttttttttttattttttgctgtttttacagaatatttgtacagtctctagcagtagctgttttttctctcatagtagtaaacaaatgtttacaagttctatataaacaggtaaaataagaattgttgacacttggatgataaactcttattatcggagcaacattagaagctttaaatgaatagttcacatagaagtaagttgctcagcacatattgcttttatacgtattgttttagatctcatactaatggatctccaattggacgtgaagagcttccaaccctgagtgagagacaagggctgcattttccaagtgtttaacttattacattgccagatttttttgtctggcccctctttcctctcccactacataccttcatgtgctgacttttaaaacacaaggggttgatcacctattatcataattcatatgccccaattttacccatgttctctggtctctaactcaactgccatggtcttaaatcaagctctcttttagtttatagtaatttatttttaaaaaatacatttcagcttctaatgctatgtcctaaaatatataaatgatacactaaaaaaaataactctattgtacataaaaaataaaacgatttggcattcctaaaattcagtcattcaacattattcttactactccctacagagatcctatgatctcagtagttttgaacactgcagattcttacagtctttatttatttttaacatcgcctgccctaggttatttttctatcagagggaaaaacaagtagatttttcataagggctcagatattaacaattatctttccaactgatatatcacggtagcagtaaatgttcaaagagaaaatgttttccttataaagcttcaaattaagccaagatgtttatttactatacacataaaataaaaaataggaatattctactataaagtcagtgtaaatgaccttaacaaaattaatggcactgaacattttataagagcctggagaatcgtcctcatcaccatctgtctgattccacatggtgctctgagatgttcaccggaatgtatattggcagcaccaaagagcgacgtctctatgcctccggctggctcccgcaaatgcagagtgactgtcacctggggagagcaccggcttagctggaggacttagggcctgtcatttctgctctagtctccttctgcacatttaagaactctagacttaagactcagaaatagttttgggggctcactcaaaaatatcttacaggatgcccaattattcatggtctcctcacagtgaaagtagcatttgactaggccagtttatattactttgcatagaatctgtaattcaggccagcaacttaaaaatgtggaaagaaatgggaaaaagtcttaaagtcgttatatattttagaaacatatatagttatagttaaacataatgtatttaaatatttatgtaaaatataataattaaatcttcaagttttatttgtcattccctagatttagaaaaccatgagatatgatttgaatgatgagtccccacagaaagtttctttttgattatagttcattagtgatttcaggataagtacattccaatacagtaaatatggatgatataagtatgtattatgtaatttatggacatattttattacttttatatatattacctatgtattcagaataagagaatagtgtcattaaaactttaatactatgtatactaaatataatttatatatcaaagtaaatatatacaataaataagtgtatttacataaatacataaatataagtattaataaattaatatttaatattaaggctttattaaatattagtatattatacagttttaaatacacagttatacagtgtttagtatttgtttaccatagtacgatatataaaaggaaataagttcaagtatttcctcaggagtttaggcatttttaaagagcagaaatattaaattatctggttgagaattgctgtgatagtttaacattgtaattaacctatcaataactccatttgatgtagtcactcaaaaatttaattctcttagaatatgtgcagtgcaatttcaccctatatgctattcagatattttgcagacgcaaaattgagagaactgagtttaagattgtgataaaaaccttctgtgcagctgttcatgcccattttgaaaatacctagctgcaagacacttgggagaagtaaaatttaacacgtgatgctataatacgtgcgttaagacttcaatttcacagatcatgaattattaagttatatatatccttaaagaaatcacggcatatcacctcgagtcctgaaatcacagacattaacatgcactgagaagactatgtaggttatttaaagtcgtgctattatttttatttatataacctcacctgaatatatgagactacttttagtatgttcctcatcatagtacattacttacaggtatctgtaaatgtggaaaaggtaacaatctaatattatattctatagtgtaaactttaatgtttatagggaactatgagataataataaaacaggaagggtgatcacatatgcaatgttttatggtaagcacgtttttatgtattacataatttaagtgtcacaaaatctttaggagggaattattactttgctgaagaaatgagaaaagtgagggttggaatttcagccagcacatcttgtttatttagctgataaatatattaaggtgtctgatttcaaagcccacattgttctttgtacattaattcactgttttcacttttgacctttaggagagctttaaggagataatattcattcagataccacaagttgaaaaggaaaatgagaagtacttcacacttcgctaatatttgagcttaccttatatatctaatatgaattcctatgtaaaagattcaaaagggcaatgtaatataaagcagattaaaaaacagaacgtggtgtaattctatttttttaaataaaagaaacatagaaaaagaccggcagtgttgcaggatatactgtcttcacctttgttgacgtgtaaacccccctttggttactgaatctctaccattgtaacaacgcggttgtatttttatttttaaaatttgtgttctaataatgctctacaatgagaatagttctttctttaaagagaaaaacaatcacaaaagcccagcagaggttgcagcccatgcacacttctctggaaccatcctgcctgcccacaccggccgagggtgacctcacgccccttccttgtttaccagagcacaggcccgtagtcatggggacttggcccaaatagggcaaggcttccattaaccgtaagtcatgaatttgaattattttaaaaaatccttaaggattacttcttggagaactttagctatgatgcacacagtaatatgaagcccttagtgatgaaagccagagctggttggatgccactgggccacggcagccactgggcatcatggcaagtgcagggggaggaagagggagtgtctcagagggaggcagctcccgcagaggggagggcatgggcatcctcacaggcgccccgagaaggggcagactcacagaaagaagtgtaggcaccctgcagatcacgtcacagctcatgagagccatacggaaaagtgaccagcgcctacagccaaattattagtggcttcctagttttggcacacgtgtccgagccaagaactctcatctctctctttcttaagtggttctagtaacccaaataatctaagtttttttaaaaagattattcaaaacgaagacaggcaggaaaaaataagagaaggaataaaaagagtaggaatgagaaacaaaagaagaataaaagataaagaagggaaggaggatagagaaaagggaaagaaaaagataaaatagaattctaacctttgcttcaaggaattccaagccttggggaacagacagttatcgacacaagaggagtgagaagtcgggggaagaaggggtgtgcagaggagacacctcaggcatgacgtgagcaaagacagaaagaacccgggatgttcgcaggacgcaggggaacttgcttgtaaaggggaacagcttcaactgagaaacaagaaaatccaggtcagttactgaggcaaaggtcaaaccatgaagaccctttctgaataagatgcttaatggaaagcagagactcttacttaatattattttctttcactgatgcattcagctgacattcagatacagcgtcctccattatttatatgtgtatttagttacatatagttattgttggaaattttatatataagggctttctcccttaaaatatcaaccatacaatattattgggaaaatttaatgacatggaatacacaatacacctagcattgctcaataaagacaacgttacagcaaatatcagctcctcatctttttctcctgtaaacagtttagactaaattatttcagtgttttctttcaactttaatataccatgagtcaatctctatgattcctatactcaggattattttatcaaggaatgttataatacacaagtttataagagattacggagatagaaaagaccacatgatcggcacagaaagaataaaggtaaaacactatatgccaaaagaaacacacacctttcatttcaaaaagacagattacttgcacagtataaggaaaggctaaaagacataacttcggtccgtcagaaacacagggtttgatgtctccacaaacaaaactagttgtacaggaaatcgtgccttttcacttagaaaaaagtagattcaaaattttcttgtcacagtgtttgtttgttgcctacagtcttattgaattatatttaaaaactggcaaaaaatgttgacgtatatttgaacaggccccagagttttatttgtaaaaagaaaacatttcaaatgattacttttctacattagagatcaaaatccccatggaaataacactttaaaagagaaatagaaagttaattgtagccagttttatttagttattcaacatccagtcagtgaaatattgactgaatgcctggtacaggcaggctctccgtcagctcctgggagggagaaattaatagctagatgggggagcatcagattttggatagggtcacagttggactctgatgcaaaatgacatttaagctgaaatggaaaagatgggcaggaattacctaaggtaagagtgaatttaaaaaccctcttgcccagtaaacagcagaagccaagccctcaggaaggaacgagactggagtattcaaagatccgaaaaaagatgaattggcccaaaccactgaaacttgagaacaagaaagaagaaaaggagaaagcatgaaagatgcttagatgagaaggtccaatttatatgttaaacagttcatcgtcgctactcctacagacccaggcaaagccaattagaggaagaaggagaggaggatgttgaagtcattcagacagaagggtgaagtgttgggctggcatgctgagtgagggttgaagggcagcagacagatttcattgcgttcgagaaaaaatgtgagagaaatgtgtgagtggtttgcttccaagaattgagggaaatggagttgcctctctgaagccactgagccaacggtggtagcactcaccatggtggctaaagcaatagaagaacacatcacgatttggaaggtcaagagttccattgctgatctcagatccccacaggcaaccaagaggaaacctcagttggtctgttggttatatgcatgtgtgtctggattagagagccgagatctcttagagaaacatggtattcactttcttccaagagatgagactgaaaagcatgggaatcattgatgtgacctagaatgggactcagcaccatgttgaacccttgaaaacgcaatcatgcttctttgctcgtgccgctccttccacccaaaatactcttcagccaggtcttcctgtcacagcctgctcagcacacaggtatcagctcagatgtcatctgcaaaatggccctccctgtgcaccctggctaaaccggcaggactccttccccttctctatctacctgctttatgttgctatgtggacagcacgtaacacgatcacaaactgtatccttcgtcgactcagcacccttccaactatcatgtaggcccatggtagcagcggattttctgtctggtttattgttctcattctgagtctgcacagagactgtcacacagtaagaaagcaacacgtgaggtagtcagtgactggagtagcaaagaagccagcccgtggctgagcctggagcgttgtgaacattttgaggtcaagaataggcagataaaacaacacagaggctgaggagcaggcagataggccgggaatagcttaggggattccagataggaaaatgttccaaaatagaaaggtttgcaaacagtttgaaatgacgctaagaagccaaatcggtagaagacagggaaggatccatcggttttgcaacactgaagatcactggtgattttagccagtccagctcaggtggaataatggaagattgaagtcgtcagacggagggaagaaattttactgttcgagaaaaactctctgagaatagcatttgattaaataaagcgctctcaaaggatttatcttgaagtaaactgggatttctctgccttaggcactaacaggtcaacaagtgacttgacattcttaatttatctttaaaacgtgaattcccccctggtccaaagataacctgactttatgcagagtagactgacgaagcaaaaccccccagatcactgcctctttgtatgttaacaaatttcaacatagtagcctcaagttacacattgtacacttagaaattactgattctctaaccataggttaactcatcattcaatcagcattatttacataagaaagtaattgtttttttctcttcagattttgttattgttgcttttattaccagaataaaattgagcaaacattttctttaacattcctgctagagaaaagggatttattttaaaaaattcaaagagctatagcaaaggcagaactactttggcaataattttagaaaatgcaatcatttctagggctgggctttaaccatttgataatgcatcttaaatcaacagtgttggttggaggcattcttccatctcataggtaaagccccgttcgccttcttggaccttcagccctgacacccccccatccccacttaatcctcaatgacttattgaatcaaaattaaagactacccctgggatatgtccatgttataggagattattttttaatgagaaaaacaccaaaagtgcctacatatatctcattaacatgtcatgataaaaccttagattgtgatgggcgttgaagatgagtattggttagaacaagtgggatgtctggcttcttttttaaaaaattgcataaagatgatgattctggatttactacctaaatgtaatgctaattctcctgaaagaattcctttacatttaaaaaataattaaataactgtcaccctaatgattcatccatcagtactatttaggcacaggaatgacttcagttaaaaagatgaccacaccaatgtccttgccaagttttgctgcccttgttttgtttttggcagtctccatttgctttcctgtttcaggtgcaaagacatctgtgtctattggttccccttcagagattatgttcctggttagtgatcctgttttaagaaggaagttctctgagaatggcagacaacaaaatgaagcaaggggcttcaaaattataatgatcatttcagaagtataaattacactttaataacactttgaaaagtgggtgctctcgcacctgagagatatgtttcctcagtgagtgtcctactaactgatacttttagtgttagagtctgccctgttgactcccaacactaatttattaaatagttgctgacgtcattgttttaacatttatttctctaactttatgttaccaagaatttatagacagtaaatcattaaacatcatatatgatgaacacaccttttctcacagaactcaaataaaacataacttaaaatgtctacattggatataacataaattactctgacactgagaagtaccacataaaattatgtggaaaatgcatactcagaagtgcatcgtgtcatacataagactcagaggtgcactgtgtcaaaggtgtctttggtcctgccatattttcttgagactgacaagtttgcaaactaggcaagacttcacagtgaatggttgctactcccggcaggataatgcaaataatatctaacatatgtataatacaagtctgttcccaatttagaagtcaaatacagatgcaatggcatcagaatacaatggacaattgtattagtggtgcacgcacgtcaaaagttcatttcatttttagctacttaaattttcatcttaatttgaaaggataaattaatatttcctaatttaaaaaatgttaatgacatatttttcaatcttaagacatgaaaatagtgtatataaatctgaaaacattcaatgatccttcaattaaaaatggaaatgtcatgtaaacactgatttcccttcagcaaccccataggcattgctttataatcagatattacttctcaagtatccacttgatgcatagcttgtaaccagctatgaagtgttaaatatcaggctgtgaacatcatagacacagagaagaaacctgacgtatgtattcaaaactatttaaaatgcatagggcataaaatacataaaatatatcattccatttcaagtggattcagtatgaaacatgaagatgaatatgcatgacccttatataaaatgtctgtaaatgttttatctgggattactgtcagtgaaataaagggctgactcagcacatctgggtagggggtggtggggggagggggccgtgccctgcccgttagaagtttggttcttgacctgatgctgggaagtagcctctaaacccttggaatgtcctagcttatgagagtgtcttcgtttacctggggaccttaggccacagcagatagtctatgtgttcacgtgattaatggtgggggcctttggccacttggtccagccacatggtattggagcacccctctggtaggactgaagactaaggtcagcaatgtgggtggacagcatgcctgtgtgacactctgtgacaaactccagttaaacttctataggcaccgaggctcaggagagcttctgtggtctgcaatcctctgtgcgtggggtcacacgtcattcctgggagaattaatgctgtcggcacaactctactgggagtggacaaccgcaagtttgaacctgctgtctcccggactctgcccatgtacctcttcccttttttgcctttaaactgtctcttttcactgtcacaagccatagccatgcacataatgaccttcctgagctctgtgcagccttctatcaaattacttaactcgagagtggtactggggacacctcaaactgcacatccaacaaatgaaatgaaaggtgtgattagaactgtgctgcctactcagcctttctggattgagccatgattaaggcacacagtttgattgcttacccattagtgaatacagccatgcatcatgtgtcctgagaaatgcttccttaggcgattcttgacgttttgcaaacatcacacagtgcactgtgcacttgcccaatcctagatagtagagcctgctgggctatagggtacagccgcttgctcctaggctacaaactcacaccacatgtgactgtactgaataatgcaggcaactctaacacaatggtaagaaatttgtgtatctaaacctaactaaacattgaaaaactaaggtaaaaacactgtttaatgataaaaaaaaaaatgggatgcctatataagatacttactataaacagagcttgtgggccttgacgttgctctgggtgactcagtaagtggacggtgagtgcgtgtgaaggccaaggacatggctgtgcactgctgtagaaacactgtagccaggtgcagtggctcacgcctgtaatcccagcactttcagaatcctaggtgggtggatcatgaggtcaggtgttcaagaccagcccggccaagatggcaaaaccccatctctactaaaaatacaaaaattagccaggcaaagtggtgcacacctgtaatcccagctactcgggaggctgaggcaggagaatcacttgaacccggttgaacctgggagatggagcttgcagtgagccgagagtgcaccactacactccagcctgggcaatggagcaagactccatctcttttttttttttttttttgagacagaaactcgctctgtcacccaggctggagtgcagtggcgcgatctcagctcactgcaagctacacatcccaggttcacgccattctcctgcgtcaacctcctgagtagctgggactacaggcgccagccaccatgcctggctattttttgtattttttagtagagacggggattcactgtgttagccaggatggtctcaatctcctgacctcgtgatctgcccgcctcggcctcccgaagtgctgggattacaggtatgaacctctgcgcccagctgcttccatctcaaaaaaaaaaaaaaaaaaaaaagaaagaaagaaagaaaaaaaaaatgagacactgcacacttaggttactctacatttgtaacacaaaatattttcttcagtaataaattagctttaacttcctgtaagctgacttagtttactttttggctttataaacttctatttagcttttggctcttttgtaataacacttagcttgaaacacaaacacattgaacagctgtacaaaaatattttcagtcttaatatccttactctataagctttttctattttattatttttttgtactttttgaagttttgtgttaagaactaaggcagaaacacacacattagcctaggcctacaacacagggtcagaataatcaacatgacttcttccatctttgcatcttgtcccattggaaggtcttcaggagcagtaacaggcgtggaactgtcattttctaggacaacgatgccttcttctggaatccctcctgaaggccctgcctgaggctgttgtacaggccgggattacaggcatgcgccaccacgcctggctaatttttggatttttagtagagatgagggttctccatgttggctaggctggtctcagactcctgacctcaggtgatccgcccgcctcagcctcccacagtggtaggattacaggtgtgagccacctctcctgtccctggaagtaaaatctttaggagtctatctaagccagtcaaaccccttttacttaacctaccatctgttcctgaggaatgtacatgtaactttatgctggtcatgaaacggaatgtgaaaaacatcttttcaggaaatgttttctcccaccctacaaaacaaatcatgacgcagagatgctcttctccctagtcttgatcctgtggagaggtgaagcctggagccacgctcttgtgaccatcttgggagcagctggctcagcgaggatggcagggagtaaggcagagaggttctcctgacacttccacactttgagtttcatacgatcatatcttttctttattttttgctatatgagtttaaatgtcccttccaagactcatgttgagatatatagattttgttgccattgtgaggtaactaggtcatgagttctctgccctcatgaatgaattagtatcattattgagatgatggattgctataaatgcgaatttgtctctctctctctttctctctgcttgttgcccatctgccttccaccatggaataacgatgcagaaagaaaaccctcgccagaatcaggatcctcatgcttgaacttcccagactccaaaactatagaaaataaatttccttcctttataaattatcccgtttgtgctattctgttatagcaacacaaaattaactaggacaattgtttaacacagtttttaagctgtgtgacatattctaacttttactaggtaatttgtaatcagaataatccttacctaaaaacaggttgtctcacttgctagttgtgtatgcttgggggagtttcataaacaatctatgtctaagatcctttatctgtagaatgtggattcttatgagtttgggcaacataaagacctgaattcaaatgtctaaccaccttattaacttaaataaattaaataatgtatttgaatctattttctaacatttgataaggtaatatgacctaccatagcttcagaattgttcttctttgactataataaaatatacaaaactacctgacaagaagtatacaagaaatagtttgcttttttcctattttttaatactttagtaaaatattgactactattttgttacctagtatatactgggtgctactgttggcactattaaagtctatgattcaatccccccaacaatcatatgaaacaggatgacaactgaattacctctggcatacaggtgttaagtagggatatggtttggctgtgtccccacccaaatctcatcttgaattgtagctcccataattcccacatcttgggagggacccagtgggaagtaattgaatcttgggggccagtatttcttgtgctgttcctatggtagtgaataagtctcacaagatctgatggttttctacagagcagttcccctgcccacactctcttgattgccgccatgtaagacatgactttggttctccttcaccttctgccatgattgtgaggcctcctcagttatgtggaaccatgagtccattaaacctatttttcattataaattacgcagtctcaggtatgtccttataggagcatggcttttctaaccacacacagctatcaaatcaaggagctcagatttaaacccaagcaggttgagtcttaaacgtaagatctcctgcccctcactgatgtttccttccaatattttacttcaaacccagttcagcaagtcttggagttcagaactgggctttaaaacattggtagaaaaaattctatagataaataaataacatgtacaccataagcaatttacatagaaaatgtgtcatccatttacagtcagtttttccaaattgtctaaaacccagtgttagcttcagtgtgtcccaagaggctgtagccaggtatcagttattggtttgatgctgagagaaaggtcctagttttgcccaccgcaactgcacccctccaaaaaaaaaaacactgcctctgaaattctgaaacctggagacgtgatgataatgatgacaagattcctaaatatatttggtaattcaggagtagcagagattacagaggggatgcttgtccctgcctgcaaagtgcaatctggaaagggtcagaatgtgctacctttctcctgcccagtcatgtggaggagcaggtgaaacatgggcaagatgtacctagaaagaacggttctgtggaccagaaagtcgacacatgggcaaaaggcttgtggtcagaatacagaatgtagctgtgaactcaaaggacccacagaccaaacataccaagagagaaaccagcatgcataggtgactctgagactcctccctctctccttcctcacaccttgtctccaggaagataccctggaatataaagataaaactacaagaaaaatggggtagggaaaagtgaagaagggactccgaatagcctgatatttattttctgtctctcagcagtatgggaattcagaaattatttcaaataagagaaaggcagtgttgcattcttaactccctgaagttgtgagtgaatatttgtccccaatatccttctttcattttccacttagcattacgttcagcctactctcaacttccacaaattggaaaaatgcaaaggacttcattctagcaaaagattttcgcagctctactttaagccttgcagtaaaggccgctcaattcaagaggacagagtaagtcagaaagtaaagacacaggccttgaggtctctctgttggactagtccattgacaatgaaatttctatgaaataggttgctatttgaataatatactttattattactatttttgcttggggtgttgtttcattaagagaatcaggaaagtttggagtttaagaggaaaaagagagaatgaaagtgaatgagtgagggttcatcaaaattcccagaaatcatttcaccaacttatgctgaaaaaacatccttgataaatcagtctatgacctgaattgtctaactgagcatgaaaataaggacagagcactaaatgacagtaaaagacacagataacataataggatggatcagaagacctgacttcctgcctcaaccagaccatccagaagatatattacctagtttaaatcttaaaatcaattaatgattctaaatcccaattccctcatttgaacactgtatcaaaacataagtggaatgatgtatgtaaaccctaaggcactacgtaaacatcaacatctttgatttctcaatgatttttcttttgcatttattcactaatatatacatcttgttattcttcataatcttctaactactcatcctattttggttcagggcaatggacctaaagcaaaaatctaatcatattatttattttatcagctggaaaaatatgtgatatgttcagagaatatttgttatcttctttgtgttttgctaaccctagttaaaagccagataagaagagaaaatatttatcttgttcactattttatggctagcatctaatagtggttgggatatagtaggtgctcaataaatgtttgtcggagaaatgaattaatgcatgcattaatctaattgcataagaagcagcaacttattttaaaaattgaaggctctcccatgtagaggtccttttttccacctgtcccactttttcttgcgtaagacttcgctctgagaaaacttaatgcttgaagctggtgcagggatattgcagtcatgtggggaggcatcaatgtgctgagaattgattaaataaataaataaagatcaaataaattcactgaggtaatgagcctgttttggaacatttagtctccaggtttcatgttcacaaccaagattttatgagataattaaatatccatttgtagtttattgaaggcattgtcaaatattcaattatatcttctcaaaactatggtacattgtaaagaccagagaccatctttcctatgtcctcggactccttcctcaactctggaaatagttgctcagttttgtctaatcagttaatggaaaattgtgtaggttatctcagaaaaatgtggaagcataaactcatttttttccactggattggacaagagaaaatatattttctctgaaccactacaaaatcaaaggtggtctctgagacctcagtcgtcctgctacgtaaattagatattcctttgattgtcgctacaatgtttgataagaaaaaggagagtgtgtgtctataaaccagttgtgtagaaaccatgttgtccctgaaaaacattcattgtacaggaagtgagacattcacagcccctgtgtggggaagagacggcctcacagagggatggaaagaccagagcagggccttagtccatggaatcttacctcactacttttttttttattgttaatgatgtcagtatccaatatgtggcattaatcatggtttgccagctttgtctttatttgtgagggaaagcaaaaggcgacaaaatcgtatgttaaataagctttagaaaatataccatcattttaaatcctctattttgtgttccttttttcctttttttttttttttttttttttgtgaataatgtcctcaaaagttgtaatgattcaggactctgagaaagccttaagaaagttagactgaagttattgcagaaggtgctcagacagaccggttctctgaatctgcacatgtaacatgcaatgggtgatcacttgactggggtacattgccttttccagactttccacttggctgcttctctgtgactcatgggtccctgagcaaatccaggggagtaagtggcagtgattcccagcctcctgtgcaggtggagaacgggtgagtcactagcaatggaaccaacaatccccaagtggagcccttcatttgccaccttcgctaacgtcagactgagcagatcttagaagcagaaataaaaattgggttcttcttataacccacatcactcctactttatcagtaagtggtttttagctgaaagaacaggtaaacacttaaagtataactcggtctcttgggcaaacttcattatttcagcacacagaaagggagtgtatgaaagtcagaacatcctttcagaaatcatgatttatgcttcttatgtctcaagaggttatcacaagatttctgagagaataccagcatttatagtcacgtaggaatttcaaatacagcttttgccccaacagagggggccaggagctcagaacaggctgcaggctaaatggaaatgtttgggaccaggattctccctgctaccactcggtacccaaccactcactacctcctggttctcaaaaaaccatctgttgtgacctttgtcgatctcttccctcaaacctaccataacgtcctattattggtacagctaacttcatataaggtttcgctacataggcaatgtgtggaaactaattctgattaaggttagcaaaaaacacaagcactgagtgaatccctgacacagatggggagagagcagcaatcctaagagattagcagccccagaagctaggtttccccctcaccacatctgcaaaccttgatcacctggaacttctacttcgatggatacactgagggcaaaggatacagcagatacagcctacagccactcaaaatggaaactggaaactcacacaaatagacaaagatatgatacacaaatatataatatttatacataatatataatatatagaagatgatgtatataaaaatatgtattaaatggtgaaacccccaagaagtcacatacactcttaaggacttgactaatagtaaattcactgtgaaaaagagatcagaaagagtgaaaagaacttgctctttcccaccttggtgctgtggggagaaagaagaaatcaccgcaaagaatttataaccttaagtccactttcccatgagtttataacctaaatttatgatacctatatggctctaaagacctctaaaattcaagagatattcccaagtagtgacccaagcaaacacaaatcctctctggagaaaaactgcctttatccaggtcttcaagtgtctccaaagataaagttccaaggaacagaagtttgcataaaggatgaaaagcaattcacaaaccaaacgagaaaacctggcatcgtgagtggaagtaggcaggttaacggacggtcgatggagagatttcacaactgggcttataggaaagaggatacaaaagaagtatatttaacatatatctattagtaaaagaaagactagaaaacacgagtatggaacaagaaggcaataaacgcatttcatgcagagtatgtatatgaatccagtagaacccccagagatgaaattatacatccatatttgtgtatgtgtatatctatatatagattatacatatatatagattatacatacacacacatatatatataatgtaactttctgaagataaaaccactaatagttaaaataaaaaaatacaaattaggaaattcaggacacagaattaataaattaaaaaaaatagatgtaagaaatttttcaaaatgcagcacagaggaggaaaaaatcctgtgcatgtgagtgtcgacggcacgggagagggagagagacaggcatgcagcttgtcaggatttcaaaagacaatttaacagtcagggaaaaaccatgtgtaaagatattataagtgagagccacatccaggaagctcagggaaaaccaatcaggataatgaaaatggtgaccatattgtggtgaaacagcagaacaaagacaaagagaagattccaaaagtagccaaagagaactggatggaaaggagggacgggcaaagaaagaggtgaaaaaaaatgagagaaaaagcagaatcactgaagaaatggggtttacaagctgatgacagacctccagagtccctgagtgccttatcagaaatgcctcctctgggccggacgccgtggctcacgcctgtaatcctagcactttgggaggccgaggtaggcggatcacaaggtcaggagatcgaaaccatcctggctaacacagtgaaatccagtctctactaaaaatacaaaaattggccgggcgtggtggcgggcgcctgtagtcccaactacccgggcggctgaggcaggagaatggcgtgaacccgggaggtggagcttgcagtgagccgagatcgcgccactgcaccccagcctgggcgacagcgtgagactccgtctcaaaaaaaaaaaaaaaaaaaaaaggaaatgcctcctctgccttttccagctacttaatcacctcctagagtcattgttcacccaccagtaatacagagaaggggaggaatcaaaccacagggttaagttaattaagctacctattatgttaattagcttaatgaattagttaatacacttgatttgatttgctatctgggcaagagatgaacaaaacctaaagggatttgtgtatttagttggatgaaatgtggtagataggacaattctaacagaagagaacacggtgaattcatcgctgttgtttcaaaaacaactggaaacaaacatttgaaacacaaggaatcaaagcttccaacttttatctttaagaaagtgctccagggcagcccttctacaccagaaacatcaccatcacctgggaagttgttatcaatgcaaattttcaaaatgttaggcccccaatgtagacttactgaatcagaaactctaggggcggggctcagaaatctatttcaataaactccccaggtcgttgaggtgacactaacagttgagaaccattgctgttagagaatttaaacaacaacactgcctgtgatcaattttgctgaaagcataggtcttagaggcaaatggccttgtgtcatgtctggctctaaaatcagcaggtgcgagtgagaccctggagaagccctggaagcctcgcatttacagtttcctcaccttaaaataggcacggtagaaagaaaagagagcaactctatgtgctccttggacatcaaggcttttgctctgattagcaaaaagaagatggggaagatgatgaaagagggtgagaaagctaaaaatggaaaggtaggagattgaatctgaaggattgcagagctgtgaaaggaatgaacgggataagagatggctgtgccagacccctattaccttcagtaaagagggcagcaggttcaagtggctgaagaagagacccagagccagtgaatgagttacagggtttatttgtggggcctgtcaggggggtgcagtgccagcagacagaattgcagaatcacaatcgcttgtagaaagcgtgcagtttatacagcatttccacttaacatcctccctccaggaaccccgatgtggtaaccttcgtttcctaagagattgctgttgggtgcatctgccatgcagtgattagacaaaacactggtagaattgcccacattttccctggaaattccagggttacggatcactaaggctttaaatgaaaaaaaaaaaaaaaaaaaaaaaaagtcaattgttctttcaaactcgcatttcttcctttctgtcctctactcctcatctgcctcatgaagatccagcagccttcttaccatcttgaattgcacaacttctgtcctgaagcctgctaaggccatgttcaaagccaaatcaggatgagtaacataagatcaaatcaccatttcactcccttacttcactgagtcctgggccatgcaagaaaccaatgcacagtccaaagaagacctctctagaccaaccatgcagtaagtgttcatacacttgtctcaggaagccataacacaatgaacacaaatgtgttctcccagcagctgcaattaaaaccttctgagcaaagacctatcctaattgagaaaaatgctgtgattagccagattggggttgaagctcggcttcgggtgtctgggtaccttctggtctcagaggaaggggaaagacagcaaaccttaaagcagacatttactaactgaaaatgggacagtggaagaaatggggaaggggaaggaaggggaggatgtgtggtcagaggtgaagctgcaggagagatcatgggaagtgtcagtcttctgcaagggatcatgggaagagtcagccttctgcaagggatcatgggaagagtcggccttctgcatttgtagaaatcacagggagccactgctacagcagagactacggcattgcctttgaaagaactttacttggctctgcaaggaacatggaagctgctggcatctggaggcaaaagttaggttattataagaaaaggtgagaaaaacagaaaacataccaaaacaaagctgtctattcaaatgacactgggctacaagaagaatcactccattgtttaaataatgtttttatatacatagggcaaattacatatgaatactataattttctaaatgtttcccctttaactcttgaatattctattatcaacagtatcataaaataattaaatttagaaaaaaactagctataattgtatttatcgcaatttctgttatagcattaacaaaaactagaaatattctaaattcccaaccaaaaaaaaaaagattaagtgaattgtggcagagttacaaaatagaaaactcttcagccgagaaaaccttttgaagaatgcttattaacactgaaaaattcacaatatataaaatgaaaaaggtgaacaaaaatagtgatacattattttatcatatttgaataaaaattacagcacatgtacatagaaaaagaaacgtgatatgctgagatgttaactgtaatttttctcagttgtaaaagtatgaaatatactaaatatactaaaatatagaagatattaaaacattgaatatttttatatgtattttccaacttttttctatgcatgcattgctttgtaataagaaattaccatacaatctactttaactcaaaattaagaaccttgtttgtaaataagggaaaatcgcacctattataataatcatttccttctgaaatgtaaataaaaatctggcggtgtcatctgtagcattccaagggaaaggaccatttcacaatgcatgagcttgtttcccctgattctcagtaggaccgcccaaagtagcagtcagggaaccactaaaaatgagtaactttcttggttcctgccaaagccgtgctcagagggccaagacttgcattgtttcacacctcattagccctccttctaaacagcgctttcgacctggctccggtgcctcctctgaggctggaaagaacgttttcatggataaccaccaggggcatccgtccttcctcattgttccagccctgtcttgcttcccctgcctcctcccacccgctggctgcttgcctctctggctgaatttgggtcacacgagcctgttcctctagttttgatgagtaggcttaggtagggcagatacaaaaaaaatttaaaacctcaacaatgatgcatcatcctctctataactattcccaaattcaagggccagatacgcatttttgaaacatctcagcagctctttcctgccacttctggtgcttcttgcgtgtcagctcaggttttcttttgtgaagtggagagtccagcccttgtcatggcaatgaaaatcccaggaaggaataaatcataggaatgtaagcttgtaggggtggatggtcctccggtgcaactcaagttcaagaggcacatgtgaaaacctgcactctttaaaaatatctatgctgtgaaacttcagcaagggatgagtaacaactcagataaaaggagaccagggtggcagaaccacccaatgtcatgtgtgagcctgggttgtatccttggccaggagagaggtaaatatggcagagagagaaatatcacgtaaagtgaaatacagcatagaaagaaatataaagagaaatagaacacaaagagaaaaacagcataaagagaaatacagtacatagagaaatacagcatagagaaaaatacagcataaaaagaaatatagcacagagagaagtatatcagagaaatatagcataaagagaaatatagtatagagacaaatacagcataaagagaaatacggcataaagaaaaacacagcatgttggaaccactggcaacatttgaaatgtggtatgctgccatgtgattaaagcattcaaacaaattttgtgaatttgaaagttttagtacagttattgtaagacattgattttctttggagaaaacaaacgttaaagtattgattggagggagacacagagagtgagacagagagaaagagtgagagaaagagagagagatattgaaaagtaaatatggcaaatgtataatgttggtgaatctgagaaggcactttgtaccttttctaactattcttgtaactgttctgtgtaagtttggaattacttcaaaacaaattactctgtttgttttgtttgtaagagacatgtgccacttcataaagcagtgatgcttgctgtaaacagcaggatttttcgaggaggcagaacagattcttatttcttgtgcagctaatcaatgaaccagatctacctgcatggttggagatggaggacagatggatggatgtgttctagctgcaggaaggaggtgtctcctaaaaacagaacctaccactttactatggccccagattaagttagatacttctctaccatatcttaaaaatgtacatatgtgtatattactcttctcaccatatactagagacatgattttacttttactttgctattccccaaattattttcctcttttctctagagtaatatatttcaaatctgccctacaaattgccttgctgaaataatagttgttgctatattgaacaatattttggtcatgacagagaaattttcaaattaagactttgtgagactgacatgctgcctgctgcactaatgatgcaactcaaattgagattttaatactggagtacctacattttcagggacaagatggctctaacacagtggagtgactgctgagattttggacctgttgaaaagttgttgtacgatttactttttctttgatttcagagcacagaaaattgttttggaactttgttttgattttagaacagatttaatgactttcccaagaacgagtttctctagagcataacaggacaaactgaccttactttgaaacatacggctataccaaatcctataaaaatggtctaaaaagtgcctgatcatttacagaagttacatggctcatgtctgtgcacctgagacataaagtaagcagtatgcattgtatttaaaacctatctttacgcggcacccctctcagaacatgacatttctctttactgtcttatgttatgttgttaccaagtgtgactcagttcagcagtttctggtagctagtgttttctatttaaatgaccaagtgtaacaacagctatttttttttctttaacagaacccgtaatgtacccagccctgtgcatggtgtttgagattctctttgcgtccagcttttaaggtatgtactgtccaaggtcacagagttcatcaatggaagaacaagatttaaagcccagggttttttctggtctttctctagcactctgtcttactcagtgattcagtagcaatactgtaccattcagtttacaatgcaacctttatttagtctgtgaaaacaacttttcggcaatggcaggtttgtactgataccataagtcttccgatattttccctgctttatatattcttctgtaacataaaaccaacctggaacttaatattactatgtgagaaccaagaaaaaaacatgaaactcttacaaatctacctgcattaaattgactgttagaagaaatctaaatgtccgcttttacactgatattaaaattcatctgtattagttcgttttcacactgctataaataactgcctgagactgggtaatttatcaagaggctgaattgactcacagttcatcatggctggggaggcctcaggaaatttacaatcatggtggaaagcaaaggggaagcaaggcaccttcttcacaaggtggcaggaaggagaagtgctgtgcaaagtggggagagcctcttataaaaccagtagatcttatgagaacttactcaccatcatgagaacagcacggagaaaccacccccatgattccattacctccacctggtctctgccttgacacatgaggattatcgggattataattcaagatgagatttgagtggggacacaaagcctaaccataacatcatccataatattaaaatcactaatactaaattgtggtcttattacaatgtaagtataagtggtcagattttgcaataccttgctagatgttttctcaatgtttaacctatgtacacatttttttgaatactatctagcccagagctttgtgcatggtatatgtaacttaaaattacatattcttatttttaaaaaacaatcttaaatgctaggagaggttaaaaaaatgataaatgaggctgggcctggtggctcatgcctggaatcccagcactttgggaagccaaggcgggcagaccacttgaggtcaagagtttgagactagcctggacaacatggtgaaaccttgtctctactaaaaatacaaaacttagccaggcatggtggtgggtgtctgtaatcccagctattggggaggctgaggtaggagaattgcttgaacccagaaggcagatttgcaatgacctgagattgcttcattgcactccagcctgggtgacagagcaagactctttctcagaaaaaaaaaagaaaagtaaagaaaaaagaaaatgaatgattgagtttcaagttgagttaggaagatgagtatacctttacttacatgtgttaccatgctttaattagggaaaattatgacatggcaaaaagtcatacatacaaataaatactatgaataggaaaactcatcgaagaactcatcatgctctaggactaaattaagcttagctggtgggaccaggggctactgagccttcattctctactcaggctcctttccttgaatctgttatgttattacagattgtatactgctagttattctgagtacatatgatgcttgccatgaatgtactgagctcccggctgtggatatttaagagaacactaccatcacgctatgagaactgttcgaagtggtaaattatcaatgctggcttctcaaagaaagggcatcaacgactcaattcgatgacttcttcagcatttctaatgcaaaaatgtgatttttttctaaagagtttccaccccttttttcctttctcatgggttcaaacactggttataccatctccaatcctgacatctcccctgtatgtaactatgactatgtaacatctcttctggaatatcgaacgtcttctcagacttctggtctctccgactccgatcttgcaagcctgcttcgcccactatatttccctatagtaaacacctttatcttttagttccttagaccaaaaaccttgaagtcagccttgactcttttcatcatacagcttacccaccagaatatcccatgagctccatattcaagattcgtgcatacaatggccgtttatcaccatctgtcagtatcttgtcttgattacagcagtagctttcttgccggtctttgtactttcccctggtctctgttccctagaatgtattctcaacacagctcacatgatcctttaaacacctaagacagatcgtatcacccctttggttgaaacacctcaaaggattccatttcaccttgagtaaaagcccaaatccttacattgattcataaaaccagacaagatctagtccccacccccacacacttcacataggtcttctgtctcctcttcattcacaatatggaagccatggcccttcatggagtacctcgaacttgctgagcacgtaatgcctcagggtctgtgcacgttctgacttccctttctagaacactcttcctccacttatctgcatagctggcctcggtttctccaggtgtctcctccaatgtcatggtattaatgaggtcttggctggccaccacatctagaacactagaatagcccctgcccccctgcactcattgtccttctcatccactctattttacctcagagcacttagcagcaatagcgtgcttactatcactgtacttaacaccatcagagcgcttaccaccatcacagtgcttaccagcaacagcgtgcttactatcatcactatacttactaccaacagagcgcctaccaccatcagagcacccaccaccatcgcacttaccaccatcagagcacccaccaccatcagagcacccaccatcgcacttaccaccatgagcacacttaccaccatcagaatgcttactaccatcagagtgcttaccatcatcagagcacctaccaccatcagtgggcctaccaccatcagagcgccatcaccaccagagcgcctaccaacatcattacacataccatcagtgcgcttaccaccatcagagcacttactaccatcacagcacccaccaccatcgcacttacccccatcagagcgcttaccaccatcagagcacctaccaccatcagcacgcttaccatcagagcgcttaccaccatcagagcgcttaccaccatcagagcgcttaccaccatcagaacacctaccaccttcagcgggcctaccaccatcagagcgccatcaccaccagagcgcctaccaacgtcattgcacttaccaccatcagtgcgcttaccaccatcagcttaccactgtcagcatgcttaaccaccatcggagtgctcaccaccatcagcgtgcttaccaccatcagcatgcttaccaccatcagagcgcttagcaccatcacaaatacgttgacttgtttgtttctgtctccttcccaaacacaatggatgcattagctcattctcttgctgctaataaagacatacctgagactgggtattttataaaggaagcggattaatggactcacatttcagcatggctggggaggcctcacaatcttggcagaatgcaaaggagaagcaaaggcatgtcgtacacggtgacaggcaaaagagctcgcgcaagggagctcccatttatggaaccatcagatctcgtgagacttattcactaccataggaacagtatgggggaaactgcccatgtgattcaattatctccaagtgaccccgcccctaacaagtggggattattacagttcaaggtgagatttggctgggaaaacagcccaaacatatacctggaatataaagtcctgggggcaagactttgttttgctcactaccgtattggcagaacctagaacagagggtgcacacagtcagcactcaatacatatttaatgaatgaataaacgaatgaataaatgaacaccactaaagactgaaagccccttattttctcctgactgctttcaagtataattagcattgtctgcactattaatgccactcaaattatactagaagccaataaaagacacaaatgttttctatcagaaaacagcactcagtaaagactcattcatcaacgtcatgcttccagcctccatgcatatgctttattaattgaaagccctataaattcaaattttttcaagttgcatatatttttaaatatataaatatacaaatatatttaaaattgtaattatttccaaacttttcttattttttacattgtctcatataaatatcaaatagataagttagggatggctggaaaaaaattaaagaaaactaaagttatgggggttcttttgttgttgttgttgttttgagattcacttttgttgtccgggctgtactgcagaggcatgatctcggctcattgcaacctccgcctcctggattcaaacgattgtcctgcctcagcctccccagtagctgggattataggtgcccaacaccacacccggctatttttcatatttttaatagagatagggtttcaccatgttggccaagctggtctcgaactcctgacctcaagtaatcagcgcacctcagcctcccaaagtgctgggatttcaggtgtgagccaccctgcctggccagttatggggattctaaatcattcctcctttaggccacgaagcctgataagggccagctttttacagcccaagtcctggcacttgtggaagcctcctttgaggaatgaggactctagtgaaggaccggccacatcgcatggctgttacacagtgggtccccaaaatgacatatccctaactcgtgacacaagtttaatgaccaatacatatttgatagatttaaatatatatatttatcttcatttacattcccagaaatgactgtcttaatcctgacagcatcagtattaaaaatcagcacttgctcttgtgtctgaaactgacaagtttcatttcacccatgacagcctactgttgtcacatagaaaatgtgatttgaacttggatcattgatgtgaaaagcaaatgtcactgcttggaggggccaactgtataacatccaattaggcagaaatcactgtaataacgtctcttttctgttagagtagagggtgttgtcaggaaacagtgtaaccacccctcatcttcacaggacaccctgtgtgcacacacacatcactgaagacatcattctcagcagtgttttaatatttaccttcagtttgactgaattgtatgtaaaccttggttttcagggacttatttaaaatgacattcttagccaaaatttaagtacaatagaaatacaaagatttataaaattatgtaataattcatactagagtttgaaaagtttgatgtcacattgaaatcagttagttttagactgcgtataaatagcagagatgtaaagtaccctttggtgtagtccacatgcctgtgcacatagggaaaagataatggtacaggaagagggtacacaggagcttttaaaaatcaagaggagagatacctaaatccacactgttaggagaacttacaaataagaaattgtcatgattatacggagagtttaggagaagaaaaaattgtctacatactcaaagacctcccatatctttttcaaagcagggcagcctttgatttgctaggtgtgagagctccatttgtgatatgctaagtaagactggctgagattcgggtcagagccagcacagggacacattgggcatctctgcaggtgatgaagtgctccagggcttgagctgaacggggtaggactgggtgctcccactgggtctaccagctgcctcagggctaccatggcgcccaggatccatagaacacatcacctgctctacccacacccggacctgccagctctgcaacagactgggagacaggagctgggctccacacagttgagccagggagcatctcatctggcacttcctgctttttggagcctgatgcatctcaaactgaaaatgccaggtgtgaagaaagggagacagcaataacgctcaaatttttaaatttaattaaaatatatcagttaaagagggaaataatttaaagaatgttttttaaccaatttattttcattcaaaatatgaaaatacacattaattttccaagctttagctatagagctaaatctcttgcttttgactttgttccacagggaacacagattattttttggtcaaaaccaacttttaatgatcatctaaaacgtcaaggttttggttactacaaaacaaggcaagaatttaagacccatgaacatgaaggctatctttgtgcatgatccttcaatttcttaaaaataattcccacattgtttactgtcatcttccctacagcgaatttggcagtgattttcatttttcactattactctagtcacagtaactcttttaagataacatttaattagtttatagcatatttcattactctacataattataatgacaaacaatagtatcagaaataggtttggcataaacacagccagctcaggaccactgcacagtgcacctgctgggaaacccaactgtgtaaggtaccaagagagaacccccactgatgaatgcccgtcccaccaggcccctcaggcagggctgcaagccagctgagcctacaagatgactcaatggaggttgcgttttttttttttttttttttttaatcttccactgctgtatatccacccattctaaatgatttataattcagcacaaacatgctcattgggaaattagctacggctgtaggaggcaggaaaggtagagtctaatagcaagaaagaaagtcttccaatattttcaggactgatgcaaagactagttgacggaaaacctgtcagacttcatctttggaaagaatagaacatgcaagaccttaatccttgtgatgccaggaatgaagagcaggactggagccctccagagactctgattcctgtcccacctggctcagaacccctttcactgaaagggttggtgaaataagttttattctgcaaagatggacatctctctgggggaaataacatgagatatatttcaaataatgcccagcacccctgctacacacagatgctaccagaagatcatggggtgcgcagtgaactcattggggcgaaagcctctttaggaagggctgtatgtacagctcaagtgagaatgtttcctaccagagctattcagaagccgctgttagacataaccatgtgagggacccaggtaaacaggaaggaaaggagaaagtcaaacgtgagtttactcaacacagaaatactctctcagaagcttagggcgaaaggtatagcactactttcctagaaaagctttccagcgcggctgtttatttgatagatgacacctgctttctctttttttttcctctcagtgcatcacctatacacagcatttcttatctttgtgagagtgaaaagatggtgtttggtggacagaaatctgcatctgaagcattcattatgcaatagtgcagtcctcagtcttctaatccgcaaaataatgggtagatgctcaaatgagaacatgagatgggagaggagttttcttacgaagccctttactctcctttcttccttgctggtgcagctgtctttctattacaaaggctttaggccaggcgtggtggctcacgcctgtaatcccagcactttgggaggctgaggcaggcagatcacaaggtcagcagtccgagaccagcctggctaacatggcgaaaccccatctctactaaaaatccaaaaattaggcagatgtggtgggcatccctgtagtcccagctattcaggaggctgaggcagatgaatagcttgtccctgggtggcagaggtggcagtgagccaagatcacaccactgcactccagcctgggcaacagagcaagactctgtctaaaaaaaaaaaaagcctttaaaaatcagagactcactttgcaagccaatcagtgaattttaggacatggggatgtgacccactcatggccaatgagacatacaggaaagtgtctgccagggcatttttgggataaacttttcttctggagagagtccactaccgagttgctgcactggacattgtcattggagaatatggcatcatctgtccctagcatttggctacaaaaaaaagtaaatttacatcctacaggaagatgctgcaggatctatgtttacatcatttcattatgccttggggtataatcaacatacaaaagcagcagcatttctatatgccaacagtgaacaatctgaaaagaaaaaccagtcccatttacaatagctacaaataaaataagatacctaagaatatacctcaccaagaagtaaaagatctctgcaatgaaactataaaactgtatggtatcaaaggtctcaggcagcaggtgcaaactaagaaaatgacttggaaccaacccaaatgcccatcaatgatagactggataaagaaaatgtgtcacatatacacgatggaatactatgcagccataaaaaagggtgagttcatgtcctttgcagggacatggatgatgctggaaaccatcattctcagcaaactaactcaagaacaaaaaaccaaacactgcatattctcactcataagtgggtgttgaacaatgagaacacatggacacaaggaagggaacatcacacaccagggcctgtcagtgggtagggggctaggggaggggtagcattaggagaaatacctaatgtagatgatgggttgatgggcacagcaaaccaccatggcacgtgtataactatgtaacaaacatgcacattctgcacatgtaccccagaacttgaagtataataataataaaagagaaactataaacaaaaatcctcttgaaacttaccctggagcttctgtgcaaatttttctttttcctttttctgatggggagggaccttacatcattgttgattaatggtaaatacatcaaatatattctataaagagaagtttgggatttggagaaggaaaactggatttctcgtcttgaaatactcagagcataacagcgtcagcccagaggcattcagcactgattatcacaatgctagcaacattattatcatcaaataaaaaaccaactcaaaaacttcagcagcttatctctctcagaatgtaactccagaagatacaattttctatgtaaactgtattcaaatatgactctcaatgtaaaataaaagataaatacatggaataggcatgggagtgaaatgtatttttttcttatcaatgattgtatttgtgtataaacaatggatttagcatatagatttacttaaatcactactcaactttaaatacatctttgtaataagaattactctttttatttgtaaatcatcccaatcttaaaagtaaatgttagtaatgttttgttttaatgagcaagcacatatatctataatatatatattgtgtatatatatatatatttaatttaaagctttccttggtcgggcttggtgtctcatgcctgtaatcccagcactttgggaggccaaggcaggtggatgacttgaggtcaggagtttgagaccagcttggccaacatgacaaaaccccatctctactaaaaatacaaaaatcagttgggcgtggtggtgcgtgcctgtaatcccagctactcaggaggctgaggcaggggaaacacttgaacgcaggaggctaaggttgcagtgagccaagatcgtgccactgaacttcagcctgggtgacaaagagagactccacctcaaaaaataaaaataaaaataaagtcttccaacaattttgtttgaattatggttaataacattgaaggttttctcctaattccaggggatgtttcgaatgccttctgttttgccatttcaattaataattccattcttgacctaccaaataatgcatatttaaaatataactttcatatgctaggaatgacctaatatttgtagtgtgttcttctaaaatacttctaggtcctcagagcagtgtcatttaattaacacggcgccattgcatctacttgaaattagttctaatttccgaaatggtaatctaattatttcagaacaatttacatagatagcacataaatccttaaaataaaatgtaacttgttgcagattcatggaatcatttctacgaagcaaaattgtattctacggcaaggcaagggaagcccagggaggtgaaattgtgtatatttattcctatgagaacatgataacaaagactaccaaattgcagagatgatcaccttcttgacaaattgtgtagttattgttacaaagaaacaaattttcattttgcacttgccaatctagtttactacccactgatgaaatttttcacttagacacaggtaacgggtctcagtgtttagaatcattgtataattatctgagacactacttagttttcaaatctccgaaacacagaagcagatgcgtttcacttagccaaggtcaaactgttattctctttgccagctgtcctgggatgatcctagttctttttttcggggggttatcatattagcaaaaatgattcaactgtgaattggtccctttgggatttcccactagaggagaagggtagtggtgatgtggcaaagcagataacaagaaaatactgctgtttctgttaacaatatgggctttccaaacaagctcaaatcagttctacactccataatattaattcccccaacacccctatgaaaaatactggtaaagatcttgaattcccaatacgcaatagaactgggaagtaaaaccattcggcataaaatgacattcccaaatagactatacaatttcaacttctttagagaaataatgccatataaatctaaactatgaagatgaaatttccaagaaagagcatatcttcattgtgtaatctaaaagaattgcaataatttcaaacttttaagaagaaatccaactcacacactgctcgttctgaacaatacgtatctaatcgccaagcttcattctgtactgtccctgtgttcagcaacacgctatgaagtataaaatagaaataaggtaccatcgtgatgtatgtggctgacattttatagtttgcaaaatactttcaactacattatttcatttgtaatgagaggctattatactgcagtggtttagagtgtgggtttgggagcccgcaattatctacatttgaagcctctgctatttactgtctgtgggatcttgtatacattctttgcctatgtttttccatgaccttatctgtgaagcgggatggtaactgtgtccaccttacaggattattgacaggactgaaagtattagcgatcttcccagggaccagcacagaaaaagtaatccacgtatgttggcatttcttattgttgtttgatcatccaagcaaacacaggagtaagaatttatatgtaaactagggctcagatcaagtggcttttttttttttttttttttttttttttttttttttttttttttttttttttttttttgaaaaaaaacaaggccctgcagtccaggcaagagtgcagtggtgcaatctcagctcactgcaccctccacctcccaggttcaagcgattctcctacctcagcctcctgagtagctgggattacagggtccctccaccacacctggctaatttttatatttttagtagagacagggtttcaccatgttggtcagggtgatgtcaaactcctgacctcaaatgatccacacacctcggcctctcaaagtgctggaatcacaggcgtgagccaccccgcccgactgactttttcttaactcatgaggattagatcagatttggaattcaattgttcagactctatgacagattttttgtatacacagctgctcccaattcatagaagtttcttgagttcctgcacacacaagactgacaggtgtgaagcagaggtgagggattggcagaggtgagcgccagcacccagcgtcaactgctatttggtatgcggatgcttcctgccaccgctaagccttgaaatgctcagagaaggagaaaacaaatgctaggatacagccgggttccatctgttaaagcaaactaaatatagcctgaggagaactccgtactttcgtatatgactccttgtggatgaattgcaactaactgaacaggcagacaagattgagaacctaatttacgagtatgcatctgtaacaagagctcagccttggccagtcccagcagccatacttcaaccatttataccctgctgagcgttcaaactgtgctcaaacaaggcaaatgccaacctgcaaccaatccagctgtttctccacctcactgcagatttctgtatgttacttccctttttttgtgtataaatcttcttccaccacgtggctgtgctgaggctctctgaatctgctgtgattctaggggttgcctgacttgcgaaatgttcattgctcaattaaactgatttttttttcttttttgagactgagtcccactttatcacccaggctgcagtgcggtggcacaatctcggctcacggaaacctccacctcccgggttcaagtgattctcccgcctcagcctcccaagtagttggcattacaggtatccaccatctcgcccagctaatttttgtatttttagtagagacgggatttcaccatgttggtcaggctagtctcgaactcctgacctcaagtgattcacccgccctggcttcccaaagtgctggggtgacaggcctgagccaccatgaccggcaaactcctttaaatttaattcagatgaagtttttatcacaccaaacaagccaccctttagatcggtgttgaaggacgacacataggatttgtacaggaagatggaagaagacagcaaatttatagcaaagaggagtaagattgagggaagagagaaaatgagaacgggacacccagaggctgcgggagagaggagctacgcagaccttgatggaagaagcgggggatttttactcgaagtcgtagaaaacatgaaaggcaactgctcagtagttgtgtagaaacagagaaggagcatgcttaaagggacattagtggaacaccaggatgttttatcttcacaaaagatttaggctatagagatagctcaccaaggaaaaggtgtaaacatacaaaactacccttgaattaacagtgggtttaggaaaacacagtatgttcaactatgctcaatcccagatgggagcatttttattttctttctcattgtcactagtgagtaaaatgaactataaatgttgtaaacagttaaatggtttcttaaaatctctctctccccactcctcctctcctttccatctctccctaacttaaatatatgaatgtcaagactccatgccacattttctttatccagtctattattgatgggcatttgggttggttccaagtcttggttattgtaaatagtgctgcaataaacatatgtgtgcatgtgtctttatagtagaatgacttaaaatccttttggctatatacccagtaatgggatcgctaggtcaaatggtgtttctggttctacatccttgaagaatctccacactgtcttccagaatggttgaatacaccattttttatgcagccatgaagaacaatcagttcatgtcctttgcagggacatggatgaagctggaagccatcattctcagcaaactgacacaggaacagaaaaccaaaccccgcatgttctcactcataagtggggttgaacaatgagaacacatggacacagggaggggaacatcacacaccagggcctgtcggtgggtagggggaaagaggggggagagcattaggacaaatatgtaatgcatgagaggcttaaaacctagatgatgggttgataggtgcagcaaaccaccatggcacatgtgttcctatgtaacaaacctgcaggttctgcacaagtatcccagaacttaaagtaaaataaataaataaataaagactccatgccatttgtctggcagtgggaataaaggaaaatgcagatgtcagcaaaatcagagccccacagaactgcccgcaatgaagacctgaagcagtgggggcctcaggagaggccgacaaagaaaaggttaggaagaaaggctggtgcattttcatttccagcacagagaaagcgtgaacaacaaagatatttttaaacaaagagttgaagaggccgttctccatgaaagtgagagagtgctgatactactgacagacaggggtgggatgtgggcagtagaatatatttttcagaggtaggcatggtgcgttctgtttggaacatggcaagtttgactttataaaggggcacttctgtaaatttccctgactgcttttaagacatgtggacaggaaggactcaagagaactgagagattcagacatcgatttgatagccatagggactgtgaaaggaaaatgaacctcagggccccaaaatcactgagctacagggaaaagtcaagctggaaactgcttacggccaacctgcctccaactctattcaaagccacccctctgctcactgagataaacccatatctgattgcctcctttggaaagactaatcagaaactcaaaagaatgcaatcatttgcctcttttctacctatgaactggaaaccccttctctgcttccagccgttctgcccgcctttgctttgagttgtcctgcctttctggaccgaaccaacgttcacctcacatatgctgattgatgtctcatgtctccctaaaatgtgtaaagccaaactatactctgaccaccgggggcacgtgttatcaggatcttctgaggttgtgtcacaggcgcaacctcaaccttggataaataaactttctaaattaactgagtcatgtttcagatatttggggttcacagaaccaaggctttgttcaaacattactaaatcttattgtaaatcttcagccattggatggcttgagttaaagttcttaatcttaaattttgttattattattaaactttaagttctagggtacatgtgcacaatgtgcacgtttgttacatatgtacacatgtgccatgttggtttgctgcacccattgactcgtcatttaacattaggtatttcccctaatactatccctaccctagacccccaccccactacaggcccctgtgtgtgatgttcccccactctgtgttcaagtgttctcattgttcaattcccacctatgagagagaacatgcggtgtttggttttctgtccttgcaactgtttgctcagaatgatgttttccagcttcatcttaaaattaaaatattggacttcatacaatgaagctttttctgctcctggttcacttcaataacctgaatcagttctcttccaaaaccatgttattctgggcaaaatggaaattgctcagaaagcataggcagctcaatgttaatcatgcatagaatatgtaaaatatcctccaggattgtatgctgatggtgggtcaagagcgtgagtgtttcctcatgagagaaaagcaaagagactgaggagttttcctctgccttgtattattctgtctgtctccccaccatttcaaaggctccgccaagatcaggagcatcttttctcattgcttttgcatcaagaagctgaaaagagctggcccatcatcttatcgggatgttgaataaaaatatctaatgaagatgtccaggttaacattgaaaataaagagtacatcctgacactggtaaaactgtacacaaagctatcaagagagtcaacattaaaatagctaaaagtttagcagtaaagccagacatcataaacaattcagacagaatttcaacgtcacaaattccaaaaaatacatcacaatttctcagggtttcattttgtctctgtgcgtcaaagatttcaatacattctttaaaagtgactttcctattttatatgtatatttgatatatattattaatgtaaaataacataattatacataaactaccaatttctctgatgtttccatgacattcaagaaacatccataacctaagaggttaacaatgcttataataagaaagtttcaggtgattaggaattttgtatcatgagcattgaccaatgagataaaattactggaacaatattaggtatttgcatcttttactgatatattgttttgctaaataaaatataatttgtcagccaggcacagtggctcacatctgtaattcctgtaatcccagcactttaggaggctgaggtgggcggatggcctgaggtcaggagttcgagaccagcctggcccatacggcaacaccccatctctactaaaatacaaaaattagccaggtgtggtggcatgcaccagtaataccagctactccggaggctgaggcacaagaattgcttgaacccgggagacggaggttgcagtgagccaagatcacgccactgcactccagcctgggcgacagagcgagactccatctcaaagatatatatatttgtcaggaaaataattagtatcttgattccttactatcccacttaatattaaccaagtaattgactcagtagggttctaaataatccctgagagaaatattgaaaaattccacttaatgggacaaacagaaagataaaactcaggaaatgtgaaaccatcgctacatatcttatctcaaatgaattaaagtcattaaaatataggaaggtgtttatccaaggcagtagcttgaagctgaggctatttcttagagcacccctaggaatctcttgaatgatcaacccaaggcttaggctcctgcatttatgacctcagtgttggtttgcttttttgttgttgttttgtttttttgagatggagtcgcactctgtcacccaggctggagtgcagtggagtggcctcagctcactgcaacctccacctgccagattcaagtgattttcctgccttagcctcctcctgcctcagcctccacggagtaggtgggattacaggtgcccaacaccacacctggctaatttttgtatctgtagtagagacagtgtttcaccatgttggccaggctggtcttgaacttctgacctcaagtgatctacatgccctggcctccccaaatgctgggattacaggcatgagccaccacgcttggcttgatgctttgtttttctcattgttttccccaccacactggtgagactttccatttctattcctcacaggtcttatcttttctttagtctatagattgtgagaaccgatgtgaagaatatgcttcaaaagcaacttaaatgatataaacgcctgtccgtttaaaatgacatattcagtagagttcaagtaattgattaaaaatttgaaaatatctgattttaatgtatacttgctaaaataattaagacagaaatactgaatcacgattgatccttgctgttaacatgcacagggccaggatctacacatcatctattctttcaacaagccttttttgaaagctgcctgatatggtttggctgtgtccccacccaaatctcatcttgaattgtagctcccataactcccatgtgttgtgagagggacccagagggagataattgaatcatgggggcagtttcccccatactgttctcatggtagtgaataagtctcatgcaatctgatgtctttataaggggaaacccctttggcttggctctcattctgtcttctatgcctccatgtaagatgtgcctttagccttccatcatgattgtgaggcctcctcagccatgtggaactgtgagtccattaaatctctttttctttacaaattactcagtctcagataggtctttatcagcagcatgaaaatgaactattacacctgctatggtgcacatgatttaccaggtgtaagagatagagaaataaaagcattgcagtctaattgtaagagctcgaattttagcagaaagataactatggcacaaccctgaaggcgccaagctagaagtatgctcagatcctttcattccttcattctctaaatgattattgagtgcttggtacaagcaaggcaatcttgtaggcattagggatacaccagtttgggagtgaggtaaaggggggctgttcttatggagctcacattctaatgataagacaaatgtgcaaacatttataaacatttacacattatataatcatagtccctacattatattaatatatattaataggttttatgatatgtcagattataagggttatgtgaaaaataaggaaagataaaaagagagtgaaggggtggcaggtgtccccttgtgtaggatgtcatggagatgacatttgagaaaggtctcggaggagtgaaaattgaggtgtgtggagatcttggggaagagattttggatagcagccattggcaaggccttggggcactacagccctggcaaacaatgcagggccagggtggctggagccaactaggggatgggagctgttgggatgaggtcaggaaggacgtgaggactaggctgagaaagtccttggagacaacataaacacctgagatgattttgtgagtgacagaggagtcctcctccttatttgggttgctctggaaacccaggccttggggtgaagagcagttgtccacgcatggtgatgactgaattgagctgttagaggattagtagttactcattagagaaagtaaacaagagttctgaaaagcaaccttcagggagcaagtgtcttgcggaaaatcatggaaacagaagacccagggcaaattcatgaacagcaggcatcctggagtgtctgtatgtttaatcgtgaaatagcagtgagtagaagcagccaaggccagatcatcaaagactctgtatgttgcggagacaccactggtgccaattcacccacccatttcctccctgcgtctttctaacagagccccaatcccgatcaatatgagtgtctgtgcgcctcagagcaagctggcttctcccccagtccccatcccaaggatgagccttgctcagtctcaatcaggtgcagtcattctacccctgggctagaaggcaatggggagagagcgttgaacacaatttggacagataacgaatctacaggggtgtgcagaggggctgacctctgagatatgtttcccagctaataagggaacatagtaaaactgacatccgtccaccactgctggatctcattctgggtgatgagttcagcctgcgaagatggccctgtgtaaaggaagatatgaagtgagaggattaggaaggaggggcatgtcccacacaggccctgggctgtgcatgacggatggagtccccagacccaaattctgttttaaatatgtatttttaagataactcaggtagctacagtgtaagctgaagagatgagggtttattcaggtggagagatgatagagtttgggggatattacaaggagaacggagagagtttgtctgactgggcattgtacaccttggtcctattccttaccacaggtaatatgcaaaggggatcaagcctggtccttactacagaaaatatgcaaaagagacgaagccctggggagaagagacgatcctgaacagagtgtgcaatatagaagctcagtctgaggtgtccagagatcaaccaggagtcgaagtctagacacagagatggatgagttgggagctcaggaggggccaacgctagggaagacccatactgaacatcctgtatctactctagttttggctcattttgttgccttagacaatttgctgttaagtaaagttatagaatgaacacaattatagaattatattgctctggtggctatcagccttaatgcgggtggcaaagcaacgcctacatcccctcagccatagctctttgagaggcgtgacagaaacaggaaagatggggagaaatcattgagcaaccaggttagcctgtgctttcactggaaatctttcattaaacagacgttatacctttagagtttaccttaacctgtcttcaaaactaaggaacgaccccactagaaatatgattgtggaagccattaacgtacagaaaaattagttaattatccctcaagggcagaatggttaaaacaaggaaagcacgtacaaatgagcataaagttatgttttaattgaaaggctaggagcataaattcaaagacactaaataaggtagcacactgcatcaatctgagtgaaaatgtctcatctgtgttttctcatctgtcattttgtcattgtgttgcctgtttgtgtgagcaattatttccttctcaggcccatgcttcagagcctgccttgggcgggagggtccaaggccttgagcttcttgggctggccagtctaggggttcgtgtttacactgtagtgagggactccactgatggtcctgttcattcattcattcaacatcagtaattagatatcctctactaaatattgagaatacaagtcccaagttaatgaatcttgaatggagaaacctcaggttttcagaaggaggggaatgtagcctgaatgagactcttccggacagaaaatcacgacagggaagacaagctgggtattcgcccgctgggtacatcatttattaactcaacagatgttagctcagcacctattctgtgtgaggcgttatgctaggaactgggtacaaagaggaaggccaggaggacaggggccctgacctggctaagcctgaggctacacacactcatcagagccctcagggatccacgtgcagccctaacagccaattcagagaacaggacacagtgggtgatgtcagccatgaacaggaggggcccaggtgatgatcaagcacctccttccttcttctttcttaacatttgaggaaatgaagatgtttgagactttaaataacacacccaaggatataatttataccttattattttaagctatcaggtgcaattgcatacatttctaaataagttatgtaaaaggcagtgaaatgttcctagggtctcacaatttgtgatggttaatactgagtgtcaacttgattggattaaaggatgcaaagtgttgatcctgggtgtgtctctgagggtgatgccaaaggagattaatatttgagtcaatggatcagggaaggcagacttacacttaatctgggtgggtaccctctaatcagctgccagagaatacaaagcaggcggaaaaatatgaaaaggtcagactggcctagcctcccagcctacatccttctcctgtgccggatgcttcctgccctccagcatcagactccaagttcttctgttttgggactcgggctggctctccttgctcctcagtttgcagatggcctattgtcggaccttgtgaacatgtgagttaaaacctaataaactcccctttatatatatataaatatcccatatatatgtatcccatatatatatatcccgtatatatatcccatatatatatatatatcctatatacatatatcccatatacatatatcccatatatatatgcgatatatatatatgggatatatatggggatatatatattgcacatatatatggggatatatatatgggatatttatatatgaaggatatatacatgggatatatgtacatggttatatatgtatgggatatatgtatatgggatatatatgtatatgggatatacatgtatgggatgtatgtatatgggatatatatgtatgggatatataagtatacgggatatacatgtatatgggatatatatgtatatgggatatatgtataggggatatatatgtatatgggatatatatgtatgggatatatatgtatatgggatatatatgtatgtgatatatatgtatatgggatatatatgtatatgggatatatatgtatgggtatatgtgtatgggatatatgtatatgggatatatatgtatatgggatatatatgtatgggatatatatgtatatgggatatatgcatatgggatatatatgtatataggatatatatgtatatgggatatatacatataagggatatatatgtatgggatatatatgtatatgggatatatatgtatgggatatatgtatatgggatatatatgtatatgagatatatatgtatatggtatatataggtatatgggatctatgtataggggatgtatgtatatgggatatatatgtgtgggatatatatatgtatatatatatatatgatgtgcctggacacatcacaggcacctgataaatgctaacattagttatgtggaaattattacatgctgtattgtatttaatttcataaattgcctgaaaacttttatatctcagaagcatatagatcttaaatacatcctaacagtactatatatatagtcacatataatcatatatataatcatacacatataatcatatatatactcatatatatgatcatatatatatatatatgatcatatatatgatcatatatatatatatatgatcatatatatgatcatatatatatatatatatatatatatatatatatgattagttctatctctttagataaccctgactaatataccatctatttaggcttcacaagcctctgccttgctttaaggtgctgtgagctccttgggagcctcttcatcttattcgtgttgcatgcccagcaccggcaggctgcctgggacacaaaacaggccccttgctcaggtgctgttaaattggaaagagcagccctgggcttggagcctagaacttcagttcttgagcaatgacttgaaagcaggcccactcacctgtcaccacctctatcactgggagatggggcacccaccctcatttcctctgtcctgtgtcgttagcctgctggtcatttttgaaagaaagttttcgaccacacatttttagtttcgatatgttgcaatacttaaacaaaaataattgagaacacaaaagacagtaggttttatttaaatgaagaagcaaattaacaaagtcaacatcttatcttactttcaaagtgtatcattctaaaaggttgatgcagcgttcaaggttaggtgctgtctacttcctcttgcaaacttgttttctagtgtgaaatctctttatggtcagggatcttataagtttgatgaaattgactgagtatggcctgatttgttatttgctcataagattttttaaaacttacacattatattaaaccaaagagtcttaaccataaattaagaaatagtctgagaatcctaaggttctcccaatggcttctgaccttcccctttttcagttgtagtgtgtgtcggcatttagaacccactcttgcattctcaaccacagctcagaaaacataaacagtccagggtgtgctggtatcagagtgtgggagctgactttcaaatgttcaaaacacgtgtaggtctgctgctatttcagttttaaatatttagattatataaactttacaagaaatcaattatattaaaacagaggtaataatggtttaaagctcatggattcccaataatgtgtttacatttggccattgtctactcttgaaggtatttactttttcatccggtcagagtatgacatggtgcagtgtcactgggcatctgttcccaaggctgtctccagtgatgggcatggtggtggtttgaaattggccatggtggatgtatttaaaccaggcaaatggaagaaggctgcatatcaggctcttctcctgggagaaccctttgctaaacattttccagcagcacattaccatgggcaatagacttggagacgcagcttctactcctccttcaggtttttcaatccatgaaaatccatggtttttctatcttaaaaagccttttccaagctcttcaccccaaggagaatcaataacttatctcgttattcctatgccttattgtaagtacttgtgttgtaacacataccatgctttccttgtttaaggttcatttcatctctagaaagtgagcatttagcggtatgattgatatactgtaaatgttcaataaatgcttactgagttaataataaatgaatcaattaatacagagtaggaagatattaaaggaaactctgatgctatgtcattaatgggacacagaatctgaaattattcaaccacatatgcccctgtgcatgaaccacaataaacatttccaaattcgtttctattgaacacatgctctttgtcctctttttctcaaatccgtatcctctacaagcctgcttaacaggtaaactgaaaattcagcaagtactgaacaaaagaattgcaatttcatgattcagtattggaaaattagcaagaatatggagatgaaagtatttgaagacgtagcatcaactccccttggtctctgggtacaatgtggccctgacttatgacaagcaagaatgtgtttaacaacctactcaactgtgatgttcataaacattttacaggagaaagtgtttgcatcttcaatatttcacaaagagcctaccctctcagtatgcacatacttgattcagagctaattttaacttgaataactcagcctgtttgacctaacgggtgcgggcaacttatatataaagcatttacggtgtgagctatttttaacttacacccaatcagctggcttgctgcatgatatgagcactgcattttagtccacgaaactattggagctattccctcaagcatgaaagcatgaaggtgcaaacctacactgtgggcactggagtgcaacacgccatcattaggaactctctggagggccaggcatggtggctcacccctgtaatcctagcactttgggaggccaaggcaggcagaatgcttgagctcagcagtttcagacgagcctgggcaacatggcacaatcatgtctctaatccaaatacaaaaattagccaggcatggtggcacatgcctgtggtcccagccactgtgggagaataacttgagcctgggaggcagaggttgcaatgagccatgataatgtcattgcactccagcttgagtgacagagtgagactccctctcaaaagacaaaaaaaatctccctagaaactgtccatttgtcaatgttgagcaacattcataatgaagacttcgagaaaatacaagaccctgagttgtctctagaattatcaaaagcagattgtattatggttgacttcattttgttagttgactgtaacccatgttgctttattgcaaattaataaatcacccaaaataccacattctttgaacttaccatgtaaaatatcctataatctgaagattaacaaattatcatcacgagctaagtagaagccataatttcctaagcatttctcattcaaatcaagaatatttaaatagaaaataccaccatggctattatcattattattataaacaaaaaatgatcactactcttaaaagtattggacagtataccgtgaatcattagataatttaacaatattattaattaaatgcttactatgtatcatgtactacattaagctactgcaaaatatattataactccagattctagatattaatatccttattttacagataataaaactgagtcaaaaaggacttgatttttctagccatataaccagcagaggcagagaatgagatgagagccccagtcttgctgattccaagtccctgcccttcatcccaacttcactcttcaaaaaatgaaaggtaactatagttttcaaagaggtgaaaccaattccaaatgaggctgcactgaagttatcagggcactttgcagtaaagactatcctttaaatttgaaaaaggatggacaacgtaagacttgtttatatcctggaagataatgaacttatgcaacacgtcaccccctaagcctctgtaggccaaaaacataaacaggcacaaaaaggggttaacatcagtctccctggaaggtttttaatgcccagtgatgcagggatttaggtggatgtattaatatccaccttttggaaacctgacgaataccgtcgaccataaaacgccatcttgaagagatgcagtggcctcccctcaccactttcccatcatggctcaagtgccactttctccacatgtctttccccactagtggctccttttctcctcacagaaggcctgaccacacctgttctccttgcagcacctgttggtcttcattgacctggctggcatgtgcgtgccattcccctgctcctggagggttggcagcactatgcacatcctcacgtctccactgtctaacatgtcattgctatccatgtagcctccatagtaaggcctcagcaatgtgggcttggatatgctatcttgttttgtttgctaatgaacaaaggaagtcttctggatggaaagaccaaaaatccaagagaaggtgattgcaatggactgaatatttgtgtcccaccaaaattcatatgttgaagccccaatctccaatgagatggtgtttggaagtgatgctttcaggaagtgatttggtttacatgcagacacgagggttgataccccatgatgagattagcacccttataaggaaaggaggaaaccagggtgttctctgccactcaaggacacaattagaagatgccatctgcaaaccaggaaacgggtccttgcaagactctgaatctataagcaccttgatcttggacttccagtctcaaaactgtgagaaatatatgtctgttgtttaagctgcccagtctatgatattttgttatagcagccagagttgactaagctggtggcatttccaccttatgcaaattttctagactaacgctacttctcatgattctgtcttgctgaagttctctctcagcactgtcccatcattggagagtaatgtacctgagtattattttctcagcccaggcctgccatcttcccagtcagagactctgtaatagtttactggtttggccttagtatcttatcatttatgacaaatataggcataggaagtcatcatttgattagcacctgtatctcttaattaaatatatgcatgtgtgtttataaatgcttgttataagatactattatacctagaataggtaaattgtttattttcttctgctcaattttatagtcttctcctcgtttgtccatactgcattatgtgttgaagtaaatactaaccttggggtcagacatgtacagttttgatccctggccctaagtatttaccaactctgtggccctggggcaagttcctaagctgtattcttttctgaagagcaggtggaggtgggtggccgcccgccaggcaggattgttgtcaaaactagatgaaaacttatataccaagcaccatgctggacacgccacaggcacccgataaatgctaacattagttatgtagaaattattacatgttatattgtatttaatttcataaattgcctgaaaaattttatatctcagaagcatatagatcttaaatatatccgaatggtacacatgttctcccttaccattaaaatcatatacacggatatatggaaacttttcctaagaaggttgccgtgagcttgtgtgttgtgggaccacgcacacacatgtgggtagagtatatgaatcaagttccatatcttaaagatgactgtccatttctatcaaactcagtgtgatcattgaaatacgtatataataaacatagcaaacacttggaaccaacccaaatgcccatcaatgatagactggataaagaaaatgtggcacatacacaccatggaataaaggatgagttcatttcctttgcagggacatggatgaagctggaaaccatcattctcagcaaattaacacaagaacagaaaaccaaacaccacatgttcacactcataagtgggagttaaacaatgacaacacaaggacacagggaggggaacatcatggaccggggcctgttgcggggttgggggcaaggggagggagagcattagaacaaatacctaatgcatacggggcttaaaaactagacattgggtagataggtgcaacaaaaaccatgacacatgtagttctatgtaacaagcctgcacattctgcacatgtaacccagaacttaaagtaaaataaaaataaaagaaacacgtatataagacttatagaaatacacacaaggaaaacaccgcttaaaagtccaagattaatagcatgcatcgaaaatttctctcccaggaaagttatggttccaactaatgattgatgtaacaaaatgacttaataaccatctataccttttaaaagtaattcttgaataaataagcagttatttgcctcccacacaagaaaacatacccagttcaaggccaatgcatgggaaacaaacctgatcccacagtacaggttgtcaggaaagtcctgggtgaatgcacagatctgagcaccacagaagacatcaggagacacagggaatgcccaggtgtccccagggtggctgggctcagcgagaggcacccagaagggtttggagatgtcttagattcacgaaagcctaagattggccctctgagtttagaacctctcttttaagcaaaacctccagctattgacatgaaaagatatctatcctttagggctctttggccagagctgggtaaattcccctgttttgttctggaagtctgtcttttggaaaaaagccctaaactttgtaaaacggaaatgaaaacttctatccagagtatatgtgcaattttttaaaaccagtagatgacataaaactgcatatttcaataacattctttaactctaaacccccttgctgaagccatttcagccctttttttccatcatgaaacacctcccactaatagagctgtttgtattagacaaaataagacaggaatgcacttgaggagcagaaacactgacttggtgcagggactcacagcctccatctggggtgtctgcctatcttcaaagcgttctgtcaatatttaaagacagtgggagggtggttcaaagatggctgaataggaacagctccagtctacagctcccagagtgagcgacgcagaagacaggtgatttctgcatttccagctgaggaatgcagctcctcaccagcaacagaacaaagctggacggagaatgactttgatgagctgagagaagaaggtttcagatgatcaaacttctccgagctaaaggaggaagttcgaacccatcgcaaagaagttaaaaactttgaaaaatgattagacgaatggctaactagaataaccaatgcagagaagtctttaaaggacctgatggagctgaaaaccatggcacgggaactacgtgatgaatgcacaagtttgaacagccgattcgatcaactggaagaaagggtatcagtgactgaagatcaaatgaatgaaatgaagtaagaagagaagtttagagaaaaaggaataaaaagaaatgaacaaagcctccaagaaatatgggactatgtgaaaagaccaaatctatgtctgattggtgtacctgagagtgacggggagaatggaaacaagttggaaaacactctgcaggacattatcaaggaaaacttccccaacctagcaaggcaggccaacatgcaaattcaggaaacacagaggacgccacaaagatactcctcgagaagagcaactccaagacacataattgtcagattcaccaaagctgaaatgaaggaaaaaatgttaagtgcagccagagagaaaggtcgggttacccacaaagggaagcccatcagactaacagctgatctctcagcagaaagtctacaagccagaaaagactgggggccaatattcaacattcttaaagaaaacaattttcaacccagaatttcatatccagccaaattaagcttcataagtgaagaaataaaatacttcacagacaagcaaatgctgagagattttgccaccaccagacctcccctaaaagacctcctgaagaagcactaaacatggaaaggaacaactggtactagccactgcaaaaacatgccaaattgtaaagaccatcgaggctaggaagaaaactgtatcaactaatgagcacaataaccagctaacatcataatgacaggatcaaattcacacataacaatattaaccttaaatgcaaatgggctaaatgctccaattacaagacgcagactggcaaattggataaagagtcaagacccatcagtgtgttgtattcaggaaacccatctcatgtgcagagacacacataggctcaaaataaagggatggaggaagatctaccaagcaaatggaaaacaaaaaaaggcaggggttgcaatcctagtctctgataaaagggactttaaaccaacaaagatcaaaagagacaaagaaagccattacgtaatggtaaagggatcaattcaacaagaagagctaactatcctaaatatatattcacccaatacaggagcacccagattcataaagcaagtccttagagacctacagagagacttagactcccacacaataataatgggagtctttaacaccccactgtcaacatcagacagatcaacaagacagcaagttaacaaggatatccaggaattgaactgagctctgcaccaagcagacctaatagacatctacctaactctccaccccaaatcaacagaatatacattcttctcagcatcacaccacacttatttcaaaattgaccacatagttggaagtaaagctctcctcagcaaatgtaaaagaagcgaaattataacaaactgtatctcagaccacagtgcaatcaaacaagaactcaggattaagaaactcactcaaaaccacacaactacttggaaactgaacaacttgctcctgaatgactactgggtacataacgaaatgaaggcagaaataaagatgttctttgaaaccaacgagaacaaagacacaacatgccagaatctctgggacacatttaaagcagtgtgtagaggaaaatttataacactaaatgcccacaagagaaagcaggaaagacctataatcgacaccataacatcacaattgaaacaactagagaagcaagagcaaacacattcaaaaactagcagaaggcaagaaacaactcagatcagagcagaaatgaaggagatggagatacaaaaaaacccttcaaaaaatcgatgaatccaggagctggttttttgaaaagatcaacaaaattgatagaccactagcaagactaataaagaagaaaagagagaagaatcaaatagacgcaataaaaaatgacaaagggtatatcaccactgatcccacagaaatacaaactaccatcagagaatactattaacacctctacgcaaatgaactagaaaatctacaagaaacagagaaattccttgacacatacaccctcccaagactaaaccaggaagaagttgaatctctgaatagaccaataacaggctctgaaattgaggtaataattaatagcttaccaaccaaaaaaagtccaggaccagatggattcacagccgatttctatcagacgtacaaagaggagcaggtaccattccttctgaaactattccaatcaatagaaaaaagagggactcctccctaactcatttcatgaggccaacatcatcctgataccaaagccgggcagagacacaaccaaaaaagagaattttagaccaatatccctgatgaacattgatgcaaaaattctcaataaaatactggcaaaccgaactcagcagcacatcaaaaagcttatccaccatgatcaagtgggcttcatccctgggatgcaaggctggttcaatatacgcaaatcagtaaacgtaatccagcatataaacagaaccaatgacaaaaaccacatgattatctcaacagatgcagaaaaagcctttgacaaaattcaacagcccttcatgctaaaaactctcaataaattaggtattgatgggacgtatctcaaactaataagagctatttaagacaaacccacagccaatatcatactgaatgggcaaaaactggaagcattccctttgaaaactggcacaagacagggatgccctctttcaccactcctattcaacatagtgttggaagttctggccagggcaattaggcaggagaaggaaataaaggatattcaattaggaaaagaggaagtcaaatcgtccctctttgcagatgacatgattgtatatttagaaaaccccatcatctcagcacaaaatctccttaagctgataagcaacttcagcaaagtctcaggatacaaaatcaatgtgcaaaaatcacaagcattcttatacaccaataacagacaaacagagagccaaatcatgagtgaactcccattgacaattgtttcaaagagaataaaatacctaggaatccagcttacaagggatgtgaaggacctcttcaaggagaattacaaaccactgctcaatgaaataaaagaggatacaaacaaatggaagaacattccatgcttatggataggaagagtaaatatcgtcaaaatggccatactgcccaaggtaatttatagattcaatgccatccccatcaagctaccaatgactttcttcacagaattggaaaaaaactactttaaagttcatgtggaaccaaaaaagagcccgcattgccaagtcaatcctaagccaaaagaacaaagctggaggcatcacactacctgactttaaactatactacaaggctacagtaacccaaacagcatggtactggtaccaaaacagagatatagaccaatggaacagaacagagccctcagaaataataccacacatctacgactatctgatctttgacaaatctgacaaaaacaagaaatggggaaaggattccctattcaacaaatggtgctgggaaaactggctagccatatgtagaaaggtgaaactggatcccttccttacaccttatacaaaaattaattcaagatggattaaagacttaaatgttagacctaaaatcgtaaaaaccctagaagaaaacctaggcaatactattcaggacataggcatgggcaaggacttcatgtctaaaacaccaaaagcaatggcaacaaaagccaaaattgacaaatgggatctaattaaactaaagagcttctgcacagcacaagaaactaccatcagagtgaacaggcaacctaaaaaatgggataaaatttttgcaatctactcatctgacaaagggctaatatccagaatttacaaagaacccaaacaaatttacaagaaaaaaacaagcaaccgcatcaacaagtgggtgaaggacatgaacagacacttctcaaaagatgacctttatgcagccaacagacacatgaaaaaatgctcatcatcaccggccatcagagaaatgcaaatcacaaccacaatgagataccatctcacaacagttggaatggcgatcattaaaaagtcaggaaacaacaggtgctggagaggatgtggagaaataggaacactttgacactgttggtgggactgtaaactagttcaaccattgtggaagacagtgtggtgattcctcagggatctagaattagaaataccatttgatccagccatcccattactgggtatatacccaaaagattaaaaatcatgctgttataaagacacatgcacacgtatgtttattgcggcactattcacaatagcaaagacttggatccaacctaaatgtccaacaatgacagatgggattaagaaaatgtggcacatatacaccatggaatactatgtagccataaaaaatgaagagttcatgtcatttgtagaaacatggatgaagctggaaaccatcattctcagcaaactatctatcgcaaggaccaaaaaccaaacactgcatgttgtcactcatacgtgggaactgaacaatgagaacacatggacacaggaaggggaacatcacacaccagggactgttgtggggtgggggtagagggaagggatagcattaggagatatacctaatgctaaatgacaagctaatgggtgcagcacaccaacatggcacatgtatacatatgtaacaaacctgcacgttgtgcacttgtaccctagaagtataataagaaatatacatataaatatataaaattaaaaaataaaataataaaaaataaataaaaaaataaagacagtgacccctgtgaatagcctgtggacccagaatatggatggatcagtcaaggcaaagttctttcattgtgttctcttatttattcttttatacaaccacgagtgagctgtttattctgggcactgcatccttatcactaaagtaattacaggcaatggtttgaaactatctgcctaaagggaattcagaattagaatcctccatttctggaggggtgttcataggtacctgtcagccctcctctcacttggagggggaggtatttctgcactgtgccaaaaaatcatttgaaaccaaaagaaaaatgaaatatgtttaaagcacttttttgaatatcattcttctgccaggtcttccgctgaaaacatgtgcatactcttttaatttaatacctataattatcctgtgaggttgtcatctcttttccacactagacagaaagaggctcaagctcctacaactagtaggttcaactcaaacccaggtctccagacctaaaatgttatgttcttccagttaaaccacatctgctttgtgttaacttgataaaaccaatgtttgcgtaatcattctaagatgtaaagaatattcatgaatgttaagctcgcagtttgcttatttttatttgatgtttattgatttcaaaaaatgactgttagaccactaagttttagcaaatttaggacaatgcacaccttttgcttcatgtgattgagaagtatgaagtaactcattagaacacattcaaattaatggactaacaccaaagagacagtctttctattttaatgtagtgatagttactctaaacatgaaaaaagcaactttaaatgtatagatattatatattatataatatataatttatataatatataatgcctatatgttataatttatataatatatatttacatgttacatgtaatatatataacatgtaattatatataatatataacataatatataatatataatttatatattatataaaatatatagctatatgttatatattatatataatatataaattatatattatataaaatatatagctatatgttatatattatataaaacatacaagcatgttgtatattacataatatataaaatgtataacatataagtacatatatacaaaatatatttttttcatctgcatgactcatagtacttaacaattttatttagatataggttttgggatttttctttgcttgctaattatgaacatatattttatcttttttactggccatctagaaacaaatggcactgtctttctatatcatcattgttgaacccagttgcagatactgatacagtcttttttttttttttttttttagacggagtctcgctctctcgcccaggctggagtgcagtggcgctatctccgctcactgctagctccgcctcgcaggttcacgccattctcctgcctcagcctccagaggagtagctgggacctgatacagttttaaaatagagtcagagcttgacggcagcctaattttagtcaccctcattctccttgctatagatcatattccaaactagtatttccatcacgactcttattacattcagaattcttacatactttattgcagttctaaattctcttctgaaatttgtaatgatgccgggaagcacttggccaaagtggacaattaaactgcctttggaataacctgtggtaggaaagtcaatacgggaatcaatatttttggactgaagtgagctccacttagaaggatcagcatcatccaagcccagtttttgaaataaaaataagagatgtcttcattataaaacgatttactgggttcattatagaaaatgcatggctggatttttaaagtgttttgatgtcatcatttcagtcacatttaaattgatggataaaatcaaatccaaagttgcaaaattgaagccactgcccttgttttacaccaaaaatagtgactataaaataaagttgcctcagggctaattgtacccattacgttgagtttaatgactcggcagtctagttgtctttccccctgtaaaaattttttgaatcttcattacacatcatcaaactgttacctaaacaccaggggtcctgtctgggtcctgctgctcactgcacagaatgccaatgactgagatcacgattactgccaaggaagaaggctttaatcggatgctgcagccgaaggagatgggagctcagactcaaatccacctccctgacctactaaaattaggggtttatataacaggaagaaaaatgtaacaacgggttacaaaacaggagtgaagcatctggcatctcattgcctggatatggtgatctggtgagtttcatttctttgagactgtttttagaggcctgggggtgcttttctgaggaaggaagtcaaagaaaatcaatgcaatttcaagccttaagatcagaagggtcaatttctttctttttttttataacatgttttattgctttatttttaatttctatgggtacattgaagttatatacatttataaagtacatgagatgttttgacacaggcatgcgacgtaaaataatcacatcatggagaatggggtatccatcccatcaaacatttattgttcgtgttacaaacaatccaatacactcttttagttatttttaaaagtacaattattttttactatattcaccctttcccattttgctaccaaataaaatatattattctttctttctttctgtattttgtacccattaaccaaccaatgctccttgcccccacccctcactattcttatcagcctctgataaccatcagaagggtcagttttctatgtttatcaaaaagaaaaaaaaactgtctatgggactattaggtaggtttcaaaattcttatttgaaattaagcttgggcttgtttctgtgaagttagagtgtgggtcacccccttgagttactgacttcgtggataatcagagcgcttggaatacaagctaggaaaggcagtgtcaagagacgtgtcattgacagctaacactgtgactttcaggaagcgccttcacttctctacgcttgtcttcacttttctaggatagggaggtgccgccacactgacgatgagagttgcatcctgcgtgacttctctatttgctggtggatgggttaagaatatgccaccccaccatatgctgctctggcatgtttaaattaaagacgcttaaaaaaaagccagttacaagatcatgtcattctgttcattgaaagcaggagatagaattcccatacgaaatatactgtcttgataccaaaagggaagcagtgttcttatcatcaagcacagaaaactgaagcccagggatatctatacaaacaaaccttgctacactaacacttatccacctggtcacttctctagccgatcccttaccctcgcccaagtcccttggccttgccacgtttcacaagcaaatattctttgtccaagccagtctatcagtggctggttgtaactgtttctttggatcttcatttccttatgagggctcccaggccacatgaaatttgcattaaataaacctgcatgcttttctcctgttaatctttcttatgtcgatttcattcttgggccgtaagaggacagagtagagctttgtctcccctacactggggggtgtcttttccatatccacatagaagaagcttgttcaaacgtatcaggacattcaggagagatgtgactggtcaagtaggggtggatggcagatgtaaaaaaattatgaggatgtgacagtattggatatcaaataccaaatgtatgtccaataaaatgcaggatcctatactaatttaaaaccagaaatacaagcatgatataagcatcacacctctgaacgcacctccgtgcagctcataggaaggcaaccttccatcttggtttgcccagggcaggtccacattcactttgttgcttttaagtccagcttagcatttccaggaccaaaaaagtctgtggttaccccatgtatgatggatgaaaaggtgatctgctccatgtaaggctgcagaaggctgactctgtcccctttctattaaaatccatggtgagcagggatatggaactctgcatttctaattttaggctggaaaacttgcctctcaaataaattatggaagcagagcctttattgagaaagcaataaaacagtaagatctatttacaaaaagcaaccatctcaattttaattttctctacttttcttccagatattctctgtgtaaatgctatatttttcttccagtttcaatgaactgctcttgtagggatctctttgaagatttcagtgggttccgagcactgtgcccttgttcatttgtgctgagtggcgcacgctaggaccgaggctccctgagccccaccgtgctaactgatggctggtggcctttggaagcacgctgctatcttgaagacagcagggccttgagtaacggccaagtctggcctgtaaaaacacttgatctttgctccacttaagtctctctcgagaaaggtagcactgctctctcagtccactcttggtctccactcagtgaggaccagagtccgtactgatgacctggggacagagcagctgtgagctctgagtaaatgcctctctgcacctcctaccaaccctttgtttccttttccatcatcatatttgcttatctgaattttaaggcttctctcttttaaatctgcaaattttcagcgtgaccgaaatggattgctttgctcactgcatctgctttttgttcctcaggaagttcagcaggctggaaacaatgaccacttagtgtgcttatctgcttcgaagtaattgcaataccttatatttagacacaataaaaatacatgagagagctgggcataaattggacacaatgaatacttgttgcatgcgtaagtgggcaaagatgatagtataattttattcaaaattacaaatattgtctcttttcttttgaaacggactataatagaggtgtaaaggaccaattttaaatgtgctaagccttacaaatgccagtagaaagtttaatcatccagtgatatttataaaggaggaattgagaaatagacagaggtgctttgaatttagattttagactttgaaactgctacatgatttgaggcaaatgactcatcctacgtgtctctgttccctaatgtcaaatgaggaaatgtagttataatgaaaagttactctttatcacatgtgcaaaacttaactacaatgcatgtgcttaataaatgttagcaatgctcataattattatttatacaataaaatattggggaaaaggccacttagcaaaaatacaaattctagatttttcagtgaaatgaaatttcgtggcagttctgcaatatttctgtagggcactctgaatttctttctcctcaattaaaaaatatttactttaaaagttgctgggtgaaactgtagcataatacggattctgacatgctagagtatactgtaatactatagtaaataaaacagtgtaatagtggttaattaactgatagcaatcaattaaaaagaatagagagatcagaaatagactcacttagatctcagacaaaggagcaaacttaaaaagttaaaaaaagtgaaaattaagtaattaaatgaatgaaatattatgaaattaaaaagggttacttcactttcgaggctctgcatagagttatgtacaatattctgattttataagcaggaatctaagggtcatctaagtaaacatgtgactgatacacttattcccaactcatcataaaatgagaaaaataacagcaaccaaacaactccatgctttggtttaagttgtgagacaacgcgctctaaggttgggaacatgtcatgactttcagggagctgcacacaagttcctacacacctccccaccttctaacttatccacagttaccatgaagtgaatcatggaacttgcagctgagcgtcaggggcctgtggctaacattggactaagccatctccagatgatctagttaactccagtattgtcctcccctcataccacccttgctgatgccatcagaaatgccagagtccccttcggttatacaatgtttcaggaagaaaggaaatggcgggatagttagaagtaattatggatagacgtagaaagattcttgaagacagaatagtgtttttattctcactctgctcatacatttccattttcttcttttcccggaggagccatttccattgactgtgtcttcaacattcacctaaggacagttcagttcactcttagtccactgaacagaaatatttagagtgtgcttactatgtggcaggcctggttctgaaggccttacacgagtcatctcctttaatcctcacgtcaatcctatgagtaaagtactataatcaatccctttttagtgatgaaaacatgatcactaaataaagcagaggcccagagttataaagtgattttcacaaagttacagtctattcattggagacaccatgattccaaactactgggctcagaaagaacatgagctttaaatcagatatttcctccagcatttcatagggatattgattcaaattaaataaagctgcaaataatcacgttcatcaattaagtagtaaaagtgctatacagtgtcaccagtaagtactgacatatgcctaatattttaacaaggtaagggtggtcagtaaatggagttcttgctttagcaaacataaaataataataaatgtaatccaaacattgatctaggctgcgcgtagtggccaacatctgtaatcccagcactttaggaggctgagaccggaggatcacttaagcccaggagtttgagaccagcctgggcaacagggcaaggccctgtctctacaaaaaatacaaaaattagccaggcatggtggtgtgcacctgtaatcccagctacttgggaggaggctgagtcagaaggatcgtttgagcccaggaggtggcagtgaccgaagatcgcaccactgcactgcagcctgggtgacagaacgagactctgtctcaaaacaaaacaaaacaaaaattacctgaatctaaaatttgccagcctttgataaaatatttgaagcaatttcttctgtatgtgggtaaactgtcacagtagtgttcaaggcttctcaacatgtggggcaatacaatgtctgtactaactaggggacgcctcccaaatagactgttagtcatcatctacttttcaattagccaaccctggcaagtgtttttacatcagtgagatgtgattcaacggtactgtgatgatatcatagcttccactctcaaaatattctttcactaatttgtccttaggggctgtgtggagttgtaggaaggctgagaagtacataaagcgcatagctgatacatctttgccacagtttgtactgagatactcttaaatgttttcttacttttataagataaagtttaatttataaaaaaaggaatagtcatattctaattttctaaactagcaaaattgaggttctttgaataggtggtctaattacccaaatacattgatttcatttaatgtataaataaattaaataacaacaaataaattgaataattaaataaattaaagtaaaagtcggccccatgatttgactggttaatgcatgtttgtgtgtgagggtggggagtgctgacgggtttcatctttaccctggtactaaagtatctttttctctctaacacacatggcgacatcctctagcaaaactgtatcaatgggccgggcttggtggctcacacctgtaaccccagcactttgggaggccggggcaggcggatcacctgaggtcaggagtttgagaccagcgtgaccaacatggtgaaaccacgtctctacaaaaaatacaaaaaattagccgggcacggtaacaggcacctgtaatcccagctactcaggaggctgaagcaggagatcacttgaccctgggaggcggaggttgcagtgagccgggatcgtgccactgcactccagcatgggtgacagagcaagactctgtctcaaaaaaaaaaacaaaacaaaaaaacaaaaaacaaaaacaaaacaaacaaaaaactgtgtcaatgaagagaagattggcgcttcctttatgcaacacagtctgtaatttctatttcaatgtttcactgcaaggcatctagaaacttggcctagccaaggaggaagctcaggacctacctgaatgaataattgtatttacacataactttataatcttccaacctttggcttctatcctatcctaacaaaaatatataacaactgacagtgttcctaagtaccctttcgtggcaggcactgggctaagtattttttatagcaatgtaataaacaaataaaaccctataaggtaaatattatcgctattttagaatttgagaaaatgaggctcaataccattttttacacatttatttctctttggtttaaaaaaaagaggcagtttcagtgatctaaaaatatgatgaaagagagtctgtaacttgaatattttcaggcagaatttgaatctatgacttctatggcttcaagattaagcatgtttcactgtgaaaacacactccaatattattttaatcaagagctctcatttcactcccctgaatgacggtctttgtccagctcatgagacaggatgctgggcatctggtctcatcatcagcagagccgtcactcagcgatctgcctgctccgggtgagatctcagtcaacttcgcaatcatcctctgactcatctggagaggcctggggaagccactgcatccgggtctcctatcccagccgctaatgaccatggccctacaacattgtttctcctgactttacgttgttatgccccatacacctcagtgtcctgggggcaaaatccttcacagcccccttagtcgctatcctgcgatttcaccagcaccaccacaatttgtatacaccccactgaacttcaagttatgaccacatacccaaaagaagagactcagagaaacagactcaggaaagagactcgctgctttctgtggagcttgtcacttctaacgtgcctccttcgacctaagccaccagacatttatactttaacaataattttttttttttttgagacggagtctccctctgtcacccaggctggagtgcactggcgcgatatcggctcactacaaccttcacatcctgtgttctctcctgcctcagcctcccgagcatctgggataacaggcatgtcaccacacacagctaatttttgtatttttcgtagaggtggggtttcaccatgttggtcaggctggtctcgaacccctgacctcaaatgatctgcctgcctcggcctccagaagtgctgggattacaggcataagccaccacgcctggccacaacaatttctgagaatgaacttttctgaggcccatgtgccttttactataggctattctgagacctctggaccctaatatgcatggcaaaaatattattaggcattagtaatgtttctttggaaaaatgttaatattctaatggtactttgatctttatatcctaacaaaatgccattcaattatcaaaatagaagggtaaaaaaaagtgatcctgtttttttgtgtgattaacttggatatgacttctttatcatcaaaagtaacattaatattatattggtaaactcttaagaaggtttacaatattaaagttcttcttagtaataatcaggaatacatttattctagatgttgaatacaaatcaatacatagagataaatagataccaatagatagtcacccacactgtgtcaagtaatttgctatagtgagtaaaattggtcaggagtcaatgaatcaatactgttcatcaaatgcttgtcacgacaacaggcataatatgttctgggtatataaccaagtaggatgcaaggtcacttatcaatgagattatattctaggagaaaatgaaatatatatatgataatttttttttcaattattgtcagatgtccaagaaatgataaaatccgagtaatgtggaatataatgacttttgttaagagtgtgggataggctgacaattgtgggtgggctgacttagctgggtattgatacgaggagttgatactgaaattgctggtcaaattatggcagcaggcagccgcctggagattcatttatccattatacatatcgttactgagccctacaatgtccccagcacagttctacagtgaatagaacactaaaatccccacccttattccatgagagagacaataaacaaaataaataaatgtgtacatatatgtagttattaggtaataaaaagatataaagagaaaaatgaaacagaacgggaattagaaaatgtatgtgttgtgtgtgttatgcttgttatggtgtgtgtgttgtatgtgtgttttgtgtgtattgaatatagatgtgtgttggcgtcgtgtgtgtgtgtgttgtgtttgttatggtgtgtgtgttgtgtgtgttagggtatattatgtgctgtatgtgtgtttcgtgtatgttgaatatagatgtgtgttggcgtcttgtgtgtgtgtgtgtttgttatggtgtgtgcgtcgtgtgttggatataggggtgtgtgtgtgttgggtatgtgtgttgttagtgtgtgtgtgttgtgtgtgttggggtattatgtgttgtgtgtgtgttgggtatgtgtgttgtgttagtgtgtgtgtgttgtgtgtgttggagtgttatgtgttgtgtgtgttttgggtataggtgtgtttgctgtgtgtggcgtggtgtgtgtgtacatgctggagaggggctcacagatctcaccaacaaggtgaatgtgtccatagatggggcagggacctctgaaacccagggaggccatagctctgtcatggagtccaggaagagcctggtcatgctcaggggtccacacctcacttcctagacgtcggcttccaggagcacagcagcatgactgagcagacagacaggggtcactcaggctgaggattttcccaaactgacacccagaagactgatcaacagctctgcctgctgcacaccagggagtaactgtgtcaggcagacagctgcatacatgagtctgggaaagacggccaggccgaaaacaccatctgggaaagcatgtgcatagagacagtctttaagatcaggaggccgggtgagatccccaggttcaggttcagtggaaggccaggcccgagactccccaccctgcaaaactcaggagaaaaggaaggacccagccctgggcatgagagggaggctgggtgggtggacacagcagtggaggaggtgctccactgaactgctgtgggctttagagggaatgaaaggggagaacctggaggaagcaggtgccattctgcttcgaaagcaacaccaaaaaagaagtggaaagagcggtccaagcagaagtaacagaaagtgcagggagccaggggaacgcggcaaggaatgagccaggacatgaagcaataccggatcctaaagaccatagaaacctgctggattcattctgggtgtgaggggaaatcgcacatcattagcaccacgtgtagcttgccagttcagtatgtcaagaaaagtagtgaaaattgtatcctacctgagtttttaaagatgattaggacattagacgaagacatgaaagggaatttggaagagaaaaagtcacgtggaagaaagaacatcacaaaagaattggaggccctgcgtgtgtgtgtgtgtgtgtgtgtgtgtgtggttattgaagaagtgtagtacaaggatattgcaggagcacagggggacatatttccaaggacctcgaagacactgtctgaaaaccaggtttatcttatagatgcaataaacgctggaagactttggaacatgggcaaggatattaatccatctaaaattatagtgccgcgatgcagaatttgcaagctaatgccctttaccaaaaaacacttaatttcctgtaagaaatgacaaataaccacaaaaaaaaataatgactcaacgtgtcctgtatgctaaaactcacttttattaggtacactccaattaatcctcttggtagattgaatattaatataaaatcatgagaaatacaaatctggctttaccttatgataattagcgtttatcacagatacagaagagaacaataatataatatttgctaattgctttccaccaaataaaagaataatattattttgaaggatgatagtactagaggaaaatgttcacgtgtttcacaaaagcatccagaaaggaaatttaggtcgaaatatattaaaaataatgattagaaagattctagcaaattgtatttaaaagttactaaaacagcagtttggctggaaggaaggatgacagctaaaccctagtctgagcatattcaatacatgatgaactggattcagattataaatcaaccagcaaacacttttccaacttaaaatagcattatttgtttcatttcacagaaattaccattatattttttacaaggtatattcattgtactcatttgatatctttctaattattttctatctttgtaggaacaagacaaatcagaccttccaaaaactacacttgaagatatgggatagttttttccagtgttagaaatatgacttgtggaagacctaccatttgtatatttgcacacgtgcaaaaaaaagctgttaagattttcttatgggggacagggaatgagacatttcctacatatcagttaccttgaattttcacttgaagccatggttttcccagatacataatgaacgtatcttcttcggatgtcacatggttgatgttattccatatgcccttcaaacagacagttcaaaccataaaataggcaatttagacaggcacattgctcttcctgcaagtattctaataataataatatgcagtgcatgcaaaatatggtgccttccatctccgaagcacttcactaattacccaatgtgttcaccttggcttatctctttgacttgtcgtatactttcacatatcttcaaacgtgacttagttttcttctctgacataagctaccatggactgcttctgcacatctcttctctgtgaatataatgcaaatgcagtgaacccaacggatgtgacgaaagaaatgctaaagcaaatcaatataatcatttggtgtaattaaatgatctaatttaatccaattagtgtggtaattaatttgggcagatcaggaaaaaaatgagcgctttggaagattgaaacgtcatcattatataaccctgatgcacattaaagctcatccattttgcagataagacaacagtcagtaagggaagtccaattgtccattttaatcgttaaagtataggatcaagttataaactagatgtcaagaatatggaaataaggtcaacaggagtttctaaaatatatttcttctactctttatcatttgaattaaaatgtattcccatagtttaaattcccttatttctatattagtgtagctcatatgaactcccatgaaaatagatttatgaaagagaacactttatcagtcactttgccttccatatatgggccacgtggactatagagtttgggactgtagatcgtaggggccccaggatccagtaggtcatgggttctggtgaatgtggtcacattcctcttccattgagggcagacacaaggtagcagcttctcctgatgccatgaataactgcaggcccaatattgctaggtcatcaataatcagcataatcatcattcagtctaaattggcttttttgtttttgaaacttttcattcagtgaggctaaattatcaagtctgggcaaaacttatttctctccagaaaatggtagtcagtttcagtttcatgattctgtaattctgtaagcactctaatgaaaggatttaaccagaaaacattttcggttttctccttacacctttaaaatgtgttttaaataaaaccaggcttaagagatatgtactttttctgaattccctttgatcatctgagttcatcttgatatttaactcttggtctcttcgttatgtttatatcaaggctaattaattatcttgctgacttagtttgcttgtgtataaaatggaattctttaattgataagaaagcttcattgattagtttttaaagtttctgactttagttactcactaacaaagacttgctcatgtaagatgattttattacaagaatatagcagttcccccttctgactgctgctggaattgttttgactctgtgggcgccaaacatgaatcattcataatcctccagaggttcagagattgcctcatccaattacataggaatagaaagtaatttagttattttcttatataaaatttgatgaaaattcatgtgttacaatgcacttctaaaaagtagtgatggaaatgctaaaatttatacttccttttttaggtctgccatcatctccaggttgtttctcattcactatttgaggtaaaagaatgtgctctctagccattacgcaaagtgagtttttccctttagtgaatcaattatattctttaattgtatgctgaaaccacttgaaaagcattttacttctatggttacaattcaatttaaccacctgtaatccaatcaggctatacattgttttatgtattttaatagatcctttttttctgtttatttaaaaaattatatgatataaacggtatgatgaataattgatgaaacatcttgttttgcttctagttcccagtgatgctgttctcaaatctatctagacagcagtccccttcacagcaatattttccatagcacttgaaaagatattttagcttctgcagtgacaaacgcctgtttagaaagtggaagcataatttacttacctgactgatgaagcattttttacaatctactacatttgttttatatggagatgggtctttgctaagaaaacagggtctttaacaattgcaaaactccattattacattttatgatggagcaaactagattagagcaattctccttcttgttttattaagcctttatactactgttagaggttaatggcgctattatttttcctaccgtcaaaatctgctttaaagcaagacctacagcacttagtgctagaaatctggcacacggattagcaggcatgcctgcttctgcagcagtgttagaaatcactctggcctactaccattcagataaatcacacgttcctaatacagcactcgcgtccctaaaagcaagacctgatgatgagaggcatttctggcaatctagtaacacgcctggtattccttaataatattattgtgaagcaaaatgtgtttctcacagatgagtaaagaggatcatgttcattactgaagattatccatatgcggactaatagagtgaaaatgtatctggttatctggaaaattatggcctgatgaaaatgtccgtgggaaaatgatttctgaaataaagtttctgagcttgaaactacataagcatcatttgcaattgattggattaggggacatgtcacaacttccattctgtggtatcctgtgttctaagtcaggcatccaggctgatgaaggtcctcactccattctcctttcctttcatcccaccctccttgtacccacatcccacctcaagctctggatctagcgaagcactctgcagaaaggcagcatgcattcgctgaaattcttcaaatgaccttcctaaaagcaagcatgtctcagccattgactcagtaacaaatgaactccttcagcagtgggatggaggaaaattagtacattacactgtgttttctgactgactagagcacacaatgtagactgacaattagtttttattaccagctgctatcaccttgtgacagaaacttgaaaaatttctcataattttcctgtttccttccatgcagtggatatcatgattctgaaactagtgtgttttactgacatggatgaattatttaattatttgtgcttttctccatacaacacataacattttgataatgggcacagttttctcttagccagtacctagcaagtctacagataagacatttcagccacggaggaagtcctttaaagaggacttggtggcgcctcacatggccctgctttcctacggctttccatcctctatttctatggatttctatattttatgggttgatctactaatattttgaaagatagtgaatttccatttttactcaatcatcagtaaatgttactaccgttatgacagcactctgtgtgacaaatatttactggtgatctgaaacactataagactataatttcccctggagaaggaacagatgctgatcatctttatgacagcttctggatgctccgcaacgagggactgttgaatgtgtgagtgaagatgtgaaatataaaaatctaattgaagaaaaacatgagcaccctcttcccacacgacacaccatcccataactacatccctgggttatatcccatagctacatccctgggttatatcccataactacatccctgggttatatcccataactacatccctgggttatatcccataactacatccctgggttattcaattcaccacctgagcatctgttgtgttcctgagactcttataaattcttagtagagatcagagaacaaagtagaaaatatgcctgtcctcataagaatgatacaaagggctctgtggacgttgggggaagagtgggagtggggcgagggataaaagacaacaaatatggtgcagcgtatactgctcaggtaatgggtgcaccaacatctcacaaatcaccactgaagagcttactcatgtaaccatataccacctgtaccccaataacttatggaaaaaatacgaaaaataattttttacaaaagaaaatatacctgccctcatgtagttcagtttatattctactgggagatgtgagagaaatgaaatgaacagggttactttatgtgtgtgtttatgatacacactcaaataaacatacacgtatatgtatatgtaatatgttataataacttaaaaaacacaaaaacagagcaagtaacagaagaagatagaaggtgtggatgctcaagtcaacagccataccaccctgaatgcacctgatctcggaacctaagcagggtcggggctggttagtacttggatgggagaagttgtggatgctcaagatacatgatatttagttagggtgatcagtgacagctgccagagaaagcgaattttaagaaacgatgtgagggagggaggatgtgatacggcttctttgggacattatttcaggctgaggagagaggagagcaaagtccctggggtgttgagtgtccaatgtcctcaagaaacagcccagaaaccaagaggaccaggatgcaagggtgggagcaaaggagttctttgggtcttcataaggaatttggactcgttctgcctgtgacgggaaacgtttgagggtctggagaagaggaaggatgtggttctactgatatttcacccagatccttctgattgcagggtgggactttgtcagggcagggagaggctgaggatgacatgatgatacaggtgaggggcgacggtggtttgggggtaacgagaaaggcttgggatatgtcggggggcagtcagggctcaccaagaggccggagagaggggtgctgtgaaggtctagggactgaatggtggaagtcacagacttcttctgtgagaggtaagagggagagagatgcctgttagacatcaacgtgactcccaagtaagcccgtggataggaagttctggcccgtagaagagaaatgcaggttaagccacgtaatccacctcagtccattctggaattggatcatctcgggacaactttccgaagatgaatatgagtgagctggttttcttctctctttatttctcatggtagccctattcatgataattcatgacttctctttttctttgtctcagcttctacagatcccagagagagaacagttgcgaaagtctgtccccgggctgaaccgaagctgctgctggcggttatggtgctaaactcagaggctgacatgagggcaaaagactcttcaggatataggattaaaccttattttttttttttagcatattggaatttaacgattaagagaagattacccactagtgtattttatttgttcataaattattccaaacttaagacaactaaaactacgaatattataattataagtagataaatacaagtggaaaattattttctgaagtatattttgcaaaatggttcaatcagtcagggtatttacaaaagacaatccaaacactctacagttataattacatcattaagtatatacagtaattgagacatcactttatgtggccttctaaaaacagagatacaagttttaaaatctgcccttccaaattatgcctgagccacaacaaaagccagagggagatggaaccactgtgtgtcgttatgaaggacaagagtccatcagttgcttttcattaactgaactgtctctttggaaactaggggcgaatatcattctgttttgcttcaggtctcttttttttttcttttcagggtaagaaaacattgattgcccaatacaaacaaagagcaaggaagtgaacgtttatggttaaatacaggagaattccaggggcatttattttataatgttgtgttgttatttttcccaggggcataaaggcaatgcattagagtgctcagttttccacatttaaaaaatcatctttttattaaataatggttctggattaattgccccatcctgcatggctacaaagtgttgtaactgcaaatgctcctccgtacacagcatgtcccatcagctcatctgagtgagctacaacaaatcaatatcgaattgggcaagtcatttgtctttaactttacatgtggggaaaatctctacttcaaaataacaaccaatgttttgtttatctttcttcctagagatgtatatattttggagttagaagggcatccacagattatctactttagtaatcctcacattgagagctgctaaaactggtttctgccaagaagaatgctcagaagaagaagaagaaatgacaggtactgttaccatcattaaaaaatagagtgctggccaggtgcggtggctcatgcctgtaatcccagcactttgggaggccgaggcaggcagatcgcctgaggtcaggaattcaagatcagcttttccaacatggtgaaaccccatatctactaaaaaatagaaaaattagccgggcatcgtggtgcatgcctgtaatcccagctactcaggaggctgaggcaggagaatcgctggaacctgggaggtgcaggttgcagttagctgagatcgcaccacactccagcctgggtgacagaacgagactctgtctcaataacaaacaaatatatacagtgtcagtttaataatttctttggtattgaaataatctactttcagaataaagagcagttcaccatttcagggtgagaaagaaaatgggggatgggtgcttgctcagtttattccagatgcccttttggagacataatattgcccatttacattgcactttttccaagaataaaataattcaaaatttagagcatataaaccacgtaattataaaatacttagatatttaagatattaatgactatcttaatatctttgggtttttcttcaaacattactgattacaagctggtgaaaaaggaaattctaaatcttctcattctacacttaatgttgagagtcgccctcaccgcacagaagagttgaaatatctctaaagactacagtcgcgctgccctatgtggttaggttttgtgcatgttaatgatgaaatgaattgtggagggttgaaagcaaggctgtgtaaagaagctgatgaacgtgggttcccaaagcaaaattcacaaaagactcatcagattaggaggcataaatgaaagaatctatagggcttttgttccaaagcacagagattcctttctcccttttcattcattcattcattcattcattcattcattcattcattcatcagtagatactggttgtgtactggtagcttgggctgtcaggggatgaggaggtatggtgtgtgatctgtgggtcatggatgggaaaaccccaaactttcaaggggctcatcttgaactaaaggtacaatcaaggtaggtctggtagaaaaatttcactggcctagcaggaagaagcagaggaagagatgagcctgcaggatgtgcacgacttccaaacacaggcactttcatctttcaagtgaaaaaagcaggagtttgttttaaatctatggccagctattacatacctgtataaacttaactctcagctgggcatggtggctcatgactgtaatcccagcacttaaggaggccaaggcaggaagatcacctgaggtcaggagtttgagaccagcctggccaatggtgaaaccccatctctactgaaaatacaaaaaaattagtcggacatggtggcacacacctgtactccctgctatttgggaggctgagacaggagaatcacatgaacccgggaggtagaggtttcagtgagctgagatcctgccactgcactccaacctgggtgtcagagtgaaactccatctcaaaaaacaaaaacaaaaaaacttagctctcttaagtcttataattagagcagtcctccatcactgtggcagaagaaaaaaaccagtcagttagacagtgaaggctggttgttggagatgcagccggcctgaaaaatcacagctacaggcaaaaatagagcagcctgggaaaagtcagtctgcacctggacagatgagcaagcaggattcagcacagaagccttctgttctttgcgtgattagcgagctcccaggaaaaatttcctccctttttcaggcatatacccagtgggctccataggaactcacacagggaggagggggccttcctaaaacaaatccacagttatacaaacaagagaagtggtactttgtacttgcctagggacataaccacaacaacataaataaggggtagttatgcagacagctttacagattagaaaagtgactcaaacagctagagagataagaggagtttctcataaaagctttgtaattcagctgtcaaagcagcaacccatttgagatcccctctgccttgtgaaaagctttcttctctcgcttattaaactttcactccaacctcaccctttgtggccacgccccttaattttcttggtcatgagacaataagcttggataacaccttagacaaccagaccactgaccttgatctgtttaattatcaaactgcaagtttcctgaggctgtcagggaaattctcccattccttgtcatgatctctctctttttcttcctgcacttgctgaactcttgctgatgccctgacagtgagcagaggggagggtaataatgaacaggactttgggtggatctgatatagtcagagggcatggatttcttgctttgcccagtgtttgtttttacttttattttttaacatctagaactttgggtagaacttgccctctcgaattcaccaaaaccttgaacattttctatcaccatgacagggtcccaccaggaaacagatgtcatttggagaagaagccagtcaggcaaggctactttcaaaggctctgtttgcaaaagggtgaatctggggacaccaccagggacagggcagtggcaggggaaggagtcgccactgagctgtggctgctttctgcactgaaggcaacaaggggcacaagttggtgctgaaatccagagggacatgaacgcacaaggtcaccctctgcaaagagctgtgacctctgatttttgtgccttggagcagagacagcttcagggggctgcaggaggcagctcagccttccatccataccctggtgcttcccacgggcagaatacaggagctgctagcagtgtccacccctgtctggctttggtgaagccagcactggatgaaaacttcttaacggggacagcctcacactctacagtgaacagataattccctggccactgctgtcacttcttttactcccaggggagtcttctgaaaaagaacgatcataaacaaacaaaaatgtccagcttacagaataaaaaatactaagatggaagcaaacagagggggctgtggaacaagagctaacagtgcctgcagaccctgagctagacattttccataaatcttctgtcatatccgcaacaaaacccttagttggggaaaggattatatcacttctgcaagagaggtttgtgtgcttggatctaatctctagaatctcaagaactgtggtctcccagaggaacccagatcttggggtgaagcagaagtggagagactcaagttaatggaatggcttgaaaaggaatgaggcctccactgaaggcaccagcacttcactccctgcagacagaagatgaaatcctcatgtcagcaataggcatgtgggcagccagtgtcaccttgggtatcaagaacgtaaagcactttcatactcagtctcctacagatggtaaaggattcatgaggtgctgaagaggaaacggggctcatggtgggaacgcctaaggcacgcatgacgcgctggaacgtggcctggcctgtgcctacctcccctaccgttcgccccgtgtggttcacttccctccatttactatggaaggctcctaaggtgaacagaatgcccactgcatgccacactctgcaacaggcagtttacacccctcttgatttatcggagtgacaaccctatggaaaggattactattttattaataattgtgtaagcgatgacatttgaacttgaataaggcatatacttgcacagctattgaatgcttgcctgtcgcttcaaaccctatgtcctttcatcagtgaaacaatttcattttctctgtcatacctttctttggaatgacacattaccattgattaccttcctcatcttagaaggctcaaggtttccattcctcattttccctaatgattaattcccatgcttgacaaatactttaataccgttaaaagaaaggacagaacgctaataccaaatgagtcattatgcatatgtcaatttgtgttcagatgaggacagaagagatattctccttattacaaaagaaaaaaagctctgcctcaatcttacagtagcagaaaaatctgatgcccaaatgatcggatatccaacctgatattgatttaatgtaagagtttggccggatatgtggttctacattgaactttagatcatttgtgcagggttttatcataaaaatcattttcaaactactgtaaatactatatctccctctacagaacattctatactaaaagctaacaatatcaaaatgttaaaattttatttttaaaaaaccctttattccttctactgtttctcagatttttttcccttcagttttcccatccttttccaatctaatttcattaaagggtgactggctgtgattattcaatagaaagtgccatgcaaacatttacagattgattttttttttcttttggaagtgggagacacctaagaccagaggggtagtcagagtatggtagctcctctctgcctctgaggcccaggggacatgtttacctctctgtcctctcaacctgcgcaggactgagcacagactatggattattgtcacacaagcaattgtcaggaaatcctaaagtgataaagatgtaggtcaatctatagtatcgttgtcaaaagattgtgattgtttcttttattagttttagcagaatatttgttgcatataaaacctcatgcagaagtctgctctagcatgcagatgtaaacagaattgacccgagagggttcagatgtccatcccagcccttccactaattgctaggcaacggaaaaacaatatgcacagatgcaaaacaccggggacaggcgcacccacagagcaaggctagaaacatcacatgaaaagattgccagggaagcatagaaaacacaacccaatgggtagaaagtcctagaagaagcgtgagcagaaaacggcccctacaggaagtcaacccacttggtatctcagtagacggtactcatctctcgtttgtaagaaaagcaaaccctcagtgaagctggtacccagtaactgttatgacatgtgtaaggtcgtgtggggagcaaaaccagtggagagctgactgcacctgcagagaaagaagggtctgcatagtgagtctccaaggagcacataggctgttggctttcagctaaaggacaaagggcccttctggcagagaagcaccatgacccagtccaggcatggtcagggcttcctatggctgagtgatgacgatgggcatttaggagaaggcaccaaaatggcaggtgtgggagacaccttcattcctcccacagctattgatctggtatctaccaggtcctgggcacgtgcaaaagtcatcagccagacatgtctgcagatcttgttttctctttggaaggacgtagacattgcccgaaagctactttactctccaggcagtgaatggtcaataatatttcaatagacaaaagacaaaaaccaacttctcctttgcagagatcagtctggtctggtgtgtgtggggtgtgcaaggacggagagagactggtatgaaaatgactgaccgtgtcacatatacttaagagagacatctggagggtccagtctcagacagtgatcagggcagacgtgacacatggttaggagttagaaccaccacgacattcctccgtaacaaagtgaagttagtgcatgttctttctcccagaaaatacttttggatatagaaaagaaggaagagataacgtggggaaggtggtgggtgggatcgcttcttaactgctccattctctcctctgcttacaagggcgtatcaatcctcagatagaaaggaaagggactcacagacagagtttttatggcttccatccttgctgggcagcatcttgactcctcttgacttcaactcaatcgcctttttcactggaagaaacaaaaccaagccattagcaggtaagacttggagatcataaaaccatgttgtatccacacagcacttccagtcataactgctttctatcaacccccgaaaatgggaaatgttctaagaggtgaatgataccaagtcaatgaagtcaaagagcttgtaaataattattgtgaggctatcaagcagcaagatcacatcttacagcatcagtgtcggaagctaaaaataatacgtgctgccactgactttacacatccaatcctatttaccactaggagtggcagattccaccaatcattatcattccccaaattgttcaggcagatcactcacttcatgtatctatcctgactacagagttgtctaagtttgctataatcatgaaaaaaagtttagataaaaaggccagttgctcattcatgtattcatatattcatttactcacagtttagcgaatctgtgtgggtggggagcaagtagaggaaaggcatgctctacgtgctgtagataaagtgctagacaccaccagtccctccagacgctttccaggctgtgcaaaaggcacagaggtcctggcttctagcatcatcattctgagagttaaatatgtttcttgatgtactacggcctgcattaaacattttaagaagtttcattttttttttttggtcacttacggaaaaaaaatgggggatgcatcttgtgattatagaatataaaatgttatgatcttctaagctatcccacacttggctttactaagtgcccagtggaaacatttctgaggtccccatatgagactggacctacagcagctgcgagcaggcagatcggctccaaatctttgcttacaacagggtggccccatgacctaggtaagttacttgcctctgagcctgtgactctatgtgtaaatagctgtgagggttagttttatgtgtgaacctgactgcaccacaaggtgctcagacattgggccagaggagattctgggggtgtctgtgagaatgtcatggatgatattaacatttgaatcagctgactcaggaaagaagatggctctccccagtgtgggtgggcctggtccagtcagatgaaggcccaaatagaacaaaaggctgatctgccccagtagaggcaagacttcctcctgcctgatgggctttaaattgcagcagcatgtttttttttttttttttttttttttttttccctgctttctgctttctgactggagctaaaacaccggctttcctggtctccaacttgctgacttacccctttcaggtcttcggtcttgtcagcttcataatcatgtgagtcagttccttatagtaaatctgtgtgtgtacgtgtgtgtgtgtgtgtgtacacatgcacataaggagattcatatagatatgaagtatatacaggagacccctgaagcatacaaggggttggggcactgaccaacccccaacccccacacacagctgaaaacctgattatatcttttggctcccccaaaaacctaaatgaaaatagcccactcttgaccagatgccttaccaataacataaacagttacttaacatatagactcatatctacatatattttacgcattcatgacacacctttttggatttttttcctgatatttttaggctataagagttgtctgcaagttttttgtttttaattgtcgcaaatttccaaaaaatgcttctatacattcattgaacagagtctaaaaataagtggatccatgcagtttaaacctatgctgctcaagggttaactgtataaataaatctatctatacacactcaggcacacacacatacccacgaccaactggctttgtttctctggagaactctgacgaaatacaatgccaggatgccaagactgtgtaaggctggagacgatcaatgcaccatctttagtatggtgtcctgagcccagccaactcagtaaccgactgtgtgtggcagtgattgttactcttttcaaatcactgacattcagagggctgggcttaggtggacaattgccctttgggactgtcttccctcactgatgtcactaagcacctgcttcctctctggtcttcctgtgcttggcccctgtgtattctgacacacctggagaccatgcctcttggactctacccctcagagtccctgaaaccatgtgttagcctctttgcagcgacactgtgcagtatttttcacttcaggaggcatcctccaaccttccaaaagccatctgagataggaattatgacaccgccagctcatatcaggaagcaaggctcacagatgcacagggaagactatgcagaatttgaactgaaatcttccagccccaaactccaaacctttccacgtgggctactggctggggagcatggagacaggagggcagggctgcaggagctggtccacctggaaggaggagggtgagatcccgaagcaatgccgccagctgtgcttctgtatcatgccttgaccttggacttcccagtatcaagagcggtgagaaacacatattatgtctaaactgccaagtctgagatattttcctatagcaaatgtttgctatatttcctatagcaatattttccccaaaagacagcacttctcctgggtattttaaaagggtaagagggagaaacgagagactggaaggaacatacaaactttgaggagcttttcccaacagtgtagcttagcaatgaagaaataagtccaatgtggttacatggctggaaaaaactgttgtcatcagagccatgaatagaccacagggatcctggcattgactcttgtggaagacgaggaggtgggccacccagatccccctccaaggaagggctggccagagggtggctgttcatcttcagcccgtttcagagaaagcccagagacagacagtcacctatcccaggctcacaacgtccagcccaggtccaaccccaaccaaagggcgctggttcatgaacgtcctgcactacggaactctcagagagggacttgctctggtgcaaccacggcacctggcgtcttcctcctcttctcttctgcctcttcatgtgtgtgttttctcatcctcatctctgtgttgtggtgacaaatatcacaggaaagggaacacgagatggggtatctgcttccacttctgcggttctcctggtggcacactcagaagtcctctgccagctctccccaggataatgctttcatccaaaatggcaaacgtatcacccccactatcttgtgctgaaataactttatcttgaagttactcaggagagaggagatgaatgcacaataaataacaaataagaaaatcaatgggaaataataaagagcatagaactcaacgcaaatgtcactcaccctaaacagataagacaaacagagatctgtttactcagaatctaaacagaaaattcgagtagtctctcagggacgatcaaggtatgcgaatagacaggacctatctgaaagctggatgagctaataaatttcgtactcttgcaaacaagtgtttgatgctctgtaaagctacgtctccactagggaatatatgtatttatttattatttttcaacaagacagtgttatactgatgtagactatctgctctcctgagttgtaatttgtttcaagttactacgttctcttattggacagctctgctaatcttggcaacgttgtacaaaaagggaaggtgacttgtgggtccagggtccacccggtgtctggacacttctccccacacgttttttgggttctcctcttttcttccttccacacccttccctcgcctcttcctccctccaactgccctcagagctgagcagagattttcatttgcaaagaaacaggagagagagagagagagagagagagacagacagacagacagacagacagacagacagacagacagacagagagagagagaaactagagctgcaggaatgcaggagaaaggtaagtcacctatggcaaatccctgcaatagcctcttctttctcctgaattaaactattgagtcattcattctcagatcttcgaatgaatgataaaaatatttcgtgattgatgacaaaacatagcttttgtgtctaatctcagacctgctaagtcacaatcttcggaggtgagcttggtttagctttgttagtccagttatctagttttcatatgagtttctgttttgttttattgtgtggaagataacttcaatgcacgccaaagttagtctcacattccctggtgtctgttgggtaaggtgattccttagtaattcagattcaacaatttcaaatacattgtggtctacagaggccagggctgggggacctggggagatgctggtcaaaagatggacaatttcagtttgacagaaggaataagttcaagagatccctgatacatcattgtgactgtagttaataacaatgtattgtgtgcttcaaaggtgctgagagttgactttaggttttctcatcgcaaaccaagaagtatgtgaggttaaaaaaaaaattccccaaaagcaacaaacaaaaacttgaaataaatatgacgaatctcttttctgataacaacatttaggaagataaattatgggggaaatatttttagtttaagggctgaaaaatcaaaaaccaccacaataaatatacctaagggatacattaattttgttgtgtcatttactttagttttccttttttctcctacatcagctgccttcactataatctctaagtggttaggttaaaactcactttctgtaggttgtttgaaaatgtgacgaaaccattactatatttgaatggcagtggattcttattactgtttttaaaatggcaataatgtaagaagtgaatacaactattgctacttgatgccacttctttctctgccctctctagctggagcgtcctgccctcctctgtagcccctgggaaagctcagcctgctcccctgtccctccctgtaatccctctgccccagcccccacagccagacatctgccttcctcaagatccactgaacttccaagacctctcttaggaaaccaagtcgtatcttctgctcttaatacacccgtaccgtccttcattagataatatgactcactgtctgaaagaagctttacctataaagggagatcagataaccccaaacaaataaataaaatgcaaaattctttcaaacaaatgtaacgtactcaatatgaggagatgccattgcaaatcctcacaaatcacagaggaaattgttttgtgtatagagaccaactacttgcaaatttgaagaattcagagtttgggagaaatgggtgaaaaatataaatcttgtgtcttcaacttttcattaacttgcatgtttactgtaattttatcaatgcctcttccaggcaaaaagttttatttaagtactgcaccaaaagaatatttactactattggtagcaataatattgaaatctttgtaaatccttagaattgcaagggctcactatgcagatagatagatagatagatagatagatagatagatgtccacatacacacatatgtatataatcatgtatatatataaatgtataaaatataagtatataacatataagtttatacgtatttagaaagttaataacatattacatattatatatgtatataataagctccatatataacatataaatgaatctattaagctcccaatgtcagacatactattgttctctaatttaatttgtcttacaattatttaatcaatagatttctgttaaatttgagaagtaatcacattccataagctactaatcttttatatttaccttttctttttatagtatcacagcaaatggaatttccaattccatcatatatattaacttacatttgggaaaacagtgtatttagacttttttgaccaggcatggtggttcacatctgtaatcccagcactttgggaggctgagacaggggatcacatgaagttaggagttcaacagcagcctggccaacatggcgaaaccccatctctatcccaaaaaaaaaaaaaaaaaaaattagccccagccaggcatggtggcgggcgactgtagtcccagctagttgggaggctgaggaactagaattgcttgaaccccggaggcagagtttgcagtgagccgaaacggtgccactgtactccagcctgggccacacagtgagaccctttagtttctcaaaaaaacaacaacacaagaatttttttaatggcttattggttatttggagcattttttgtctagtttatgattgcaagataaaaattaaactgttcttgaattatctcagagctttatcaattttttaagtgaaacatgttttgaacacaacacacctggagaaatctcaatggtttacattgtttcgcttttactctaggactctctttttctaggagcatttacactataataaattattttctaatattagaatttagaattgctttcaaaatgtttaacttattcattaatagacacaattacataatccccttcccctccaaattttaacatttcttcattagatttttttgtgttttacactgaggaagagtcatcgaaattcagatcaccttatattttaaacacacatttaattattttttgcaaattattcatcaaagtacctgtatagttaaacaccctaagacccattaaatttctaagtaagcgttgagccaatttcctattctctgctaattattgttaacgtgtgatttgtgctgatacactgtaaacatcagtaggagctatgtctctactgtggttgttttcctgaaggatggaaccatttcacagtctaaaacctgagcctccaggtctgccctaaagctcatcaccttgaaaatgtggttccgtcatttttctcctcttctgcatgatcattttttcttttctgcatgattaacccaattataaaaatgtgttgttccatttcccatctttacaaactaagacaaagcaagcaaccttttttatttagttttagctttttgagacagagtctcactctgtcatccacgctggagtgcagtgacacaatctggactcactgcaacctccacctcccgggttcaagtgattctcctgccttggcctcctgagtagccgggattacaggcacctgccaccaaacccacctattttttgtatttttagtagagacacggtttcaccatgttggccaaactggtctcaaactcccgacctcatgtgatcctcccgccctggcctcccaaagtgctgggattgcaggcatgagccacagcgcccggcctgcaaacagctttttaaaaggcacacggcctgcagacagacaggaatctttccctccacattcctctgcagctgctgcagcccctactccctgtggacatgatggaggaaacccctcagatgaacggttctctttgcatctcttcccattctctcttaaatctcatcagctgtaatttctctgttgctaaatattttggtcgaatgtccaccctcctgttcactctgaaacaatcagccacttcctcctgaaagcactttctgccctttgcttccagaactccaccctgtttgggttccttctaattcactggccgctccttgttcacagggatgggtgttgcctatggcactttactatttattgccatactgtggctggaaagtggtcctgatccagaccccaagagagtgttcttgaatctcatgcaaaacagaattcagtgggagtccacagactaaagtgaaagcaagtttattgagaaaatagaggaataaaagaagggctactccatagacagaacagtcttgaaggccgctggttgcccatttttatggttatttcttgatgatatgctaaacaaggggtggattattcatgcctcccttttttagaccatatagagtaactttgtgatgctgcattcgtaaactgtaaactgtcatggtgctgatgtgagtgcagcagtgaggatggccagagtcactctcgtccccgtcttggtttcgggagatttgcgccggcttctttactgcaacctatttcatcaggaaggactttatggcctgtgtcttgtgctaacctcctctctcatcctgtgactaagagttccttaacctcctgggaatgcagcccagcaggcctcagccttactttctccagcccctattcaagatggagttgctctggttcaaacgcctcttgacaatatggttcaactttccatttaactctgttggtcacttatccgatggaagtatggtagtcatctaataaaacattatcatcatcggaattatcaagagtaatagttttaaaaaatattttgtacatggtactaaaatgctggagtacatcctatttaattccaccaaaatgttataagatttatgctactcctacaatcatttacaaaaaaataaaaaattgaggtacaaagaacttaaaaaataaaggtcacaaagcttgaaatggtagaagcagggtttgctgtggtgaagtctgatactagaacctgctggctttaccatatctcaacagtctgcttcagaaattatagccctgactttaaccacaccttacacttaaaatttttattttcgtcgataattattacattttttcattgataattattacatttcaaaattatattagtaaacgtacctttccattatgctacattttttaaattcagattttgattaatcaactctttcaacgcttatctcagaagtattttaatgaacttgtatgtcagttgtttaaatatgattaaacatctattaatattagtcccactataataaaagatatacactgagtcacacagtattaattttgtttttcttttccatgaaatgctttttttatcatttattgtaactgtgaaatattcatgaagatattgttgtaggacgttccccttagttcagctaaaaacagggtccttgtcacatggccatgaaagattaggttcacaggttattgcagaatatttgagaaaatttttaaataatcaagaagaaaatgtaactgtgtaaacccatcaccacagacaaccactgttagaacgtttatgtatttattattaatgctatgtgcattgtatatataagttgataggtgaagacacttaatattggtagaataaaaataaagttgttaatatttattattctgcctttatgacctctttgaacagttttcctaaggtatttttaatagattattcataatgtatttaattcctttatcattagaaattagtttttctcacttactacaattgtacattacaccaatcacctatcaaattctgctcagtttccaagaataatttgctagaactagaattctttagtcaaggctgttaatctactaggctaaactgatttctagaactataggaccagtttacttcacctgatgtaaataagaatatcttaactaaagcctctctgcccacattgttttagtacataaaagaaaatgttcagtaatttggtggttgaaaaatgctatcttatttttattaacatttaaaataatgcgctattggatcattctttgggataaatctattattgtctcatggtctgtacattacgagaagcgagttgttagtacaataactctttctttttttaaagtctggaaacagttgttgtcttcacaaggttattttgactgcagctcccattgtcagcttacaaatattcaggcattcctgcattttttttattggatttttgatgtccttgaatagggacttttgagaaaaactgacaaccaagttttaagaactacattatcaaattttatttctacccttaaatcagtcagtgtcctttccttggtcaggaaaatcatcctctgaaagcctgatgttataagtcatcttttgcaccaggaaagacagaggtacttacttacaatgtgaaccatttgtactgttgatattcctgattggttatcagaatcttttaatttaatgtcgcttaatagcagcactaaattaaaagataaatgtctcatatatgaagttatagtattacatgaatcattgtgtcaaggtagtatggaggattagcgtgagaatgtccacaaaaccttgatgactgaactctttactaatgtaaagggtaattagcataagatgctttactggaagaaaggcaattaactattcatctcacgtttccttaccaaatcagggaccccatttaaatcacgtatttccctgtgatttaagttttcagacataagcaggatttaacttggaagcaggtggaatttaaagattgttttacttagtcttgtagtgatctatcggtttacaccaccggagccaatttaaaccttttccctccaaacagagggagaatagaaggagcgagaagataagaaagcgcaaagggggaggcagaacaaggggtgagacaacgcgctcagaaacaacattcttcctgcactctacgtattgagatgtagaaaaccctcctgaggtggaaaacagaggtgtctcagacgattcgcaaattccaagaaagattttgtgtcctgttctattaactcgttcttcttttctatacttcgttgcattaaagtctttgccactataatttcccaaatttcctactgggattatcaaaagccttccaaggtgttcaccttgcaaggtgaacaacgtttttacaaaaaccccagtttcagcaaaaaggccactgccctagaggcccagatagctgagctccaatctcacccctgaaatgttctgaaatcctgagccacagcctcggattttttcatctgttaaaagaagggcttgaattaactaccctaaaagtctagtttctcattctttttccaggcacataatgcagaatctcaagaaaagtgggtggtatttaactcagaacaaagttcccattttccctggaccattcattacaatgaagactttgggaaaattaacttcagtgacttcttttgacatgtaagagcaataatacatctcttgcaagagtgctgtgatgaacgaaaaagatgctctatgcacagaggaaagtgcactctgggtagggcggtcagatgagcttggggaagtccaggggtgtcattcacatagaacacactgtagcccccataccagccacatattatgtacaaatatatactggctgctttccattcctcctgtgtggaaggcatttccagttctacgtgtgtccagcttttggatctttaacaggaaaaatctccctcacagtggggattttgaagttagttgtaagaaagacttaatcattgttctggaactcattagagatgtcaccttgccaggttaaaaatgcctctaaatcgcagattcctcgtgtgtttaataaagatgatcaccacctgaccctcagagctgtggtgaagattacatgacatggcaaatagaagcacctagtgcaatgtctagcctgtgtggttacacaaagtgcatggaaaatacttctcagaaaatgaagaactttccaagtctttgttacattcaacgtggaatgttaatgcaactctttattcagcttttcccgttaaacttcaccgcacacaggaagctggggatgaacctctccactccccaagtaagacgtccatggagttggaaacatgccacgtcatcttcacttccaatggagaaattggcacatcttaccatttaatcaatcaatagagcttacagaagaaaaaagaaaggggagagagaggagaagctactggaaagtgactttggcaactcctgatactgcttctgccttttctatctatgggaataataaaagctgtccaggcacaacaacctcactgtaaactatttcctttaagcacttcaacagaatacatgtgtcctttcagatctgtgaacaacacattcaacaataaccacttcctttctgctgccatagaccttttgttgtctcaacactgggggctaaccttcttaaacaggggtgacacttcacagtaggagaaacctcacagcattggtggtcaaagtctttattcttacacacacacacacacacacacacacacacacacaccagcacatttctccttcatgacccatgggaagcttaaatgatacctagttccaggcatgtactctaagccctgggagattcattttacagagcaaagctgtaacaccttcagatgctgacacgatccaaaacagcttcaggagatgtgaacatctaacgtttgagactttttttttcgagagtctcgctctgttgcccaggttgaagtgcaatggcgtgatctcggctcactgcatgcaacctccgcttcccgggttcaagtgtttctcctgcctcagcctcccaactagctgggattacaggcacccaccactacacccggctaatttattttttttgtatttttagtacagacggggtttcaccatgttagtcacgctggtctcaaactcccgaccttgggtgatctgcccgcctcggcctcccaaagtgctgggattacaggtgtgagccaccatgcccggccagttgcgacttttgcataatgggaagatcaggtggtcctgaaacaccatttttttttctccagcctctgcgtgattttcaaaggaatgcaattttatttgtgaaactcctaaatccaatcattttttttccttttataagcagcaatgcccctcaaggatctgagatgagtggccacatattcgggtgtgtaagtgagtgtgtgtggctgtggatttttactagtgacggcagatgaaagtgaatcatcaacgtctctagcccaggtttttaggatcagtcccatgtttctgattcctcagaaaacatcaaacagttagctggcacatatgggactgagtccattagtttaacatcggtcactaagatagcaaggtaacttacagcattctagagcatggcacaaagagaaacatattcttaggatttttaaattattaaattccagtggtatttcaggttcaaacttattttctcctttctcagtcctaccttaattattcttattttgcaaatacctttattttgctgttttcctcctcatggttttggaagagcttctttaatttcattaaataacatgttaaatgaaagttaatggggtgaaaaataaaggaacagaattctaaattctttacatgaggataatagaatttctctctgaatggtcaatcttcatcataagccattttttgagaaattaattacagggagttttctgagaggcgctgtatgaagaaaatagcagagaatgaagtgcccgttaagtagctgactgtccacaatgggaagtactgatgcatctacatgccacaggtgcacccaaggccgtcctcatccctcacctcctgctgtccccaagccccccacaagccagtacacatgggtggagttggcacaggttgtacaagtagagatgtgtcagaagcataaggaagaggccgggcaaagtggctcatgcctgtaatctcagcactttgggaggccgaggcaggtggatcacttgaggtcaggaatttgagactaagaatgcaaaaattagctgggcatggtggctggcacctgcaggcccacctactcgggaggctgaggcaggagaattgcttgaccagggaggcagagattgcagtgagtcgagatcacaccactgcactccagcctgggcgacagagtgagactccatctcaaataaataaataaatagatataatagcttgagctttcataaaatctaagacgaagttgagggtcactttaggaatttgaaagcacagtagctaagaaatcaacatataattaaactcctaatcttaaataaatattaaaaagtgcttgccccaacctcagacagatctgaaaccattctctcctgaaaagcagggtctgtcttacctttgagtttttctctgatctataacccttcttacctcttgtcaatgtctccaaaatactgccattaataactcaccttaaaaggaccctggtgggaaaagtccccattagtaaaactgtttggtccaggcatgaaatgtgtatattccgcacagagttcggtaaattgccctaggatcaatttttctggattctagattacaagcgaaaactcttgtcgttaggttttctaatattagcattaatgctagtcgttagcagaatgcacctgcacttctgctgtgtaacaaggaacgatgctggtcttgaggaaaaatatgtttgagattccccgatttcagggatgaactagctgctttttcatggaacaccatttttacttgagagactagcaaactattgtgtgtgtgccagtttttcttgccacataaattactaccaacttaagagcttaaagcagcattttatcatttcccaattctgcaggtgaagctcagctgggccctctgagctgggtctaacactcaaggaactagcgcagctgctttcttctcttagagtcctaaggaagaatcctttttgacattcagtcaggttattggtgaagtccaattcggtggttctaggactgaggttcccatcttcttgctggctaatgaaggggccactcggggcactcagggaagcttgtggccatggacccttccctgccttgtgacccatccatcaacaatgcaacggggactgtcccaattcgaatcctcctcacactcaaaacctcttctcaggaaaaagtcccttttaagggctcatttgattaggtcagggccgctgagcaccatctccctttcttaaagtcaattgagccataagctaatcataggacagagaacacatcatattcactcaaggagggtgcattatccaagagcatagatcatgggaaactaccttaggatcctgtgtattctcttcagatattccgaaaatcatagttgggcatttagtcatatttacttaaaaatgaacagtcagctattgttacctaaacaattattagatagtctttttgccaatgatgaaattcgggttttcaagaaaatattagaattttagacaagtagtgtctgtctttgtaacttcccaaaacttaaagactttttttggtaagagcagggtgatattaacacgtgtgcttttttacttattgcacaatatctaacttatttttagatacagacactaacatttgaaagagatgcataaagtgaacccatgatttcaaaatgaccgcaacttactgctaccaaatcacggatgagtaaaaatttcattcaaaatgcaaaatagaccaacacgttttactataataaagtgcaaaaagttgacttatatggatgcagattccattttgtagctaacttttaagaaatagccatttgttaagtttaatgttgtgtgaaagaaaaatgtccactattatctaagagggatattaaaatacgcctctctttttcaactttctatctgtgtaaacacagattttgttcattgacttcaaccagaataacagagcacagcacattaaatacgaaagcagatatgagaaaccagcctctttcaccatgccagacgttaaaaagttttgcaaaaatagaaaacaatgctacctcttttactacttttttttttttattattatactttaagttttagggtacatgtgcacattgtgcaggttagttacatatgtatacatgtgccatgctggtgtgccgcacccactaactcgtcatctagcattaggtatatctcccaatgctatcccgggtttttgtttggtcaaatatacttattttcataaatatatatgttaatttctaaaggagtattgtcacttttaaatgaagtgataaacatttaaaattttctctcaatgtaattctgaatatattaagtattggtagctatataacctttaaaaaatgaagctgtttgggattttcaaccattttcaaaagggtcctaaggctgaatgatctgagcacccttcctctgggctgggagaggaattagggagggggaatgagaattggcctctgggtcactcccagtatgcaggaaggacatttaccctgggctcaaccatgagaattcagggagtccatgaaattaaataggaaaagaaatgcatttttatttacactgccttctaagtgaaaattagtattttcttctgttatgagtgtaagcaaaaagccataagaataccagcagtactttgccatcagcagaaactgtaggtattttcttatcacattaacggtgatggcagatatcagaagctttactttaaaattcagactattgtcgctattagatctgccatggtaaagaagcacatgccccactatgtacaaattctttttaaaatatgttgatgactatttcaacgcaactagctttgtttggtatcctaatattttatacagctataaacgttattctgggaagaggcccattaacctctccagacgactagaggagtgaggcaggaggttaagggccctcagcatagcggtttggaaggtgagttttcagcaaaggaggtagacacagcagatagataggaaagggactaaaggagggagctgtgccctgaaggcaaggaggtaggttcaaggaaatgaaagtgaaaagagattagtgttgctaggaaggccctcaaggtgtgggttgagaggtaaccaatgagtttggcaggtccagggccatgaagacctggacaagtgctatttcagtcatagggcaggacaaacatatccctgcatggacagggaaacaatgacaaagaacctggatgaccaggatagacatcacttgaacatttttattttttaaaaggaagcagagatttgggaccaaagctgaaggcgactgtggggccaaaggagaaataccggtgctgattttgtgggtgatatgaatgtgtatgtgtgtgtgtatgtgtatgtgggtttgtgtccctcccatgagctgcttgtattaagtagaaacagttgaggagagaggaagcctgatggcttaggagagagaaggtttcagggaaggagtgatgtccaagcaacaggatggagtgagcagtggaggacccggtctcagatgtggcaggggcagccaccactgcaatgagagagtaggcagagggccacataccaactgctgtgttgttagtgagggcagagtggaaggacttgggaacacgtgaaaaccattgatctaggaatctttcaaggactgtgactcagtatctcaacccatgtattccacttgcagtggataaaaatacatctaccattattaaacatgcccttgaaaagatggagcctactccttctttctttgatagtggcctggacctaatgactcgcaagcaatgaacagaaaaaacagtggaagtaattgtgtgtgactacggagaccgggtcactgcaagttcctgctggctctttctctcttgaagaattatgcagctctcaggaaatcaacagccatgccatgagggtactcaagcagccaccgggaatgccacctagtaagggacctgaggtccctgccaacagccatgcaggcaccgaggcgtcctgccaatctccacacgaatcagctcttggaactcagcctccgttgcctgcagccccagccagcattgactgtaaacccatgagaggctgggaaagaacagcccagctaggctgcacatcgtctcccttaaaaaatacgtgagctcagacacctttcttcattaggccaataataattccggtaatttatttgtagcaatagaactaatccaccaccatctttcaggctataatataagtctctataattagaaaggatggaatgagattggtgacaaggacaggggtcagcaggtattgaatgtgtagagccagatgggatgctttaaaccagagatgagaggccaactctgaacacctttattctcttgcatagtttgggtccagtgtttttgaatcttcatgttttcaggagaagcaggaaatctggatattcatgtgaagttccctgtgttacgagggtaggtacatcaatccttttttatgttccatcatacaggtgacatcagtctgtagttctggtttgtgagtggtacgaggtgtatatttacctatgggcccttgaataccagagggaacttgccagtccagttctcattcctgagccttattcttagcatgccctctgatggaaatgagttgtgcaaatatctaatgttttaataatcagtttgagtcactgtaaagcaatgtctccctgcccaaagatagatttcctgtcccgttaaaaaacatgaggaaatatctgtttagcatcatacacagataacctaacaattaatgactaaactctgaagaattacatttatgaatatacataccaccagtaaacactgtgaacacaaaccctcaatatttgcatttattttctcttagttactaatggtagctatccttttttctctctatataaagataatggcatttaatgttacccaacttactactatcccataataccaattatttatgatattaaacatggttaaaaagtgtttcattttaaaaccatacttagagcaatgtgaatgtttaattttaaattgtgtttattttcaaagttgcgtttgacaattatcacaagaggaaaactaacctctggaaagtaattctacatacacatacctttgaggcagtcagctcatctgcagagcctcccgcctgaacggtggcactgcagttcccataaatatacctacagagggtgccagagagctggcagccccgcccaggtaccaagtggatacctcagctcagatgggcttttcctgtctaatattctaacatgagggtgaccaatgtgtgcattaaaaatgaataaagagtaagaagctagagctctcatgcactgctggtgtgaatgtaaaatgaggcagctgtcgtgaaaaaacagtatggaagttcctcgaaaaaatactaataaaaatgagcatatgatactgcaattcgacttttgcgtacacacctgaaataatggaaagctgggattcaagtagatgtttttacactcaagtttaaaacagcattatttacaataaccaaggaggggcagaaagactgtccataaacacatgaatggataaagataatgtgatctgaccatataatcggttataatttagtcttaaaaaggaaggaaacgcaggtacatgccacagatgggtgagctttagggcagtgcgccaggtgaaatatgcctgtcacaaaaggacaaatactgtatgatttcatcgataattagatacttagagtagtcaaattcaaagagcggcagggaggagggggtatgggtaatgagagtttaatgggtgcagactttcagttttggaaatgcatggtggtggaggctacacaacagtgtgactgtattcaatgcccctgaattgtacatttgaaagggtttggctatgacagtgtccgcacccaaatctcatcttgaattgtagctcccataattcccacgtgcgatgggagggacccagtgggagataaatgaatcatgggtgctgttgcccccatactgttctcatggtagtgaataagtctcatgtgatctgatggttttacaaagggaaacccctttctcttggttcttattctctctttgccgccaccatgtaagacatccctttgctcttccttcatcttccaccatgactgtgaggcctcccagccacgtggaactgggagtccattaaacctcgttcctttatcaattacccagtattgggtatgtctttatcagcagcatgaaaacagactaatacaacatctaaacgttgtgaagatggtaaattctgtgttaggtttatcgtaacagagtagcaaataataagtaaaataataaaacttagcacttttctttcaaaataaatataaacgtaggtttgcctatgttccaagagcctttcagtggtgtgactgacttgcacattaaccaaagaaaaagggcatctgtggtagagaccaccatcctggagcagtcgtgtggggagcacagatggaacagaaggagaaagtagaaagagtgctcttgtaatcttgcaaatgatgcaagttaaaatggtgggcatggtctgtcttaagttatggagctgaactattaatacatctcaaatgtcaaatatgaggtttattcagcacattgactgataatgcccccttaatatttctaacattagttcttttactgaagcagattcatggactaaggcagggatactggcatccacgtggttttcaatctatcaccgactgcattttaaatcaataatcccaaaataatgcaaatgagtgccgttcgaatatctgcagggctgaggtggtagagtgtgatgctactgtcctctgtggggagccccgccaaaccgaccagcaaaacttctaatccaaagtctggccgtaattctccacgtgatctgaacatgtcagccagggaagtaaaggtttcgagctaaagtagacaactttcagaaaactcacttgtggaacatttaactaactcgttcatgacaagacttactgccacgcaataagcaatgccgtcttaaaaagacctcaggtcaggcacactcttccctgcctttttaatgactgacggcttgctacaggaagtgttcacctcctggcacagggctcgtgcagggcagatgctgtctgagggtgggcttcggagtgagactttgccagtctagctctgccaccactcactcgccttgggctcagttgtgctcagtcagttcttaggcacaactctctgcatgttaaaagagggatataatatccgccagtagatgaaatacatttcaagtgcttgaacatagaggcaatatgtatccccagcaagacagactgtggaacctgcccaagaggaatcgaagtgggccttgacaatgtccagaaggtatcgggtcagtaagacttcatgacaacctgctggaagccattagcagatcttagtgtggaaagacggtgaactcaacttagaggaagcgatgggggctaccagcgaagtgtttaaagatgaaactcgcctcttcttctgctaagtccctatcacttccaccaaagctcagaggattttaaaagctctcaccacaaagacataattatttcaggtgatagatatcctgatgaccatgatttcttcattctacagcatatttataaacaaggcaccttgcatattccatgtattgaagcacgtatcaaaacatcacactgtactccccaaatctacagaattattatttgccaattcaaagtaaaaaaaaaaaaaaaaaaaaaaaaaaaaaaaaaaaaaaacaaaaacagaagaacggatacataataatgtttcaaaaagttcagaggagaaaaatctttggtcgaagcgctgcaagtgtttccacaggtcctctaccttaaggctgtgattctgctctcaccccaaaagaactttcccgtttgcaaaagtaaactacttacaaggagacaatgtgatcatcctgaaggcttcaagtccttccattcccccaaaatcatgtctccaacaggtaggcagagaatgaggcttccagtttgattccccatatggttaaattcgagatgagaaaataccttgagcacatggagccccttggatgcatcatccctgactcagccattccttcatgtagataaatgaacacactgatgcattctcctcatgctcccaaaaaaatttaaggagcgattttttttttttttttgccctgtgtctgatcaccactgagctgggatagagcaaacctctaggttagcagagcaaagactgctgtctaagaaggctctcaagagatccattatcccttaattgactgatgctgatttggccccaggttagtggtagggatcacagcgaggagaggaaagtgctaccgccaatgaacagctttgcacacactatatggtttcagtgcctacatgtgcacctctcacttatgtcatcctctaaaaagcttacatttcttctgacagattgaccttcaccagcatttactaacctcaccaaaaggcaccttgtttattccattaaacagacctagaaacttattcacagttctatgcagataggaccagagttatgtgtcactcagaggtgatacccttaacctaatattttgacatgttcaaaaacaaccccattcatgttatgccagatattaggaaattatgctagaggtgataagagagagtgcttttagccactataatacgtagaccaatttgctgcttcaaagtgccatttcttgccaaaggttgcttttgtaaaaattattttagtggggaaaatttatttcaaacatacacaaaattacagataaaagtgaattgaacctacagatacccatcactcagctgtaataattatcacagctatttttcctacgtccttatacactttcttcccaatcaagtttattgtcgagcacaccccagaacataaatctatatatccataaatatttcagtatgtctgttaacacttccatcattccaaagtaaaacctcttacccattaagcagtttctccaccttcccactgtcctccttcccccagcaaacaatgacgtgcattctacattgaccagcatttatggagatacagatgcatctccacaaacagagtctctctgaatgcctctcttgaaagaaagagatggaggaatatttcattttagtggaagttcaggctaatacagggagaaatgttgcttgtcttggtaagagtgtgggattctttacctggcatggtcatgataatgactaccagttttaaccccttcaattcaatccgaaacttgcccagccactgttggacaattcatggataagtgcttgacccagtgcagccagtatggctggggtgatttgattccacccgtgaagaatctaaaataggtttttgaaagtgatatgaactttaccaaccaaggctaaaatggaaaggatgcactgaaagaagataggaattatgctcggtactgggaggtcagcaacaattgaggaaacaaagtataaatgggtcagaggcttagagcacagaatttacaggtagagagactaagatgatgagcaataccaatattaatggtaacagcattaagtgcttatgttttggacatgtgatgtttcatttactcctcaccacccatgagtgagtttccatcattatcactgctttataaatgaggaaactaaagcttagagcagttgaataatgtgaccttagtggttttggacctgaggtttgaaaccatacaatggactccaaaccctgggctctcactgaactcagcagatatttaaagaacagcagcaacattgtaagaagagcagaatgcatgctctccacattttttagacaaaaaaaatgctccattcctatgaccaaagagcctaataaaatggatgccaccagggaaaggagggccttggaggagagggctcctagcggaagccacgggcaagccctgagttcaggtcactcgtggtggttgccttgggaacagagtctttccgagaggactctatcaatttagcagtttcgcccgaggccaccctgcagggcaattactcgatacaaagctgccctctttagaaaggcttaaaatctttccgctaaaaataattttgatcaagtcatttaacctgtgtggatcacagcctcaccatagtaaaccaatgaaattttattgtcaaggactttttctagctgtacccttcaatgaaattaataatgaaccaagtcatactggaaggactcattccttaggaatagtaatttaactacaaaaaacaaaaagaaccataagctcaatagctataagaggaaaatatttgctgagactctgtataatttcttagtacattctactaaacaccctgactttatgcccaggcaacgcaccatgaaagctgcatttcagcaacccttgcctttaagacctttttggtttgtttgcttgtttgaacagagttcaatcctaaattgattttttttaagacagaaaaaaagaaaagtaaaaaatgccccagatgaactgaaccttcaagagtaacacctgataaactcaatgcttaattactaagctgaaacgtccatcccactgagtgattccgtttcacctggcctcatctcaggtatttatcgagtgattcaagactattttgaaatctgttttaaaagagatctatctatctatccatccatctatcatctatctatctatcatctatcatacaactatttatctatccattatctatctatctacttacctacctacctatctaccaacctacctacctacctacctaaagatacgtgtgccctgatcaagggaaatctgacttgggaatatgtcagccgaagtaaatgctgctgattggttttataaaagtgacacaaactttaccaacagaggctaaagtggaaaagataaagtgaaagaagttaggaattagactcagtaccaggaggccataaatacacacacacacacacacacacacacacacacacacactctctctctctcatacatacacatacatatattacacatattaatatatatacacatacacatatttatatatgcataaatatacatatgaatatatatacacatacatatatgtacaaatatatatacacagacatatatattatatatataatatatatataaaatataatatatattatctggattagatgatagaaacctgtaagaatgtacttttgatttggtgtatgtatgcactaatcttcacttattcaatgttttgctttcaacggtttcagttacccacggtcaaccgcgttctgaaaatattcaacgaaaaatttcagaaaaaaacaactcttaagttgtaagttgcgggccattcttcgagtgtgatgaaaccctgcaccgccctgctgcatcctgcctcggtcccgaatcattcctctgtccagaaggtccctgctgtttgcaccgcctgcctggagttgggagtcactcagtgcccatctcagggactggatggacgcccatggggttgtggtgtctgtgttcaagtaacccttattttacttgtacttaatgatggcaagcgggtggatacttgcatactgttagaactgtttttactttattattagttattgtttatctcatatgtgccccgtttataaattaaactttatcatgggtacaaagtacgagaaaagcatagtttatgtagggtttggtgttagccacagtttcggccatccactggggtcctgaaacttatccttcaaggataagggggggatgtctgtacgtgtgcaagggtgtgagtgtgtatatggcagtgaataaactcaggaagaaatgcaagctgtttaaaaatacaaagaatttttaagtgaacttcttatccttgagttccaatgtgctaaattaatacttaataaagatatttaattatttaaggatactaccattaccaatatactacttaaaacattgagctgatgcatggaattggaagcctgcatttcacgatgagaatgggagccttcggcttcctactcagcaccattccatgtttcatctcccagtgtctccctagtgcttccaggcggggtctgctgcatcttatttattactgatagccaagagactgatgagggctgttcgacagcatcgtagaaaaatggatttgcttctgcctggaagcattgggaacactgctcaatttaaaatacagaaactctgccaggtgcgatggctcacgcctgtaatcccagcactttgagaggctgaggtgggtggatcccttgacgtcaggagttcaagaccaacctaaccaacttggtgaaaccctgtctctactaaaaatacccaaaatagctaggcctggtggcgggcacctataatcccaactactcgggagtctgaggcaggagaattgcttgaacctgggaggcggaggtcgcagtgagccaaaactacgccactgcactccagcatgggtgacagagtgagattttgtctcaaaaaaataagtaaaatgaaatacagaaactctcctaatgtggctgcttcttctgtaatcagatctctctgctctctgcaactgggtgctgaggccccgtgacggggataccttccttctggttgctcccatgaaacttcatctaatgccgctgatgctacaatagggctgtactgaagcaattttccgtttccagttagagacataactcttcttttacttcatccaaaccctccagagtagcctctgttcttgttttgagagcaatagctcccctgtggtgtgcaaagagaggagtgaggagggaatgctgtttttgtaaaacaaaataggtgatatgaatgtggacatgggaggacacacgccagccaccacaacgatgtgaaacaggtacatttgcaaaataactcttttcaatcaccagcatttccttcagctgatacattcccaagtcatatttcccttgatcaggcacacggtaacgggcaagttgcccctggctccttaatggctttctgtctgatttggatatttagtgatattactcaacacagatccaaaacttggcttatacatcatatatggcaagataaaaaacaaacaaaacacacaaacacacacacacacaaccagattctgcaaatattgactcaagacttttaatcctggaagttgagcaactgtataatttacaaaatccttagatgattccagaatgcatctacaaaatgcaggtattaggcaaaatgttttagaagtctctgtgtcaatatattcatgtttccctgtgtattagctactgattctgtccagttacacagtaaaaagcaaattctgcctttagaaaatatgagtcagcatgacttgcttcagtgtctgacttcactactcatttaactctctccacaggtaagtctgaatctcttggtgccctggttcactcggctgagaaatgggctgccctctggagaggcttgctatcaggattaaattcatggacaacagaaactcgtttggagcaaggcctaccacacctctagcctttacaatgttgctgcagataccacacatgctccttgctaatctggccaattacactttctatcagtattcattttgaaaatatgcattgatttcctaatttatgcctagaatttttctaaatatatgacatagagttataaataaaacagacaaaaattacagcctcctaaagctttcttgctagggaaagaaaataaacagtagacaggtaaatgggtaaaatacatggttttcagtgggaataagtgcggtggattaaaaaaaatagagggaatagaaatacaaagaactacctaaagcaggtgtgaaggagattaataatataaattctacgtttccaacactgttgtatgcagtttacatacattaaatcttttcagtactcataaaaccctgtaatcgcatcacatctgcgtctaatcatattctatgtgtattaacacaatttgattctcactcaacatttgtgtgtgtgtgtatttttttgttttgttttgttttgtttttgacagggtctcactgtgtcacccaggctagagtgcagtggggcaatcacgactcactgcagcctccacctcctgggctcaggtgattctcctacctcagccttccaagaagctgagacacaggtgcaaatcaccaccatgcatggctaatgtaaaaaaaaaaatgtagcaatgtggtctcactacgtggtccaggcttgtctcgaaatcttgggctgaagtgatcctccctcctcagcttcccaaattgctgggatcactggtgtggaccacatgagtagaatatcatttccagtgtgtctaccacctgcctcaccatggctcccaggccctggctcctgcaacaccaggcaatggcagagtgaatctttctcatgccccaggtcttccatcacctgcgacctggcctgactcagcttccgcagaatggagctggggataaggacacacctgcttcacactgcctggcttcaaattcacctttaccaatcattaggtgtgtcgttttgcctcagatcctcatctgcaaagtgggagtggcataaataggccctgttttgtgaggctgctgggatgttacgtatgtctacatatgaatgggtgaaagccatgcctggcatgtagaaggtgctgtgtgcatcctactagaacattccgtgtgaagcattctgggtaaggtttctccctgagccctctcccctacctcctgtcatttcctcccaggatctgatacacaggtgacattcagcacacgactgtggttacatgattacgtccaattataaagtgctttaagcggatttgaaagtcagtgttcatttatattatagtcatgtaactacaatagtcccatattatattttaatcttaaattagatgggaacagagacaattagtttaataaaaattgcatttcctaccctaatcacaaacaatgactatcgggagaaattatcattgattttttgctttctagagataagccgattgggagtaatggcctataagtttatcttgctaaagtaaattgatgtgacttccttcaggaggcaaagacagctgaccacaaacctcacattcctaatgtgacccccctttctctatcacattcttcattgtgcaatctttatttctataatgcttttactgataaagaaatgcaaattattttagaattaaagttacagaaaaattaattgttaaatgccatcatcttgctctctgttgaaaaatttctctgttgaacattttttacttacactgttactggtttctttttaccaatctccttgcacagagtagcatatatcctcctatgtcatttaaaacactgtcaagagagatcaccctctcagttactaagctttttttaagctaccttggttgccccaacaatccacactgaccaggaaaatcaattacaatttcttgtcttcacgtttctgacttccaaattgaggcagtgatatttaattaaagattctctgaccacattcatttaagctcccatgaaatcgtctgaaatcaaaggagacaaataaaaatagccaagatggtagtatttaaaactaccaaaacataacccatttaatgttaagtcagccttatttagtctttgcccagtgagaattccctcaaactctgacttgcttgtgttctaaaggtagataattgtcaagggaaattcttaaaagaaacaactaaattacttgtaataaattgcagaagaatgcagtgacaaactaatgaagtgaaaaggggccatgtctccctttctggtgtctgtaagtttcaaacactaatgtaaatgattactatagtctctttccattagcactgtgtgggctctaacatacacttttatttactaaatacatttagtagacatgtgtaataaaaatatatgccctttgatctatacatttaataagcacagaaataaattatatgaagtagtgaattttatgctacttaaaaagcaagagagccctaacagaaaatagcgacgatcacagtggaaggaagagaagtcttagatatttgtatgtgtattttgcatatttcaatacatcgtacaatgcatacaggcattggggcctggcaaaaataactacaattgtacattcttctcataaaatatgcatggtggttgtcacaccttttatttatttcaattttgggggaaaatgacttgaagctcatatgtgcagtgaatacataatttaagttagagttttgatcctggtgatcagaaatgcaaatactggtcctgccgccaaacatgaatgcccttcccttttcagggctctgtgctcttgtcacggggatggcaaacatcctcaggtggcagcagtcaccactgaggggaccaagagaagacatgccttagacagggcttagataacagataagtctttctactgaatgcacacagacacatggaaggtgccaccctgtggtcaccaaccctaatttcaaagacaaattcagagtaacgtaaaataaaacaacctccgtcaactgggtgcactatacagataggctcacacgcgtgacaccatgtttctcttcatctaaaataggcatcaataaatgttacttattagggcattcatatttcattcatagtctcgaaatctgtaaggcctccatggtcttccctctgtccttgctgaatgcgcatatttgtatgcacaaaaaggtgtgttcaaactttagacatgatctattcagagatatatattgttatattgtaactatgtctttcttttttctgttttctagttatgttcttacatttcacctgacacaggtttaatttcaaaatagtggggatttattctataagtttacattttatttagatcagagttaattgtaagtttaaacaatgtttgcagttaaagtatctgatgcatgccggatactgtaaggaatgcaatccccactcctgtcctcaaacttttgtcccaggcattctgttctcatcctttgaaacttctgacaaagctgtagattgtctttagaaagaatacaaaattacagctagacaggatgaatctgttctagtgttctatggcaccacagtgtgactgtagttaaccacttattacacgtttacaaatagttagaagacaggatttagaatgttcccaacacagagaaataataaatgtttgaagtgatgcacccgttaattactctggtttgatcactacacatattatgtttcaaaatatctctctgtattccacaaatatgtataattattacacgtcaattgaaaaaaagggaaaactgattaaatctgggaatgcttaagtttttgaaaactaacacattaagtctctcaaaaggcctttctgtgctgaacatttacagttcatagggaaatctgttaatgtttaaattcctgtgttgtaagactgtaccacatggcataatgggtattataagttttaaactattgatccacagttatcacaaaaatagcaacagatgctacagtcagctgagatcaatggaaaaaggtaaaaaaaaattcaattttgttagtaacaaagaatgcagacattttacatttgggacaattaaaaaagcagggaagttgaagaatctccagtaaataatgctggttgcagccttcaagcaatgaggatattttctctaaaaattacagagaaactaatgccagagttcgattctccttcatgatccctatcattaaaattgtcttggtctcttctgggagtcattgaaataccaataaaattcgtagccacttacaatatgctgtttttcatagagtaaaagatgcaacaaaggtattcattttacaaaattttattttatttttctttttgagatggagtttcactcttgtcctccaggctggagtgcaatagcatgatcttggctcactgcaacccccacctcccaggttcaagtgagtctcctgcctcagcctcccaagttgctgacactgcaggcacctgccaacatgcccagcgaatttttctatttttagtacagatggggtttgaccatgttggacaggctggtctcgaactccttaactcaaatgatccgccttcctttcattgggcagcacaaatttaaagaataactgatgataaaatgcaatgctgaataagagccaaatgcctggtacagaaaaataggtagacttttgcaggagaactcagaagtgggagccatccttctgcggtaaaatactcagaggagggttcaccgatggatgtgatatacagacggaaaggagaaggatttctgccacagggaaagttatatggcacacacaggaaggaggacgagcaggggctgaggtagtgtgatttgatgctggtaaagagacaaatgtagggacctgggatgtagattttacgagatgtattggggaagaggagtcgaagcaaacaaaacaaactgcaaacgaagagtctaaaagacttggtacctagttccacaaaggaaagcaaaggaaaaagtgaaatgaagaatcactgtgtttaccttgagcatcagcttagggaggctatgcaggcaacagagtgcccagtggaggagagtatagcagagaggatgaggcagagccctactcagcttctgtgcccaggggtgggaggaaactgggatcagaagaagatagagggggccaggggtagtggctcacacctgtaaccccagcactttggaggccaaggtggacggatcacctcaggtcaggatttccagaccagcctggccaacatggtcaaactccgtctctactaaaaatacaaaaattagccaggtgtggtgataggtgcctgtgatcccagctacttggagtttgaggcaagagaatcacttgaagctgggaggtggaggttgcagtgagctgagatcgtgctattgcagtccagcccgggcaacagagcaagactccgtcttaaaaaaaaaaaaaaaaaaaaaaaaaaaacatacagaagaagaaggtagaggaggtatgactccatgcggtagagtttagtaggtcagagactaaatgtttaaagaggtttgcagcttccctttcaagaagtttgacagtgagaggggagaccgaaggggaatgtatcacaggatggcatatagggccaggttatcccatccagcttctgaagttaatcattttgtgtacctacatcatgacagagggagtagcaattttacatatttaccaagtaaaatgtacttcccatttccttttgttttacagtttttagtaggcacatttatttctatccatttatgatatgcattttttgacttcaagattaactgtttgttagaacctgaattattcagtgcaaatagtgcagacagataacttctagcaaaactgaaaagtaataaggatttctaaacttctaactgggaaattaacactacacaaaatttctcctctctgagtgcgcattcttactgagaaagaagaaaatacccagtggtggttgaatttatttgtgggaatatgcccatttctctatgaccctccatggcccttctaccctttctttctcaaatgtgctcaagtcggctttagcaaactcttgtggaccaaaggtaaaggttccaattccttaccatgtgagtcatattctggcccaaacctactttttcataattatttcccacaaatggcaaatctaattccactttttccaaagaatcttggttttttttttttttaaccctgcaaattgcctttcgaggctggaattctctccttttcttcccagcttcacactcattcagcacattcttgcctcacatcctggtgcacctggctctgctgatgaggaatcctgtccatcagtctatttgtctatccacctagtcacttctatcgcctttctgtaaagtgagtcttctatagcccaccattaaggagaagtgatcattccaatctggatgttctgtagatagatttaattctcacctagacattttattactcctaagatttcaggtaaacataacgttcatacaaatgtttatgaaatctggtatccagggagacagtccataacttacattaacatttcagtggcgaatctgacccgaatatttttcaagaactataagtaaaattgtaaactcctgcagaaagagtcagtaaatttttaattgtgctcctctatctaatgcttacaataggcctgcggtctatgatttatacatttttaaaaacatttctgatggatagttggcactgcactgaaaataaaataaacctgcctgtggacatggtgaagaaagtgacgcattgcctctgccccgggccagtagtgcttcaccctaggacgtgcccaggtccacttttccttctgctcgtcctgaaggacgtctctcccatacacctacactcagagtcagcactccagtttaatcacctgagaagcttgcataggatcagagagagagagagagagaagaaaaaaaacaaaaacaaaacgaaacgaaacaaaaacaccaacaacagcaacaacaaaaaacaaacagagaactcctcatataaggagacccaacttcttcactgtgaagagttacttctgcgtttctaaatgtgttatgactgcaatggataacagagtatttccgtgcgaatgcgctgagcagcctcatgtcgcactcatcttcttgacaggataccacgaggcacagactacacaactagtggaagcagtaaaatccacgccacccttggaacatacgcctagcacacttgtctcacttgaccgccatggtccctgtatggcagctgtgcttagctccatctcactgctggataaacaaacctttaaaggaactgagagacttgctcagtgtcatgaaggtcttcaggctccaaaagccagcatctctctactgtgctacacgactcttttcatgaatgcagagtgttctgccctttttttgtggttttattttgctcaggcattgaaatattccaggaattattcaaggaacatgaagcgaattctgcctctctggagatggctttcctggatgctggaagcaacaaacaacttgctgcttttgctctttagaaaaatagataatttgccgtccacacataaaactgcattgcgtggaatagtgtgacattaggatggtgttagaaaataataagtattatgtggagacttctgaataagtaattgatattgacttagaagactggaaaaagtttcttcaaaaagaataatggaaagaaacaagggtggttgcagggtgtgaaagaaaattaaatcttgggacctcaaactcattacgccgaagggaaaagtcaagctgggaactaggtctcgaaaaccttccttcccctttttggttcctaaatgaggtgattacaagatgaaaagctccacacttctccgtattttttcccataaagacattcctagtgagctgcaagatcgttactcccaggtgtttctgttaaaatttcaccatggcgatgtaaattgataagtttatctttacagctgccgtcactcccttgcccaccagacacaaatgcatatctgcttcctcctctaaccaatttcgtctatgttatcgtatgtaaaatccagattccctgccttttcctctgcaccatttgtctttgtcaccttacataaaaaattggagaatcactgacccagacagaggcatgaatgattatcttcccctacccccgttacatgaaaattgtgtatttctcaatatcctgccctttccccttcaatgtggagccctcacaatcctcttccgagaaggacatagacctgtctccccagcatgcatccttccctttggcaagtaaacctcctgaaatgattgagacttgtctcgtcacttttctggattgacaagggcatggaaggtctggcgggagtgggagttgaggacagggatgacgtgttcaagccgcagcaggtgtgtgcaacaggagcatgggaagtttggaatacggatcaaaagatgagtttgaaaaggcggatggggacacagcacggagagcatctactctgcctgtgataccctgtgggcttccactgattactaaacagggcacagcaggaccagatttggaacccaggttaatgaattacatgaggttttattccatagaaagattttaaccaggaaaaaagtctaggaaactagattttaactaggacttctaaactttttggaggcaaaaataaataaataaataaataaaatagatccaaagattcgtttctttattttcatgtcagactcccatgactagtttgtcaatgtaaatgtggatgactgtggtggacagcttaacatgtgcagtgtacattgtaatgcttcaagttccaaagcacatgctatttacaagcgatgcctacagacaggtagcaaataaacatgaaacgttgtctgggctatgaaatgaagagtcagtgacttacagcattagggtaatgtaggtactctcaagacttggtgtatatttctctagaatgaatgacattcttatttattttgtttcatatatctatggaactgaacattaagtctgataaatgctcatcacagatagagtaagggatggtgttcaaacatgctgagcgctttagttgagtgggcctgaagcagactgaggtttctaagggctttaatgaggacagggctgaggccttttgtagtaaagcctagagtagctggggctgggaggctcttaggattctccgggcagtgaatatttatcatctgatgcaaataattcaacatgttaacaaccattatggacatacaagctgaattgtagccctagatatgtgtcttgagaaagcaaagctcttactactttcaaaacaaatttcaaaatatctatgaaaaaccattttgaactctatcatttctctgttatattttttggggtagtaaattgtagactatgccatggtcaaaagttaactacaaggctcccctggaggagaatatgccaccttcacaacaggaaagaacatgatggtcagctctgcaagaacctggttggaatctcatgagcctttaaaaactaccactgagactgagctgaccagcaggagggaaccctctgagacatttcttcaaaattgctctgacaaagaaaggtcttacaaacaggtgagtaaatgccaacttgacgtaatctgagacagtctgaggaaaccaggttctgcacgtgtacaacaggaaactcgcccaggatctaatcatcacaattttcagtggttgccacattcatcttttgctacgcttgctcctcaaccattttggaactcatctctggattcattctgagcactccactgagactctgaagcatttgtcttttcacaaggggcatgaatccccggggaagtcaggcagctgctggagtaaggacgttaacctcctcagagtagattccttatttcattaagcaacagcttcgccattcaatttcagaagcctgattcagatcattaagagaacaagcaatgtaacctgtgcctttgaaggtttcctggtttccctacagctgtgaataatctgtggtttccccacattatcatgtaggtaattgcctggggagcagtcactacagcagctcgccaacctggtcacagcagcaggccggggggaaaggccagacttcatgaccagttggtcaatgtaaatgctgaagactttggtggacaacttcctcacatgtacagtagacacaatcatgcttaccgttccaaagcacaccgctacctacaagaggtacacacggacatttagcaaataaacatgaaacattgtctgcagatttggccaacgatattgcctgcatgagacagagaacatgaagaataagagcagctcagggctgatacgctgaaaagaatagcagtttaggactgatatgctgaaagccagaataagttcttcctccacatcacaaaactataaactgcgggaaaacaatttacgaagggattgataacctacctgaactttattcttgaagcataagaacttaaaatctaccagtcactgccaagtattaatctgttttaaatagctgagatttactggataccattgttggcccccaattatccaatgtcaaccacatttcaaagtttagagaaaggaaggatttaaagtggttttatatataacagtaaacgtttgtcatgcattaatatttcagagacacaactttaaaataaatcaatacataaaagtgcactgaattaaaattctggcatgaactcaaatgttcatgtattccattagtctgcgtgggatttttattcattaatttaacatctctgatgaataatatttcatatctttcttaaatttattctcttgtttcaacattagtaagaaattatccccaatatctactcaaaataattacaactaatatttaagtgtatttctcctatccttaccagatacccagaagctgttcagaatgaacttttacatttatgactttttaatataccgagagaaacaaaataatcatgcctgttttatcttctttgatgaaggtcaatagggtggggctaagaaattgtcatcacatggccagcccaagaggactgagtacagtgggtcaggacactggcctgtcagctttctgcctggaacaggccagtctgagaaataaagctgtgactaaattacagctatccgaaaaagttcctcctttcattaggaattttatttcataaaaataactcactatccaccacccctcaactaaaacacgttctgatgttaagtagtgggagcagtatgacaagtcggtggagaaacacagttgtaaagactgacatgaagccaagagcacagcagcctgtactcacatcctggttctgccatttgcaagctgtatgacgagagccacagcccttaatctctccatttctcgcatgagagttgaagcttctttctgttctgccatccaataaccccatgccatccaggagggattctctaggtaattttatgtggccccatttgcaagcaaattctaaacaatccatcattttctttggaagagattgttctgatcatctttgaaaacacttttttcacagaaatattatgtagacacagtattttttttttactaatggtcatccatgcgaacacatagctttgcaaattcctgtttttcatataaacaaatcatacgtttgttttttttcctttcatgaaatattgtatgtgagagtcatccatgtcgttacatgtagaggcagtttgtctctttccaagtttgtttattacttctatggttaatgaacatttaggtgattctcagtggttgacaatagcgcttgcatctcctctggacgttctctgtacctgttgtgcctagctgctcatttctgttggacacatgcctgaaatgttccttatgttcagcttgatggtaaaacagttttctaaaacggtcgtatcaattcagatttccaccaatagtgcaaaaaaaaagtcattgttttgttctttatgttttaaaatgtggaatttcaagctgtttgttttagttgctttgggctggggaggcattgagtctgaggaaggtcctcagtgtggcgagctccctcccacttcccagccctagaaaaaacccttgtcccacttttcttccgtttgtctagaagtccaccatggttctccaaggtggacgtgattatttctattttataaaacaaggtagcaagacacacaggtagaaggggtactggctaatcgtaagtacttaatgaaaagtgcagagtaagagtcagtcgcttggaacccatagatggacactttttccaaaatcttaaaacttgtgccattgagactttacaagaatcttttgttctgagagaaattaaagtagatatttaggaaaagtggttacgtgtttctgatttgaatgagttatattattaaaaactattttttttcatggaggtttagtggttttaagaattatttaaaggttataatatatttcagtaatttattttgattgaaacaatacttcatgcatccatacctacctaatagttccctcaaatacaagatagcaagggaggtccactgccatggaaacaggcaggaggcccatgtggaggtttctagacactctgcagagcagtggtccgtggaaccttgaggggaataggagcacttgatttcctccattccttccgctaaacgtaactgagcactttccaggttctagataatggttgttattatttttacactgttttaaaaggagaggcaaccatgcatgccaccagaatccaggtatactcctagatagagctctggaaactgcatttcaaatctcagaaaatgtgagcattggagaatggggaatgcatacgttttatccaaattagaattaacctgggaacatggggctttcaataactcaaaatgcctttctaataacatgaaagtcttcatttggtataaaggtcttcattttaattaaaagggaaaatcaatagttatagggaactataacctaaaaacaaactaattatttgtgtcaacacaagctttatcgccactgtcagggtttcccttgatttatgagatgaatgttccctataaaaattggaattttattacaaacacttactttcatgatgatttatcagttacagaaaatcaatgggaatttcattttatgaaaattgtaattttataaacagccgggtaaaggtgtgtaaaactggagcccaacacttagatgactatttagtagtgagggggccctcatggttcaagattaatatattttcaaaaaatttatcttgtagacactgaaaacgtctagatgatggattgtgcttacaaggcacttatttaattataattaatgatggaggcaacatataaagaatgggctcaattttcagctgatttaaagaaataatgtgtcctgcataaatcttacattcaaccacagcccaatatatacagcagatattgcaaatatattgtgggtttttcccctgcgttttctactacttttgttcacaatgtcattttaaaagtgaatagattttaagagtagcaactgtagaacagttttacttgtcaagcaaccttactactgcttctgacatgacttgatgatataattggagaggtgaaagtcaaagaagaaagtgtaagactccgagaataaagaatttggagatgaaagttaaaaatgtaagggaagagtagaaagaatattttatgttggttgtcatttatttgaccaagaaaagcaccaagttaaaaagaatatattatttgtctttgagaagttacacaattctgtccaagcatcatacgctggaaaacaaagaagtttctcatagaaagagaccaccagtgggctgatttcatataaacgaatcatacggtttatgtttttttttcctttcacgaaatattgtatgtgagagtcacccatgtcgttacatgtagaggtagtttctctctttccatgtttgtttattacttctatggttaatgaacactgaggtggttcgcggtggttgacaatggtgctcgcatctcctggggacattctctgtacctattgtgtgtagctactcatttctgttggacgcatgcctgaaatgtttcttatgttcagcttgatggtaaaacagttttctaaaacggtcatatcaattcagatttctaccaatagtgcaaaaaatatagtcattattgagttctttatgttttaaaatttggaatttcaagctgtttgttttagttgctttgggctggggaggcattgaatatgaggaaggctaggaaccacaaagggtttcttaggaattccagataatctgcaatcgtatcaatccaagtaacactgacggaatttttgttctcttacaaatgaccataaatgataaacgtgactacaataacgttaaaaagattataatatatgcgaagcataaaaatgtatgttctttttaaaatgttcttctccactttatatgtatatatatatcttatatatatcatatatatatgattcaggttaaatatacgatatatatgattcaagttgtttgacaacatttggaaagatgaaaataacacaataatgtttacattatgtaagttttcactataattattattgttgtcttattagtccccaaatatcaatcgactatgctttttttttgtttcgcaatttttgttggcacaaataatatcaggctttccttctttaatgtatttagttcagataaaaggtacaatacaatttgggcttcatgctttttaatctcggtatagacaagagggaagattcagctgaacaaatgttttccctgcttgacagaaggtttcacatttgccctctgaaggaacaaacttgatgatcttactcgcaaaaaaccaggacagccccgtgtggagggctgggtggctggcagggactctgagaagggcccatctcatcctaagctgttgctctgtctccagctgtccttaggtttgttctagaatcagcaacagcaaccatactggagcttccattccttggtaacagttctgccctctggatccagaaaaataatcgtagtgcctttctgcgtactgtgcaccatgcgccctctaagattcctcacatcctccttctgatgggtcttgtcatcttcctctctctggtccttcttcttcttcagagggtggtgtctagtactgaacctaaccttccacaggcagtctgcgtaaatgtggttttaagcaggaagtcccctgttcaatgaggaccatgtggtaatgaaaaaaaggtaacttccttgtaccgtgttgtcttggagctgaactttaaagtcagccttgaaatgtttcctaatgcattactgttaagccaggcttacctctcttgataccttcataccttttgaccgttttagaattaaatgccaaatttttgactcctctctccttatatatacaattgaagtgtgtgtgtgtgtgtgtgtgtgtgtgtatatatatatatatacacgaacacacatctacatctatatataaattatttatatatttcttatataaatataatacaataaatttaattaaatataactacatacagtttatacatataaatgtttatacttaaatatataattaagcatatattatagaatatatataaataatgtaattataatttatgcttctataatatatacaagaatgaagtgtgtataacgtacgtacagtttaattctataatgtagttgtattgtttatataatttatatactctatataatactttcattaattacatattttttttaacttttaaaatcaacgtctgatacatctaagtgattgctattttctgccaaccaatgagtttcttatatctaccatcttggagcagcttcaaagttgatattccatttttaacctttctttcaattacagatacaaatgccaagttcactgatcaggtttgagaaacaaacgcttagaaatttttctttaattcactgttgttcagttactgagagctctaggaaaagatcaatttacattttagagacaaatctgttaatcaacctaactgactataggatcagtccattggccttgtaaatattgacttatggttatgttaaatctggtacgggatggacatatccatagataaggatcactgaagagaaagtgcagacagaatttctctaccagaccacatggagtcttcctcattcaaacccacccagcctgggtgtgcacccacctcccaccgccaacacgtccatcccacctttactccattctaactacagccacagtatatggcagtcacaagataacggcagatatggggaggtatggaaaaggaggatcggcctggcctggctccaggtgaagggaaagcacattaatttcactctaataaaatttcagggcagcttctttgcaaccaaagaagatcaagctaagaaccttccggcaacatcagaaggcaatctaagatggacaatgttcctgatgaagtctaaaatatattttggcgctgggtacggtggctcacacctgtaatcccagcactttgggaggccgaggcaggcagatcatctgaggtcaggagttcaagaccagcctggccaacatggcgaaaccccatctctactaaaaatacaaaattagccgggtgtggtggtctgcacctgtattcccagctactcgggagcctgagacaggagaatcacttgagcccaggaggtggaggttgcagtgaggcaagactgcaccactgcactccagcccagacaacagagcaagactctgtccactgccacccactccccgcctggcaaaaaaaaaaaaaaaaaaaaaaaaaaaacatattttgttgaaacgaatttgcccctggattctgaggcaggaagttctgcgtacatcatgtgccccagggactgggtggcaaataaagactgctggttccgatgtgtacttctcagcaccctctgcatttcattccccgcaactgacccttgtttctctactggtcatcctgaaggaaacgatgaaagcattatggattttaaaatgtgtaagataacagatatttagaccagtttgttgaaaaattactaaaatctccagcaggagctataattagatccctttgcattctgactttcatgggaggtatttacaaactgcaaactgtctccgtgacctgctagttcctgcagcatggaggatgctgtaatttctctggcactgcagggcttggtgtcctctctggcacatggcaggtgttcagcgaatgctaccttaatggggtcaacgttctcatcgtcacaatgtggggaaagcttaggcactttgattgggaaggtccattattttcaaagtcatgttattttaatttggaaatcgaagtggaatggtttttaggagactgcttaataaactgaatagttttttgctgtgttaataaggattactcattattagaaacatacaggaaatgatacaatatgatctaggtataaaccttagaaaccagagagaaaaagaacatttcattaccaagctctgtcctaatgactacagactccccattttgctcagctgcaggaaatccagaatctttcttttaagattcattgtgtgtaaattactgaatcatgcatttatgtggtgtgaagaccttttaggattaaaagtgatattacaatactttttgtgcattttcatgcaacctatatgctatagcatgcttaacatgaatgtaaatacaatagccaaactgctgtggatatttacagattagatgcataataattaaaatcaatgataataaatagctattgattaaaacttagcaattgttccagtgtatcaagaaactatacatatcctgtatactgtgatagtgatatagctttactaataagttcccagctgtcgactatatgatttccaaagataactgtgaataaaagaattagaaaccattttcaagctatttatccaactcctaaaatttcatggctagaaaggatcaaaatatattacgctctgttttttttttttcttataagatggagcatccttaccttggaactgagcgttaaatcctttgcgtcggtggttgctgtcagaggtgaaatggagtcgtagccaattcttgctactgataactggagaggggaggttcatgccagttagcctagagaagagaaagaggaaaaaaatctcccttgtaaaccaacagagcaaatgtcctatatcaaacccgctttgaaatccgattacttaaatccttcatcttgagatgcttaaaacagaggccatgtattaattgactttgaaccttaaaacgatcaagatgattttatctttgcccaaacataaatgctaaatccctagatggaatgaatgttttcaaaaatatttgatactttcattctcctttattaatggtgaatgcaggaggaggtattcttttgatctcttagttcttttcatcaagatcttaatcacaatgaatcagaaaaaaggaaaagaaataggaaaatgataaaattctgtgtttcacaatttgaagacttagtaattccttatttatttatttatttatttatttatttatttattttgagacggagtctcactgtgtcatccaggctggagggcagtggtgcgatctcggctcactgcaagctccgcctcctgggttcaagcgattctcctcccacagcctcctgagtagctgggattacaggcatgcgccatcatgcctggctactttttatatttttactagagacaaggttttgccgtgttggccaggctggtctcgaacttgtgacctcaggtgatctgcctgccttggccttccaaagtgcttggattacaagcgtgagccacggcgcccggccacaagacttacgaattctatgtaacctgaagtagacgccaacaaactgtttctcatgcttggtaacaagctatattcccagcatcccatttgcaggactaagaacctgggcctttcctaccaaagtaaagaagaggaccatttatgagattgatgacaagaactgcaaaagagatttgaaatggaataaaattatgttttaagaaagcagtgcattcattttaaaaataagatgcaatcaatttctggttaagctgtttaaaatatccatttcactttacaacgtgcagtttagttgtcagaaacaatcatgtgttttatttctcactattgaaaaccttatgtgcttactaaggaataaaagcattccaagatattaaagctcctgcccgttagaggcgcaagggacacatttagtttttcagtggcataagcatcactggattaggatgcttctgatacaggattgcgtgctggctcgactttgtgctaggtgaagcaacataggtggatcatgtttatgaacctctgttacccattgtataaactggacacgaaaatacctgtatcaagggtcgaaagatgatagagatgcacatgtaaatgtacctgaagcacattctccatgtgctctacaagtggttgtgcactgaataattattttgcatcttggtaacaaaatctattttcaaaatgatgcttattagtgtagataatctgtaagggtttaagcaaattgcttttagcaggaacttgaactgtggtgctgcgtgtgggcctgcctgtgagcgccgcagctgcttggtaaagctgaggacctgatttctacacagacgatttcctacgaaatgggtcacctgtgtagagagcatttccctacttattctattacctggaagaagcaacaccagatgaaatacatagtcaagctttctgatgtcagggggctctattccaactctcaggtttaaaaatgtacaggatccactttaagttaaaagccaaaccttgactgtaaccaattacaacagtgtttatgccactgtttgaaataatcttctgtaagagaagtacactgctcagatttgcctctttgcttggatttatgtagtactggctggtgacagctggacacagctgactccaaggcatatttaatcacctttttttatttttctggtgagattatgttacaaattctataggccacatacttatttgcctaatacggagaatgtctaaaaaactagattcaaaaacccccagtctgtgccactcacctgtacttactgaacttacaggtactttaaaaaatcattgtggccgggcgcagtggctcacacctctaatcccagcattttgggaggccgaggcaggtggatcaagaggtcaggagatcgagaccatcatggcaacggtaaaaccctgcctctactaaaaatacaaaaaattagccgggcatggtggcgggcgcctgtagtcccagctactcgggaggctgaggcaggagaatggcgtgaacctgggaggcagagcttgcagtgagctgagatcgcgccactgcactccaccctgggcaacacactgagactccatctcaaaaaaaaaaaaaaatcattagtttctttgtatattaaaaatcaataattatttttatacacacaaatatcacatacaaaaaacgttaaattcaaacatagaaaatttaaaaactacaaacacatagatatacactgaaattaagcacagaagcaagcctaccttttccacatcagatacgatcctaatgtaaaatatatacatagctaatagtatccaaagccctcaaaatactgcactgatatttattcaatcccctgtaagtttccatttcatatggtgatagaagactatgaatacaaaagatcagcgaatgtaggaagctgcatgtacttgctaaacttttcacaaccgcaatcaatgcttgttttgttgctgctttgaacatatatattttctcactcgcattacttatgaacggttctgactgaaaaaaccaggtggaattttttttttttcttgagacagtgtcttgctctttcacgcaggctggagtgcagtggtgcaatcacagctcacagcagtctccgactcctgggctcaagccatccgcttgcctcaacctctggagtagctagagctatatgtgcacaccatatctggatagttttgtaatcttttaattttttgtagagactgggggtctcactatgttgtccagactggtcttgaactcacagcctcaagaaatcctctcacctttgcctctcagagtgctgggattacaggcgtgaaccactgtgccagcctggaattgcactttatttgcatgcctacattaataatgatcacaaataaatcccctctctaccaccacctacacccacatccactctttaccctcatctgtatttccaaatacctactcagaacaatgatagttttgtgtcagtcaacaggatatttctgtaaagggccagggagtacgtacgtatttcaggctttatgggtcacatggtctttgttggaaattgttcaactttgcaggtgtagttggcaagtagccataaaatggcagtgggtgtgttccaataacactttatttacggacactgagattttaatttttatacaatttttttgtgtcacaaaatagttactttttgattgtattttttcagtcacttaacaatgtgaaagccactcttagctgatgggccagatttggcctgcaggtactagtttgctgacccctgctctagcatatatgaagcgatttgtaaaaacagacccggtgcagtggctcacccctgtaatcccagcactttgggatgccaaggtgggtggatcacctgaggtcaagagttcaagacaagcatggccaacatggtgaaaccctgtctctacttagctgggcatggtggcaggcacaggtaatcctagataatcgggaggctgaggcaagagaattgcttgaacctgggaggcagaggttgcagtgagttgagatcacaccatcacactccagcctgggtgaaaagagcgagacttcatctcaaaaaacaaacaaacaaacaaaaaaaaccaacaacaaaaacaccgagctggaagataaacagatgatgcatagcagcctagtgtaattcaggtttaaaaaaaatgcgtaagtcctgcacaaattccttttatttttgacagtcttgctctgtcacccaggctggactgcactggcacaatctcagctcgctgcaacctctgcctcccaggttcaagtgattctcctgcctcagcctcctgagtagctgggattacaggcaccggccaccacacctggctaatttttgtatatttagtagagatgggatttcaccattttggccaggctggtctcaaactcctgacctcaggtgatccaaccccatcatcttcccagagtgctagggttacaggcgtgagccatcacactcagccttgcacagattccttttatagagaagcaagggtgagggctttagaccaattatacaatccattttccatgaagaagccattcaaatgaattgtaccccgaagtcgatttttgtacatgaatttcctgatttgaccttttgcgttaaacaaatgttcatagacttttgttgtttgtttgggaaagggggttgttccaaatgagacctggccttagaactgtgttgttattctatcgctgtctacagggccaggagctaatcttatagctctcatctgacacaaagttgatgctataaactcagttgtttcttcattacaaactacgtaatttaaaggaagatgattactgtacaaattaggtgaaattgtgaactctctaacaacttggtgtttcagttgagatttagaagaaaagaattcaactgaatggctttgtgggaggcagaatcatacctgctacagacagatccccaagccccgaggtcctgctctctggagactgtcaatgtgtcacctgacatggctcatgaggactttgcagaacaatgcgcttactgagcttgggatggggagattatactagattattgagtgggcccaatgtaatgaaaaagatccttaaagtggaagacagaggcaggaggacaaggttccaggtagaagagcctgtggacaaaggtcagagtgacgcattgagggcttcaccctcttggctgacaagaaagctgctgatacctttataactggaaacgcaaacaaacgccttttcccatagagtctccagagagcaacacagcccagctgacaccttgattgtagatgtgagatttctaatctatttactgaacataataaacacgtgttggtttaagtcattgtatttgtgttaatttgttatggtggcaagagaaagcaaatctcttgttgagatgtatacattaaatatgtatagcttttatatgtcaaccatatctccataaagtggcttaaaaagaccaaaacagaaatacggcctgttaatcagaatgatctagaatgatcctgaggaaaaggacagaaaacaaaatatggtacaatgtgacacaattcttatctattcataaccttactgaatccaggcagtttaaaccctttataaaacaaccagtgactgaagatctaccgctgttggagtgaggtttcctggaagtcttctacagctgttagccacacttcttttaggcctgctggatttggttttctaataaacaaatagtttggaaaatgaaagagattatggggcaaatggtggaaaatgggcatgaacagagacaagattcaaagtagaaacctctaaaagagaatagggtgccaggcacagtggctcacacctgtaatttcagcaatttgggaggccaaggtcagcggaccacctgaggtcaggagttcgagaccagcctgagcaatatggtgaaacaccacctctactaaaaataccaaaaaaaaaaaaaaaaaattagccagacatggtggcagactcctgtaatcgcagctactcgggaagatgagggaggagaattgtttgaacctgagaggcagaggttgcagtgacccggagattgcactgttgcactctagcctgggtgactgagagactgtctcaaaaaaaaaaaaaaaaaaaaaatgaggaacggggaaataatggtagtgatcaaccaatgtcttcccgcattaattcagagcgcactgaccattttctctcctgatgtccagaaacacaggacacacgcctggtgaaatcaaacggagcttgccaggtcagggatattggtgcttaaaaaacaagggggttgagaagtgagaaaaagagtaaaagagtaacaggctgagaaagggtcttcttaagggaattttgacatgccctatttctggagcatctcaatctaggtcaggaaacccacaaagccattcagtgggaatgttggacagctcctttagagatggcaaaaggaactggttgttcccacttttttcccctaagaataccaaattaagcaatttaaagcaatgccaaattcatttccttcagaggattcaactgggttttgcttctgctaagagttaaaataaatggaggactcatgggatccttacagttacgacgacctcctttgagcttaaatagaacaggccagtctgtttcattttctccaaataattgtaccatacattttaggattctatttataacatactcctactcattctttcatgtaacctccctcagcctcacttttctccgatgggatataagggctgaacacattgttctaacattttacagcactctgtatgtatgactcatgcatttcgcgtatgtgacttgaaaaatgaagagtcaatttatggggataattttctaaaatgcatttggaaatgctaatggttttggatatcgctttgtttgagtacttctcttacattaagccagatttcttatgtctttagaaaatcatcagagaaatgtctgggggtccctctgcagttaagtctctttaactatgatgactcagaagccagaaagcattactgctattgggagaggctttaaatgatctctgcccacagggggactaagaaatttaataaacctattacttggaggagaccagttttgtgtcaatttgggcagaaagccatataaaagatgtgctttttcttttttttttgcattttctggacatgcaatccaaatgatttgtactgtggtgtttcattatctctgttttgtcaaaattaaatagaacaacctgatcaaacagagagttcctgacatgttatgttttgaattggctgttactcacattgtaagtgaaatcatttctctcatgaacatgttttgagtttatacaactgttccaagtcttattttggacattaggaaaagcgacaatgaactctcatattgcaagaacatgaaaaacagttaaaagaaggtctatgtgtgtgtgtatacacacataaaataaacacaataatacccagacacaaatatatatgtacacacgcacatacacatatttacatagttaccaatatttctagaaatttaattcaaaagttttgtgcacacgtatatactatctggggaaaaacaaccaactatgaaacaaaataaaataaaaaaacccatatggtatatttaaaactgtaccacagaagagttttcattcaacagttctttaatcaaaacgaccatttttttttttttttttttttttgagatggagtttcaccctttcacccaggctggagtgaaatgagatgatctcagctcactgcatcctctccccaccaggttcaagccattctcctgcctcagactgctgagtatctgggattataggcacaaaccaccacacctggctaatttttgtatttttagtagagatgaggtttcaccatgttggccaggctggtctcgaacttctgatctcaggtgatccatctgcttaggcctcctaaagtgctaggattacaggcttgagcaacaatgcccagccaaaattaccactttctacaagtcatttcttccacccggagcggcactcatgattgtctctggcaaaggccttctctctccctgacaatgatttttctccctctggctctcttttttctgggagcactctctgaggcaccatcatgctccacaccagtggccataagcatccctcttggtgacatcatccactcctgcgactctagccacggcctttagctttttccttgtgccctcctatagtcaattttttaaatgaaaaaataatttctagtctcctgagccctcccactcactccagcttggctcattctgctttccagcctcttcaggtgcacatcgcccccatcccctgctttctacacccagaaacagctgacttcatgcagggcgccatgcaaagccccatgtgccctcctgactcagatcatcccatgcgctgtcccttacctggagatcagcagaaatatctgccctgcatcccacctactctgcacctgcctggtcgtttctggctctcctttaaatttcagatcatgtgttgcagtctcagggaagcctgccctgatctctaagatcaggcagctcctccttggctatgccctctcctgacacgccagacttaccctttgcagacattttcaaaatagtaatgacttggtataaggcacatggctgtgctttggtcagataggctgaggtaggatgtttatatcctctgtgactcagcgagtctgtagcacaggcgtgtaactccatttggtatcacagccatgtagccataacatgggaagcccatgacttggccctaagccgctcttgtctgtggaaggtataatcgccctgctgacgccgtacaggcacactggtgcccagagaaagagagagagccaaagctgtccgtctgcaaagatggtcggggggagccaggccacagctcggcttggtttattcccagagagagaaagagttaagctgctgaccctgaaggcaagggagagccacccacgcagccgtgtgtaaggcagctgccagagtaagcagccgagacacggtggacagtgtgaggaagctgctgatgagagctgctactgaataaaatcaactttcacctgcctacgccccacagagtgttctttctgctcatcccccaactctcttcagatctcaccatgacatttggtgtagtcttgaaccggacacttggtgatttgtatagttatttgcttaatgttagtcatttttgcgagattgaagcctgtcctattctcacggtctctctggcacgtaacagagtgctgggcatgtggtaggcactcaatgcacattggctgaataagccaaagaggtctcttcacccacactcccagagccctaggccagtcccacatcataaagtagaaatgactatatgaaaccctcgatgttatgatgccagctagggtgcttatacttcggatattttgtctcctccaaatctcatgttgacatatgattgccggtattggaggtggggccctgtgggaggtgttggtgtcatgggggcagaaccctcatgaatgaatggctggtgccttccccatggtaatgagtaagttctcactcttagtttactccagagctggttgtttaaaagagcctagcactcccccctctcctctcctttgctccccttctcaccctgtgatatacctgtgcccactctaccttctactgtgaataaaaatttcttcaggcccttaccagaagccaagcaggtgctagccccgtttggtacagcctgtggaattctgagccaaataaacctctgttttaaaaataaattacccagtctcaagtattcctatatagcactgcaaaacacactgacacaagtgcctttgtggctaaacagtgtcatagttggataaaccctgtacctttgtacagaaactagataagtgaggagataaatggtggtaggacaatgaccagggctccatattctcagaggacccaggtccctgcatgcacacataatcctgaggacactattcacatggaatgatttcctccaaagccttagacctcagcacccctgactggagatgccttatctccttatcttaataacctctatgggaatcaaaagatcccataactcacttgccctagaaacgtcctcaattcccactccccacatctgtctgtttgtcatgaagctcctcagcaggtgtttggcacacagccaccccttgtttcaggatttctggaggccacaggctctcagatgtatatttctggttgcactcaaaaagacatgactagaggcgaccaaagcagggctcagggagtgcacagcactctctcactccagggacccctcctccatttagatttgcaccgtacgcattaggtcactaagtcacatgtgttccacctgcaaagtacgcttctcgcttctcttccagctacacactgcctgtgttcccgtccaaaccctggtgtctctccttgtgctgtagggaaactctcctgagtgtacttgtgctccctgcccctctctgctctaaaccacattacataactctgatatgaaataccacaaacataatcaaacatatataaacaacgtatgagtgtgagacaccttactgggccctgaagacatgcgtgtgagtgagtagaggcacccacaatctttgagagcagagtagccctgggtgacggatgtcacacctgagacatcaccaggtggggagtacaggttgctgtgagtgtctgcaagagaggatttaaacttctcttggatggcagtttccttggagatgtgatatccacattgtgacttaccatgtgtctggctagacaggggctggggagttcattatctagagcagtaatcacctgaaaattcatggggaagctaaatcacagcactgcccttttctctttcttttttttttttttttttttattttgagagacattctcactctgttgcctaggctggagtgcaggggcaccatcttggctcagtgaaacctctgctgcctgggttcaagggattctcatgcctcagcctcccaagtagttgggattaaggtgactgccaccacacccagctcattttcgtatttttagtagagacagggtttcacatgttgaccaggctggtctcgaactcctgacctcaggtgatctgcccacttcggcctcccaaagttctgggattacaggcatgacccaccattcctggctgcactgcccttttttctaaaaatatttttcatagctttcaaacacccttaaaaagaggtcaactgtcttagtactgaagaccctttataatatgaatcgatttgtttctagcctcatttcttatcacgccctttcgtgaaccttgtgttctgcccatgtggtggcgatcactccctcgactgtctgctgtgctcctgctttcgcccttgatcctgtgcagtcaatctatgctagccccacggactcacttttgcctgtgtaaatccttcccaaatttccaaggtttttcagaagacatcccttccagagacctttctctccttgtctttaatagacttaaccactcctacctttacagcatttgtttcataggcttccctggaagttactgtgtgtcttacattattaatggttgtgtagaggtctacctcacctctgcactctgagcccactgagggcattggtgctaactcagacatcttcctcttctttgtagtattctgtatgcactaaagccttaacaagtcaattctaaatggtttctttacttttatttttgctcctaatgtaagttattaagagaagtgaaccctaagatgataaagcattaagaacagtaagagaatgctgctcttgtcctctcatgcccagtggcttcccatcagcactgcagccttgcaggtgggggcgcccagggggtgagatctggcatcctccttttgtttgccccagcatagctccagagtcctacgggtggagacaggtctcaggaatccagtggggacacaccttcaccattgaggaaggagaaagaggaggatgacagcacttgtgagagatagggtatgagagtccatctcaaacatgacagacttgagagaaggctgtaaaaatggcctggatgccagcaaatcaggcatcaggaattaacccagaggtcaggcagagaggatcatttgggagaggatgtgacaaagcccatcttcttaagcttaaggactacgtgccagggaattgctcagaactcaagcctgggaaatggctcagacagacaagtaattcgataagacagtcgagagacagtggccctgatggcatttctctgtgggtgtgtactttgggcctcctgtccacggaagggacagaggaatgaggccagcacagtggtgcgctttcttctgccggatgagagagctgtcatgccccacctggaaatctcctcacaggcctttcaatgtgggaggaccctccacgggtgacgcagatcacactggtattaaaaatcttggttgcaacaagctaatctggatccaagtcagtgacctggaaaacgaaacctccaagtgcctgtttctaacccttggctgtatccaatgtcctggtacctgggttactactgtctgtgaagacaggcctctcaggcttgccaacacgaagaaacaaacagggagacaccctttgcctcctataatacttggacatttgaaacagggagcagtcggcactggcaatggatatccatatcatattttgactatcaaaaaaggcagtgtcgccaaacacagagatctctataataaattccacgcacagtcgatactcaaagactgataataaagaaaataatttaaaaaaaaaacatggtaacaatttattttgggttcactgacaattttctcttgatattatttttagcatacatattctttaggaatatcattaaaaaacacatttttctccttaatcttgggataagaacaagtcttatcctagctcattccaagagcctgaaatgagtctaccattttcttttttctagcaaatttcttatatcacttgatagactgacgcagaccttgttcagtcagctggtaagatatccaacgagtccgacggcaacagatgcagcacggctaatgcaatcatatgggtccccaggcgaaaagaccagcagccctcaacatctgagatcatatgagctctcataactccggagctcttcagctgcttttcagcatcactgcctgcctcctgcagacccacttaaacctcactcaagtacagtagccgtggggttccgctgaggctgctgtgtctccagctggtctgtctgtgctgtgcttcttaggtcacgctgccatcgtagaaagcaagttcattccatgcacaggctctggactgaggccaaagagcagctcaggctcttttatgaaaaccagccgcctttctccccgacctgcacactctgcaatggtgtggtcattacgaacacggacagtggagtcatactgacctgggtccaaacacaaccatgtcctttcccatgtgggtgacctcaggcctttactcagccctcctaaacctcagaattgttcattgtgtgaataacgatatgtgctactgcagactgcaagctgctgctgttctctcaagcatctttttctacttcccccaacctaactaaggcttagattatgctctgatcctcactttatcccataacatccaaagctgattgctgaccttatccaaatacgagtgtgtggatctatctctcaactatgttttatatccacttgcatatatattcacgcaatgcatactgtatatgatatatggtatacaagtaatacctatatattatgtatattatacagtgtatgtctacatatactttgcgttaagagaagtgaaccttaagatgataaaacattaatgacactcagagaacagtgctctcatcttctcacgtacacgggcttccaccagcactgcagccttgcgggtggaaatgcccagtgggtcagataaataaatacgtctatttatttatatatcatggtaaaaagttaaaaagtttcccaacttcttagcttttttccactttacattaatgatgtgaacattacacgtcatgggatgctgaacttttaaatatttcatatgtctttgcagttccaaactccatgaatgcaccaggtatacaaaacagaatcaatctttgaccccgagtatagacagctacggtccatatgatttagagtcatatatttaaagacaggccaaaatgtgtgtcttcaaagatagcagagagggggtggacagtaaggtaggagaactaaagcccagaaattaagggaatctttaggaagagtggttcctggcatagacaaccatacagtggccaatggcaacaaggcggagacgtattcccgggccaagtgaatatcatgattgagctaggtggttggttcaccttcccactcagtgaataatccaacctaactgtggaagctcatcttcaatatgattgggaaattccaaacacccagcctttaaggagtaacattcctttagatcaatccatgtttataaatgttttaaattgattactgtaaccagaaaatatatttccaacatatttttttctgaaaatttctagtttatgccataaacaagaatataaaatagcatgagacaatttataagaaagtccaaatggctcagacactgctaaacagaaacaagagtactttaagttcaacacagagtgtaacattaaatagaagcaggaattgaccatattttattttcacttgctccagaagctcagaacttttaagtgttgtgttattgctcctttccagccagtctagcaaagttatgtaatttctttattaacacgcaaaccaaacggatgtatcccacattattgacacactctcagaaatcgtaaggcttgtcctaagttttgctggtaacttgctaatccattacttccttggtggatagtctaaaagaaaaaatgcacaggctctaggaaatgtccatcctagagcaccacttctttgaaggagggtctacttagcactcactgcttttcaagaatctgctgtgttccgatggaaggtgaatggaacaggaaaggcctggcggattcccgcacagcaggcccacagcacacctggggagggcgttagttgcttttggacaggcaggtgtgtttggttagaaagtcagtcaggaaaagtcagagttgagcaaactaattaaagagatgacttttccttattagttactatacagttaaattgattaaaagatgaaaacttacaatttccccttgccatgattttacaagcttttaatgttcacagacatgttggtgacacctacaacactcgaaggcaatttgatcatcaccatgattcttccatatatatcagtaacaaactatagctaaatagtggtctttagttaaaatcattttgagaaaaattgcaaatatgttaaaagaaagttgtaccaaattagataacaatatccattaaatactatgttaaaaagcattcaatgacacaaaagaatatgtcagatacatccaattccagtgtaaagtgacaggctgaactcattgtttttcttccacagttgttgagaaaatagaggataaaaaaataagaaaaaatataatatcattaaaattagtgacaaaaatacacctagttttctatgtgctttcctttacagatatgtacacgcagatataaaagtgaagtatctatttatacatcatttaaaatccacttttttccattaagagaatgttatagctctttgtatatctatatatatatgatgtgtgaattctgtgaactattccattgagtgaacataccattacttatttaaccaatgtcctgctatggcaatttggtattatttctcacagtctcataagttttatagcacatcaccttacgatgcatgtgtgttgaatcagcacttttatttcacaggatggactcctagaagaaaaacgtatgtgtcagaagggatgtagctcttcaggacttttgagaaatgcctattgcaatattgctctttacaaaaaataggctttgggaagaagcctttgaaaggcactctgtgaattcatacagtgacctgcctttttcttcctttttttagatccggccaattttctacctttgctgtgattcctgatcagggaaggcttgcgtctctatttccagattactcccttctttccatcagagcgattggcacagctgtctccagcaggagactaaaggctacctgcagccctggcctatgccacactcatacaggtccctctcccatgattttgaaacatttctacacatggcttctttccttggtgcaagaaaatactaggcaactgggcacagtgtctcatgcctgtaatcccaacactttgggaggccgagggcgggggtggatcacaagatcaggagttcaagaccagcctgtcctatgtggtgaaaccccgtctctactaaaaatacaaaaattagccaggcacggtggtgcgtgcctgtaattccagctactcgagaggctgaggcagaagattctcttgaacccaagaggcagagattgcagtgagccaagatcacaccactgcaccccagcctgggcaacaaagtgagactccatctcaaaaaataaataaataaaaagtaaagaaagaacataataggaacattaagaggcctgtcgcacatgcagaacggccataaatgaagggaagaagggtctgaaaggaaaattgtttttagtgctttttcccatcatgactgactgtcgccccaacaccttgtgatctaatttcatgtcactgtaaccatgatggtagctctctttcccttccattgcctactccattccccgccaaacccatacttaattgcagtttttctttatactctctcaaccattatatatttagcagctgacctaagaaaagataaaggaggaaaaacaaatggtcctgtagctcatattttttagtctcatagcattttgcaggattaaattaatcattttcagatagcttggtgaatctccgaattcaataggaggtaagcagaaattgcccagtgcatgttaatttggacagtttctctctctctctctctgtcagtgtgtctgtgtgtgtgtctgcgtgcgtgtgtgtgtttcatttgcatgtctgtggtggacaatagtcttgggggtattgtattctcaggatcttgaaaaactgtatccaaattgtgaacaaaaaataaaacatttcaacacactggaattatgacttggtgcactttggggaaaaacgatgactactctttttggggccagctactttggggttttgaaatcgtgtttggctccgtgagccactcttgctttgaggttaggtccagaggctgcacctgctggtgcttctggaagccttgcttactctcagggataacagacaaagaagaacgcttagaaattcagacggcattgcttcacactctgcaaaaagagtttacaaaggagagatttcattcaaaatgctttttgcagatgatagcaagttcttctctcagttgctggtgggggggcaagcagggccaggccaattctcaagctctcgaacacacaacagtttggagcttctgctcatttgggtgactggatagcatcaccattgcagaaacacagccctagagacctggagagcctcaggggcagggagtcaggcagcatcaagttggagaaaggtgacagaagccagtgctgaatcacccccaggaagcaaaacacaggaggaagagaacggagaggcccctaaagacctcgaggtaaaagcagacaaaacgcaagattcaatgacattgactgtgtgtgttcaaatgacagcatcatgctctctccattgcaggaaagaactctgggaaccctttactatgaggcagaatgatccgttcaatacattctcactccttgtccttgctttgcccacttttgaatctgccacagtcctgatctgacccagatatgagcaggagaaaaatagcccacaggcaactcaacaagccgtgtaatgtctactggcattcagcaattacagcatttatccaattctgggctggtgagaatccataccctcctttgaaatggatctaaagaggagcttctagtgcgagcatctgagtctgccattatgctaccaatccaggcggttgatattagggtgattttgtgtgagtgctctaaactgtaaatgaacacctccttttctccttgaattctcagaaagggcaacatatatatatatatatatatatacacacacacacacacacacacacacatataatacacacacatatttatatatagatatatacatatatttagacatacatatgtacatatatttagacatacatatgtacatatatttagacatacatatgtacatatatttagacatacatatatacatatatttatatatacatatatacatatattcatatatttatatatacacatatatacatatatttatatatacacatatatacatacatttatatatacacatatatatacatatatacacatatatatacatatatacacatatatacatatatacacatatatacatatatacacatatatacatatatacacatatatacatatatacatatatatacatatatacacatatatttatatacatatatacacatatatttatatacatatatacacatatatttatatacatatatacatatatacatacatttatatatacatatatacatatatatacaaatatatacacacacacatatatatatatacacacacatatcaaacataccttcattcagcaaatattgaacgaatgtctggtctataaagcaccatgacagccaactggaagtctgtgtttaagccatcttacagcacctcccaaccccctcctctgcaccacatccttagtgcattcagggtgacaatgaaaatatcacagatgagggctgataaaagacatgtttatggctcacagttctggggtctggaggttcactatcaaggtgccagtggatcccacttctgggaaggactggattcctgattcagaggcaggacctcctccctgtaccttcccatgacagaagggaagaagggagctctctggggcctcttctataaggacactaatcacactcacgagggctctgtcctcacaacctcatctcttcgccaagtctccaccttctaatagcattaggatttcaacatgaactctagggggacactgacatttagacgatggcatgtactcacataatctgtcaccaaagtgtgaaactagcttgtgttttagattctccatgcataatttggggatataataggtttggggagagctggtaggatggggtcttgccctgtcacccaggctggagtgcagtggtgcactctcagctcactgtagcctcgactacagtgaaggctcaagtggttctcccacctcagcctccagagtagctgggacgacagtcatgcaccactatgcctggctaattattgtattttttgtagagattgggtctcaccgtgtttcccaggctggtcttgaactcctggactcaagtgatcctcccaccttggcctcccaaactgctgaaattacaggcatgagccaccacacccgtcctataataggtatttagtgaagacaaagtaagtccagtgtaaactatttggcagttttattcaattttggccttattctctatttgctgacttacagcaacagcatcttaattgagttcccaccttcaaattgatgatgaggagggcaagcatgatgggcggtgacactaacccagaataaatatccagaataaatatcattcaagtggcaggcccatctacatgcttcaacaagtcgttttcactcactttcccccacattgtatttattttgatcattactatgttgctgaggaaaatgcaaaccaataaacaaactggggacctgtgaggttgagtaatttgcatgacattgcacagctaacaggagcctgtgcctggattaaccctgcatctatttgctcttaattcttttacttacacagttgctgcgctatcctacctatctttcattcttgggcttttgctattttcctaaaatacaggctgagtcatgcagcttcttgtctaaatatgtccgcaacccattccctcttaggtttgagcataaatttacgctgcacaaagtgttatctaaagccttttgtgacctgcaccgcctgacccttcaaccttataattttctcttatccaacaacttttggctcaaatgccacttgctctgtaaattcttacagattgctgcaatcagaattgaattccaatgtgttcccagagcatctgggtttcagtagagtacacagtgcctgaggtgttatcatatggcggttgtttggatgtctgtcatctccccgggatgcaaaacacaagtttttcaaagatgccgtcagcctgctttccaccatgatatctccatgctgcctaatgtgtgctttgttgcctggctcataggacagagagacggttaaataaataaatagaaagatgctgaatacatgaattggtattaatctttcattcccctccttagtggacagaacgtcatgtcttcctgcttttctctgttaatcttcagttgggaacctgtttcaaattctcactatctttgttgaactgtggacaacctagctggagaccagtgaaaaaatcagtttgactaatgctaagtgcaaaggaataacttcacgatttctgctctcaaattttggtgaaaggatttctatttactattctaatgagtacaatatggatgacacagtgtccgtttttaagccatgactgtgctgccccgtcattctcaagggatacattccaagactaccagtggatgcctgaaaccacacagagtgctgagcccatatgtacacaatgtcttttcaatatggtaaccaagaaggctactgactgaccagcgagacgggaaacaggtagcatatacacagcaatgcactggacacaggggcgattcccactcccggcaggaccaagcaggatacaggagatttcatcatgttactcagaatagcatacaatttaaaacttacgaattgtttgtttctggaattttctatttaatgtttttagactgctgttgaccgtaggtaactgaaactgcagataaggaggaactactgtatttctttatttataccaaacttaagtccaaaaaagaattttgaaaggtttagataaaactttgcaaaacaagttagaaatgaattgtatgttaaacattggaagatttaaagacagtgaaaaataagtgaacagaagatgaatccaggagtgaagttatgcaggcaatgtatcctacgccttcacctctgaaccatctagcagacacagcatagcaggtaacaggcccaggtacctgactcaaattacacagcaattaaaaacaagtactttggggagggggcaaaaacaatcatttatcaatgatactcatgaaaaggacacggggtgaagttatgaataacatttccaataggatcctaatattaaaagcagggagaacttttacaagagcgcaacttcaaatgatctccagtgtggactcatgtgctcttgtcagtaaagttcgtaaattgttgggactcatgtgctcctgttcagtaaaagtcatagattgtcggggagagagcccaacacagtcactgaaataagttctagttcctaaatgatgcacgcaaacacacagttcaaatgatatgaactataaacttgttttactgccttaatctacaaaaggtccacgaagcattgctgggtgctgatgtcatcatggggtccattgctttccgccaacgcgcagggttgttactgacctaggatgggtcctgagacctctctcccttgcgccacatgtggcttctcaatgagctcctccagtctcatggatgtgaatgccacctatatgctgatgatgccaaattcatgtcatcagcccaggcttcctcctcagagcttcagaccctgatccaaatttccccttgactctctattccatgtgctggagccacctcagaacccatacacctaccttgtccatacaaatctactctttccccatcctcccccatccttccttccttcttcttacctgcacacactctgctcatctgcacatcatacggatcctaccttcagaacagatccatgtctgaccatctcagcaccggagggtgccctgtgctcatccggatggaggtcacagcctccctgcttctatcctccctgctccattctattctcagaacactgtccagaggggtcacatacaacccaaattagatcacattgcaccttgaagcgacactctccaggggtcacctgtctcactgagagtaaagccagactctaaagaggcgctgcaagggctgacaccttctcactcctgtccttctctaatctcctgtctggccacattctactcacacacctagctgtggccacacacacatttcctgctctctcttaaacaccctggggccttggaacttgctgtgccctctgcatagaatgccagatattctcaaaggtgactcaccttcttcctacgggacttttgttaaatctcattgacattgtagactccatatccagccatcaccacctccttctttccctccttcccaccaaggcacttgccattacctgatttcatacagatggctacctggagagatgatagatacattaggtagatgacagataaagataggcagaaaaaagatacagagatgatagatgagcagtgatagatagtgacatatagacgagatatatatatatatatacagatgacagatcatacatagaatgacagatacagacaaagatagctgatagatataactttgtattttttgcagagacggggtctcaccatgttgcccagcctggtctcaactcttgatctcaagtgattctcctacctgggcctcccatagtgctgggattacatgcatgaccccccacatctgaccttaaatgctggaggatttaaagacaatggaaatctgtctatatctgtttacatctatcatgcttcctactatctatctatcatctgtctatattagctatctatacctacacacacacacacacacacacacacacacacacacacatcatatatatatgtatgtgtgtctgttacttgttatattatgtttaaaatctgccttctcctatagaacatgagctccttaagggcaggggtttgtctgcttgatttctgcttggtgcacagtccacagtcagtaaatatttgttggacaaatgactgataatcctactcacacagtgctccagacagcagtgcctccagatgagctaactgctgcaggatacttgcatggccccctccactgctcttgcacctggggcatcctgtcaggcctcaggcaggcttcaaagggagcagtgctcattctggtgtcctgctactctaagagatgatgggctgaggatgctctgagcaccataaaatcctacaggacggagggctttctcctccaggctccctctagtccacaggagacaagctgccatacggaagcagtctcagaatgagatgcctcccccaccagcatcccaaccagcaacaagaactcctccaaggagcctccttgaagtgcagagtctcaggacccacgccagacctgcggcctccttcagatgcagagtctcaggccacactccagacctgcagcctccttgaagtgcagagtctcagttcccactccagacccacagcctccttgaagcgcagagtctcagttcccactccagacccgcagcctccttgaagtgcagagtctcagttcccactccagacccgcagtctccttgaagcgcagagtctcagttcccactccagacccgcagcctccttgaagggcagagtctcagttcccactccagacctgcagcctccttgaagtgcagagtctcagtacccactccagacctgcagcctaagaaactctggctgtctggctgtctgtgcttaacaggctgtccacgtccctccaggggaaactggagtttgagagctgctggcccagagcattatcttgagaaagactttgagactcagtttggagtcagtggaaaaatgtgtcaggatagattagaggcgtcagcagggggcagggacgggatcctggccgtttgtcctttagaggtctgtggaactgactattttctgctctgacatttgctatcacattctatttgcctgtcagtagtttaccatttaaaagggtatctttctcctgttacattttccccaattagggaaacctgtgtaatcaccagctgtctggaatcatttcggtaagaagaccgggggcagaaacaaataaataaaaagattcaacacttaaatgatctctttccacttccagccatcccaaggtgccctcgccttacaagggttcctgtcttacggtagtcccattgcccccatccctaccttctacaagaacgctgcccgtgtgcctgtgcacgctcttgcctggggtttattttctgagattctctagcagaaaagagcatcagtgccctctcctgtctctgttctgcacctctccttcctgcctccaacctttctccaggttgtttctggaccagagcttcctgcagtttcagagctggccaaagatcatcttccgagcaccgcttcctttctgcagggcctttggaaatcaggttacaaataattgcttgtgattgggtatcatggagccttgtttcatgctccgaacacttttctcctgactgctgtacaagtttattattcctcattgaatactcagttgagaaaacatgctgcttgcaggcatttggacaaaaagtaggacaggagttcccggatcaacaacaatctctcaaaaatgctgtttctgggaggacaatcagccttggcttgtgttcttttcatttgcagcactttttctaggctcagatcagctcagagacaccagaatatttgcatgatcaacgttttcataacaaattaccattcctgttctcctctaaatggaatgtaggttaaaagactcctaatgtctatttttcagataaataaaatattttcactatgcgtgcatacttgtgtgtgtgtgtgtgtgtgtgtgtgtgtgtgtgtatgtgcagtatttgagagggtgaataagacagaactcactgtatgccttctagaaggtgaggactagcaagggtattatctgtttgcttgagcttttatgaaactaggcttgaacttttctattgatttttagagatttcataattttaaagtagtactgtagctacaaattgtaatgacccaagatgaagaaggggcttcagaaaccctgtaatcgatgagcactacgtaggagcatcaagaaagatcgtttaagttgtcattttaaaattttagacatcttaaaacaatccttttatagtattcactgatttcatcaaatatgtgatggaaaattactctgctaaatgagccatgcaaattagcagtgaattatgctcaaatatccaaaagcaattatgctgctgaataaccgggtattttaataaaatatggataatgacagcgttaatattttaggttacatttatgcaatgatatgacatttaaaatatagaaaaccagatacaacactatctagcgcatattttatatctgcagaacataaaattatatttaagttatttgaaagagatcccaggtcctcatgctccttccagaagattaacatccagaaatattgagctgagacatatttaatagggacaggaaaaatagttgtttaaggtgttcttgaatattttgaaaatttagtttcatttatttttttctctcatggcctgtctcccagatccactgcttgtcttaacctttaaattgctgaaaactaagaaagcttaaatcaaccaaaagaatgtgaacttccaagctccttttcctaaatacaaacatgttcctggtattcacactctacttctacttttgtgagaaacattctttaaaattctttaaaatccttttactgtaccagtcggtgttgcattagaaggcttgcgctgatataaacctgtgccatcggggtgaaacatagtatgcacaaatccaatatgacaggttaaaagttaaaagcatcctttatctccctctgtaagtacactggcattaatcaaatcagcattgtctggttcttccatgctcagaaatactacagaagaggctgagcaattagttcgtattccgcaaatgagtcaactgaaataacagttgttcgttagaatagaatttggaagcattgcaaacaatcaagaggcggcctggtccttaattatcgccttttcagcacacattatcaacactgctgactcactagtaagagtggatttcacaactttaatggttcaaaattacatcctgaatcgagtatcagtaaccattccatcaagtcaatttttgtggtactactgaattggatgggtaatgagcttcaacaaactactattttcaaattcacaaatactaaagtgcatctaataattcactacaactgtcatcaaactgggcctgctcccagctcctggggttgtaatcaagcccctcacctgtgcaaaccgcttcagttgtcggcagaaagagcccagcctggtgagaaatgcacagatgctttccacataaagcccatttaatctcttgggtgacattcttatacacagattcatctaaaagaaagtaattcaatcagctggccctagtgctttgccatagaacaatttcctcaataattttctctgcttattggatattttgagatttgcagagtgtggaaggggtttaggtaacactggagaatttaggtaagaccatggctttctaaatgtaaaaataaagctctaaagatatctgtcttcatgatctgaaaatatctgtgacattttgtgtgactccttggaataaagtatttcgtaggggaaactgaaatctaagcaaagtaaagcagcaaatagttgaaagcctgttatgatcatggcactgcaaactgtttcaagaagccaaaaacaccttcagctttggagttcatgatcaaggttgtccaaacaagacaaagattggtgattatttaactcacagtacaaagtgataattggagcaaaatttaaaaaattgcacctgttcaattttgtgaatcagaatgtgcactaccacagagtacatgccgagagaatatggtatgaatatacaatattcatacatgtctttgttcttttcattctttactcattgaacacggagtctagggtcaggtcaagcgcattctatagagttaatgcaagcttgtgctgtgaggccaggtggactgggagcagcacagtctggggggtttcctctcagagaatacgggttaagggagctgctgatagttgcaccacgtggtgcccctgagttaggtgtgcgattgtggacatggatatatggtctatctgcttacacactgctactcgcttttgaaaagaactctccaattatcagtgtactctgtcccacagtctcacataccatcaagaaaccctatagttgatgattgtccctgtgatgtgaatggcaggtgcctaggtttccatcctggactccagcctacggaggttctagggtgtccccatgtgagggggccaatattgcccctgacaatctgatagagacaacagagggcttagaaatgctgaataaatgtttccttttaaaaaagttatgactttttatgattttgctctctatacttcctagattcatttgttcaatggcattttcccgctattttttttcacttaaattcattttctaattttggtagacccatttaataagaactataatctcacatgccaactccattaaaaaaggagtatgtggtaagagaagggatgatgatactgaaagacattttgattttttaagggataatttaagagtatctctctattattattctgtccacttaatacttggaaggagagtttgataaaataaacaataaaatttgagagccatgaagaatgtaggggtcatataatttctttttttctcatttaaaagagaaaacaaacgaagtcaaagaagttcatgtcacatgaaaagcaaattcacggtgcggcataggacagaatctatgtcagtcaccaggatgttagttttgtgcttgctttgtttaatgatactcattgacttgcttatatatttccatgctaaccatacttgtatgatactgtggccctataggaaaatgttcaaaaagggaactccggcaagtcaatctttaacctgaataatcacgataaactaaaaaatagactataaataggctgttcaacaaccctgaattcaggacagcagtaatgacgcataacatgtatagataatctaataaaatcaagtgctttttaaaaaggaggctgggggagggatagcatgaggagaaatacctaaggtaaatgatgagttgatgggcgcagcaaaccaacatggcacatgtaatcctatgtaacaaacctgcacgttgtgcacatgtaccctagaacttaaagtgtaatttaaaaaatgctatatattctcagagtcaacaatgtttgagaacaagctaatagtttttggctaggttcaaggagctgggtgttggtgatactgaattataagaacagtatgaatagagatctaaataaactttaggaattaaagataacaaatgattttataagaggtttttctagcatgaacacttatggagcgactttcttgccctagctcgcctgggaatactataccgtgagccattaccaaaaaataaataaataaataaaactgtggttaaaaatacatggcaagagatctagcctctaaaccaaattgtaggtacaggattgttagctataagcaaaattaagcacaacgtcctatagcacatcgcaagcacgcgttcatcttctgtactgacacttcctactgttgaaagcaagtccccatctccccatcccgtaacccccagcctccaccatcctcccttctcgggatttatccagaaggagattatttttgacaacttaagtctcaacatctttccacctgttctatttgttcaatcaccattctttcttgttcctggatagcagtgcatggtcaggccgatactgtgtaggtgctcccggaaaaactggttttttgcaaaactcaccattagaaatactgggatggatgggaaacacagtgcagatggcaggtttttcaagtccgtacaactctgtgagcaaagcaccaggaagcagtcacatgcccctggggtgacccacggctggcacagtcaggcggccctgggcggccctatgctgatggcaggtcgggagcacagaagcattggcgggctgtgaggcggccctgcagtgctgaggaggggaaaggacctgaatcctgtgctgagggtgctgcccctaaggtgggcacaggaggaagcaccacctggcacaggtgagagagttggacacagtagcaaaggcctgagaggaagccctggatgcagctggttcttctgcatgtccataaaacatggttgaagcaccctgctgctggttcagcagtcaaacggaggctcccctcccctttgctcctgaaaggtctcattcttactcctgctattcagatccccctttgcatataaggggaaaagaaagtcgcataggagacactgaggcttccatattgtaggacagcattttcccacttaccaattaatattgatggatgactgttttcacctcaggagcacatgaactagactcggccatggttgtggtgcaggctggagctgggctgcagtttgaataccccagctctgcgatttacctattacctgcccttgggcaaattacttcctcttctggtgcctgacctttcttatttgcaaaatgtttatcatcgtacaacatgcctgacagcactgttgtgaagattgaaatagtaaattcatttaaaatgcttcggaaaacattagtgtgtttggacaataataattacaaattctttttcctctctctttctctctctcatgcatacatatagtagacatgtaagtgtcacaccttgggaaaggggtgggtacccaataaataacaaattattttttaaaaggatgtgtaaataaatgtccaacacaggaccttgctagattactaaatttctcagataaataatattaaatatatactttctaatatctcacttctaaaattaaaagttgttctattgaaaaaatggagaaaacaatgagaaatcacacgattcttcagcccagaaataactgctgttagtattatgctgtttggcctttcagtttcttaaagagatatataagttcctgattttaaggtgaacttctagggatgggcacttatttttggacttgctagaatcctcaatttctaacacaccaactggtccctcatggtcataaaatgaatatttaaatttctaatttattaagatgcttcaatatatgctttagcaaagaacagaaaaatgaataaatcaataaatagaaatctgtttggtttggaaataagggatattgtcagcaaattttcaaatattcctggaaatatgctattattctataaacaaatggtggcagacaccaatgcatgactaagtaaaataagatacaattagcaattccactcatatttacatcatgttgcatatcacaattgcttgcaccatttccgctgattttcaactcatccaatgaaatcatcacaatactgatgttaacatttgcttaaaattgtactttacaaacatcatttttgtggtcaaaacaagtttcctgttgagctaaaatatactgctgtagaatttaattttatcattctggtaaaatgtctctcatgtcagattctctagctaaacagttataagtagagggagggaatagagatagaaaaactgcccatctcacccctcaatagcatagtggactttgggtcaagattgactgaatttgaatcctggtcctacctctgtgatgttgggtaagttctttaacttctcttggccttagtgcctgtctgcatgatggagatgatgactactgaattaaagagttgttatgaagaatcaatccatcacagtttgtgaaatgctcagaagagtgtctgtttcaaagcaagcacgacagaagcatttataaaataaatgatgaaacttcaggctgcggaaaataaatgccccgggcaaggcctcagtcagcagtggaaccatttcttttttcattccacacctggccatcaagggtctgttctggtgagaggtcaggctaagcagctgggacccagcaatgccaagatcagcaatgggccatgccctcctaaggcttgtactctagtgttggaaaatacattaacggcagtcaaacacctaggtgtacttccacaaacacaatcagggcttgaagggagaggtaagcggtgctaagaacacttaattggatcatttgatctcatttataagatgttagaagcaagttaccatcgagtgtttattgaaggaagagttggcatcgccctgagggtgagtgtgggctgtgtgcatggaggagccacgtgctaccaagaagtgagaggcccagggtgcggggagccaggagctaggaagcctatggtgccccaggaacctggaagagtaggtaggtccaggctgcggaagagctatgttgaagagcttcttccttattcctgagggctttgggaagtagagcaattaaagagggatatgtcatgtttgtgtctaaacattaacaagatttctctgtacaccattcttggagccgaggaaatggaaggcagacaattgggttagaagctctgcagttttccccaggagacctgagtacttaggctgggctggtgggcattggggtgaagaaaattagaaggacggaagaagtgatgtttgggaggtgagaatgagcaggcctcattgaaagactgggtgtgaggcgtgtagtttgtgaatcaaatagaggtgaggctgcttagcaaaacaggacacagaggagcacctggtttggggccagattgggacatgagatctcccctgttattttgggcacgttgggatcaaggtgtcgctaagacattgtcgggagatgtcaaggcaagagtggatacatgggcatggaggttagaagagacctgagggtggagacaaaaatcctctgtctgttggatggagggtcactgagaccacgggcttgggtgacctcatttagggagatactagagtgagaagaagaggatcgaacaagagtttgggggaccacaaaagtacgagagaaagcatctgtaaagccataaataaggggaagcaggaggaatggtgacagatagtgtcagacaacctaggagtgggtgagagccaagaatatcacagctcccgagtaatcatgcagactgaggactttacaacggcctaggatggacaggaaaatcgctgttgggctctctcagcaaagcagttgcttaaatctagcatcttagttcactcgagatgctatgataaaatactacagactttgtggcttaaacgaaaaccatgtatttctcactgtctagagggtggaagcccatgatcaaggctctgatgagaactttctttcaagctcacagagggctatcttccccttgcgtcctcaggtggtagagagagaagaaggaaacagaatctctactggctcttgttataaaggcactaatcacattatgagggccacaccctcctgacctaaaagccccacctcctaatactagcacctttaggatgaggatttcaacccaggaatttggatggacaccggcattcaatcctcatcatctagattagatgagggcatggaagctgagggtcaggatctgaagtctaacttaagtaacttctatgtgtgaagtgtcatatttattctgagtttagagtgtgtttacagagggttaaaccaagctttatggtaacaacataactcaagaggaagggtagtcaaaacatattctgaacatgtaatcaggtagctttcactttctagaaaggaaaaaatgtccagaattttgtattcctatgctgaggaaaatgaaaaacaacaacaaaaaaagaatttgaaaaaacttgtgagttgtgaaaaaccataatcaattttagaaaattgatttcatggatatttaaattggaaagctatagagaaaacagttcaatgttgatgccattttgcttgcaaaatcaattaagtaagcagataaccaggattctcctgttttgtgggaaattcatgaatttcaattcattttctaaatgatatacaataattcatgtgaaaaacaaagtagtgattaatcaaaaaaatgacagcttatcagaagaacctaacagcaattaagaaaatattcatatccatgaataggtaagaagatacagattttccaggtaccttaattaaagatgtagttgctacaacagttaattctgtataagtatttttattccaaggagaaataaggcagcttggtaatataatttagtattgtttacaaattattgtaagttttcacacaactagaaatttacattacatttgtaagaaaaacatagaccctgtatggggaagttaagaagtgttataatacaagctaggaactggcactttttagtactttaaatgtgctggaataagaaatcagtgtcctatcttgcaaagcaagaaaagttctatcacaaaatagtataagtatgagagagtgttactctattttgccagattaaatctctgtagttgtgaggggaaggagatgggcagaaatccttgcatgggctcctaatgctcttgaataattgggagctgtgagttttagaccaagagtaaaaaagaggtgtctttggctagagtcttaacctcacacactggctcaaaaagcctctccatccagtgagtgttctttgggaagacttgcaacgcttagttctaaaattttctttaaaatattctcaggacttggagatgaaatcatttgtaaaacaagggattcatgtgatactacataattacaaattacagatagttggatcacaggatttaacaggcatagacctgcatttaaacaagatggagctaaacatcagttttctttcttaaggaactttttcatagcattttagtaaaatgcataataaattaagggatgggctttaggtaccctgaggtgtgcagcccatgcctccctgtgcccacagcagccttcattggtcacagaagacccaagtgaggcttctggaggtgcccaacagaagaaccagctgagataagaggcagaaatcaaaatagaactggggaattctttcctacttaagaacttcaggatcaatagtttccttcatctcacctcagatatttattcaaccatccatccatccgtcaattaatttaatgcattaaatcttaccaaaggtgttaataggattgtaaagatttagttcatctacattttacttgagccctctgaggtagataaatgtagacaaaaatgtaagtacctctccatctacagacacagttatgagtctaagtagccattcagagattagaaagcactttcacatccatgcagttgttccatttctgaatgtgtgcataagagagtgcaaaatcaatacacaggacagacgcatttatgtatttcatgcaaccttcacactaacattctggggtagaaattatgatctcgcccattttatacctgaagaaacacaggctcagaggaggaaagggacttaggctatgggtacgtatttcctagacagtattgtagaatttaaatgcagataatctgattccaaattgtaagttatttccactgtattacactcttcccaaattaggaggatgctatgttctgaatgtttctgtccctccaaaattcatatgctaaacctaagcaccaacatggggggattaggtggtacagcctttggaaggtgactaagtcctttgttttagagcaatgccccagagagcttccttgacctttccactatgtgaggatccaacatgaaagcgctgtgtatgagcaagatagtgggccctcaccagacacaaaatatgccttggttttggacttcccagcctcctgaactgttgttttcaagcttcccagtttatatttattgtgacagccccaacagactaatacagagaataatgtaacttgtgtctgcttgtattgctagtgtttttttttttaagtagtgtttttttttttaagtaagttttttttttttaagtagtgtttttttttaagtgtttttttttttttttaagtaagggacaaaactttaacaggaaaaggaatacagattatgaaatgctaccattcaggtttttatgctagtactttaatactccaaattaaagtaatatattcactcacttgctaaataaagcttatatgactagagatactgaataattcttttagtctttaagtcctctaaaaaataatagtgaaaacccaaaattgcttaatgagacatgtatgaccttgtttatttagtatttatcatagatgttaaaatgatcatggttaattttttttttttttttttttttgagacacagtttcactctgtctccgaggctggagtgcagcggtgctatcttggctcactgcaagctccgcctcccgggggttgcaccattctcctgcctcagcctcccaagtagctgggactacagctgcccaccaccacgcctggctaattttttgtattttcagtagagacggggtttcaccatgttagccaggatggtctcgatctcctgaccttgtgatccgcccacctcggcctcccaaagtgctgggattacaggcgtaagccaccatgcccggccgatcatggttaatattaatgtaagaaattagagaatgtcaatgaaggtccattatatgtctattaaatgaaagtgttagctgcttatagttattttcgaatttaaattgccttggctcacatgccgttttataatttcaaatacataatcagaactcttttgcatctagtgaatcagtgctgcctacacaaaactcctttatcagggaagagtgcattatcaatcaaactgaaacgaaataacagaaaacaagatgaagtaagtcatgtgtagctactggctgtaacttcaaatgtataatgatggtgatggtgatgatgatggtggtgatagtgacggtgatggttatgatgatggtgatgtttgacagttataatgacaatggtgataacagtattataatgatggtgatgatgacacggttatggtaatgttgatggtgatgctaatgatgatggtgagagtgatggtaattatgacggtgataaccgtgtgatggtgataataacaacagaaacttagacaactaggaacaatcataatttttttttatgtttttggcatacacaacaattacatttcacaataacaacttatcaaaacacaaagagataatagctgggattttgttgttgttgttaacagggtttgttttatctttttgatatctagatacctttgacaaaaacacccaaacttctccatttcaaagataacgaccttcagaaataactgctgagtatagtgagtttggggtttttgcaacattgaggtcgataatgggacctggagatgtcagagccctgagtaaccgtccctctcccaggcagctactttttgagatggaaactgtcgctaatgaatggatgtgtcaaaactgtcaggtcctaagagcaacagatgacacctgtcattttaactcacaggaaagatggtcaaaaatattcttcaattataggcaaatggaatgcaacaccttcaggttataaagactccactaaaaccatgatcatttttaatatgatttatggctacttggtgagaaattaatttcataaaatcagtgtgatggaacactttataacttttaaagctggagtgcatgacaaacatattcttctaggttattacttatattttaggagcatttagatgtgtttgtaaacccctaccccaaacataaacttccaccaccaaaatgcttttagagattctataattatatccaaagcatgtatgataaacttgctctaattaatgaacataaatttaggtatctgaatttaagtatagtagaatttcataggataacctgaaacaatgtgaaaaaataaatttggtgaagaaaatctttcaaagctctttgacaggggattcttaaaattcctctgtatttctcacagcatcctagcatagtgctgatacgtagcttgtaatacgttctttagttgaataatttgaaaagtcatctctacaacaagggtatggacaattttaaaattaccttaacaggccgggcatggtggctcacgcctataatcccagcactttgggaggcctaggagggttgatcacatgaagtcaggagttcaagaccagcctggtcagcatggcaaaaacccatctctagaaaagcacaaaaattagctgggcacgatggtgggtacctgtaatcccagcaactcaggaggctgaagcaagagaatcgcttgagcctgggaggtggaagttgcagtgagccgacgtcgcagcactgcactccagcctgggtgacagaataagactcagtatcaaataataataataataaaaaaataatgtatcaaaccctttgtataggttggtgcaaaagtaattgcagtttttggcattgaaagtaatggcaaaaacctcaatagcgtttgcaccaacctaatagcttattatccttcagacacatcacttccttgttcttttctgatttctaattcttttgtttacttctaatgttttgacagtcaattaacttgggcaacctcaaagtttaaccaaatctctatgttttcctccttcaagaatgacttcctgagcctgggccaaatagggagaccctgtctctacgaaaagttgaacaattagccaggtgtcatggtgcacacgtgtagtcccagctacaggggaggctgagatgggagatcgctcaagcccaggagggcgaggctgcagggagttatgatagtgccactacatgccagcctgggtgacagagagagacctggtctcaaaaagaagaagaaaaaaacttcctgggagataataataataaaatcaatgaacacccacatgtacattatgatcattaatgtagccacttcctgcctcatttcttaaccatgacatatatatttggttataaaaacaaaggcaaaactgaacaagatgaggacggagagcttactttttgccttaaatgccaaagcgtttttgcaactcgctgattactgtcaattatctcacaattgatttatttttcagactagtaactttggaattgactcctcctttgttagctcccacataccttcctcttcctttcaccctcagacaaatcatgacaggcagtaagttaatcatttgccatgttacagaaaacaaaacagagaccgcaatcatgaaatcttttctaaaattgacacagtcaagttggtgaaagagtttcaaccagaatgctcattttctgatgttgagaactgccttttcatgctctctctcacaatttaaggcatatattgataatgacagagaaacaactactctctgtatttgacttgaagcacaggatgaaattttaagtcaccctacatacttgccttgagaacatctaacctacctgagatttaccgttagggtctttttcctttggtattttcagatgcacaactgccactgtgaaggatcaccgtctagaaccatccactctaccacaggtgtgaatttcctcactctgcttaaactctgaggatgggcgagtgctaagaatggagtaaaacacccaaaagagtagaaaggggcaattaacacttccaaaagtgtctcgaggaggatacccacaagagtggaaggaactgctcgaataatttaccactttgcagaggggctgatggattttggcatttttctgtttagcaatttttctctcaaccgctatggtctaagtcctgttccagaccttaatggtcatcaatctcaagcgactgcagcagtctctcaggcaattttcctatttttagaatttccattcccatctgtttatgcagctagaatgtccatgactatcatttaaattctgtcattttctttttctgttcagaaaccaacccatatttttccttgcctactttcaagaatgttgccactgtctctgcaagaactcccctttctagtaactcctgccatgccccccatccagccaagccagccctcttgtgcccccctctctaggtggatctctggattcgatctctgggcttccacatgacaccccctcctccaaagcctgccaccctgtaccctaatacatgcctctcttgcagtaaaccttcccaaatgtcccccagaagcctcacctcaattgcttggatgatctctcagcatttgtaaaccactcatgattcattattcagggtaagttaatatgtttatttgtggtcttgtgcactttttattttcgtaggatctctctggaactggtaggaacttgacgacagagaccttgccttctacctccttttatgccccagggcactaaatgtcaggatctgcatacaagaatcactcaataaatattgactgagtgtcgctgatggaccatttgtcaaatcgcagagttccctttggaattgctgtgattctcttgatactctcccccagagctgggtaaatgctgctatgtgtaataaatggttcttctgctttcctcttcctgaacccctgcttatcccacgcgtagacagacgaaagacttgctactcaaatgacgaaccgtgttccaccatcattggcttcccctgatggctcatgaaaaatgcagggtcgcaggcacacaccctgcctaatgaaccggtgtttgtgttttcccattatcccagcaaatgactttatgttactcaaagcttgagaagcactggtttaaggggaggggtttccttcttgggacaatcctgttctacgcagttgagatgttgatggcctgcagctacttcccttagtattcctaggtgtagcgacttcaaactgaaaactctgcgcctggtgatttttaagctgagtaaacatatgtttgctaaataaaacacttatagatcatgaagtttcatccatgtagttttctatcactaacaacctgtacctttgttaaatgtagtgatcatagaatcagtacttataaaccaattaaatcaacaaatagtttttcatagctactctctgcattacattgtattgtgtgttataatactaaaataagtatttaatacaactttcctgccatcaaagtgctagtaacccattggtttatttttccatttttttctcgatatattaataattattttttaatttgctaaacacatgactagaagttatgtgattatttggtatttatcctactggaaaaaatctcactgcttgactgtaaacctagcaaaactcctccgatatctcacagttgcaacttccaggtcaagactgtactctgaaacaaaataacacatctctaaagtgacaaccaacttgtcaataaactttaattctgaaggtaaaattatcaaggaagcccatatccgggatcaatttaccaatgatctctctctctctcttactgtctgtaatggtttcctacccattttcatcttttctaaccttctaatgtatagctatagatatatatctatcatgtatagctatagatatatatctatctatcatgtatagctataaatacatatctatcatatatagctatagatacatatctatcatgtatagctatagatatatatctatcatgtacagctatagatatatatctatcatgtacagctatagatatctatcatgtacagctatagatatctatcatgtacagctatagatacctatcatgtacagctatagatacctatcatgtacagatatagatacctatcatgtacagatatagatatatatctatcatgtacacatatagatatatatctatcatgtacagatatatatatcatgtacagatatatatatctatcatgtacagatatagatatctatcatgtagatatagatatatatctatcatgtatatagatatatatcatgtatagatatagatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatgtatagatatagatatatatctatcatagatatagatatatatctatcatgtatagatatagatatatatctatcaagtacagctatagatatctatcatgtacagctatagatacctatcatgtacagctatagatacctatcatgtacagatatagatatatacctatcatgtacagatatagatatatatctatcatgtacagatatagatatatatctatcatgtacagatatagatatatatctatcatgtacagatatatatatcatgtacagatatagatatctatcatgtacagatatagatatctatcatgtacagatatagatatctatcatgtacagatatagatatatatctatcatgtatatagatatatatcatgtatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatagatatagatatatatctatcatgtatagatatagatatatatctatcatgtatagatatatctatcatgtatagatatagatatctatcatgtatagatatagatatatatctatcatgtatagatatagatatctatcatgtatatatatatctatcatgtatagatatagatatatatctatcatgtatagatatatatatctatcgtgtatagatatagatatctatcatgtatatagatatctatctatcatgtatagatatagatatatatatctatatatctatatctaagatatatatctatatccatacatgatagatatatatctatatctaagatataatatatagatatatatctataatgtatagatgtatagatatatatcttctaatgtatagatatagatatatatccacctatatatctatatgtatacattggaaggttagaaaagatgagaatgggtaggaaacaattctatatgtcaccttgttataggtggttgcaattatacaaaatattctgatcatcatattcttgaaattccattcacttcattttcatggtatcaacataagagataagcttaaagctaggcaattgtcaacatttcattctattgtttctacaaaaatggaaattcctcacggttctgcctaacaactcattatagcctaatgaagattttggttaatatgtaatgaagatgaagtataattaaataattccccacagctaaaaagttaatgtaatatttaataatgttgttaattatataaatttaaaaatatatcagcacatacgtggtagggcaatgtatcacttattaagatggacttctcctttaatgggtgaacatttaaaacataagtaaataatgaagtatactaataaaatacagtcaacataataattgaatttcaaagtctattcaacttgaaatgtcaaagaacttcaatctgaaatatcaaagaacttcaaccatctctattttcaaactcaagtggctataaagtagtttttaaaattgaggtaaaatatacttccaggaaacgcacatgtctttgttatataattcaatgattgttgacaaactgttcactgtcacaagtagagcccacaccccggatgcaggcataaaacattttcatcaatatggaaatttcatttttcctcttacattcagtttccatcccttccctccacaggcaacttttctggttttattaccataaattcattacatctgatctttaactttatataaatggaattatatattaggcaagctctcttaaatttggattctgtctcacaatataatattttcaagattcacaaatgttttatgtttcagcaagtcacactttttattgttgggtagtgttcttttatacaaatatgttataatttatctctccaattaatggacttttggattgtttcaccttttggctaatacaaacaaagctgctatacatattcttatacaaaatattttgtggacacgtattttcattaaacgtgataaaacagaaaattcctaggttattaggtaggtatatgtctgacttcatataaaagcactaacgattgttctaaggtgattgtaccattttatattcccacagtaagtgagcatgcaagttgttacgcatccctgtcaacatttgatattgtcaagttttgtaattttagctgttctcataactatttactggcatctcattgcggtttcaacgtgcatttccttgaagattattgatgttgataaacttttcaggtgcttttttgaccatttttatttcttcttaataatccattgaagtattgtgatgattgaagtcttagtgggttttttattatttatttagaggaattcagtatataaatatgtttagtgcatcatatgtagtcttttattagataaaacaatttttaacattttccgctacagagttcatttctgtatgaaatgagctgtagctttcctttttattttcataatggtactttttaataatatcttatttatcaatgttatttcctcttaggattagtgcttcgtctatcttaagacaactcagtatatctgatggcagtaagtcactctcttacattagcctctagttttttaattgggtctcttatatgcccaagtgtgagtgtgaggtaagagtgcagtttcactgatatactcattttgatttcaggaaccacttgattcatatcttgtggatatactgcagaaggtcaaaaggtgagaaagaagaggaaagacagcaaagatcatatgaaaacacttttccagagttttgagaggtgattgcaatgaaaaggcaattataaataaaatattaactttgcttccatgaagccagtactcatgctatataaaaaatacatacatttattcaagaagatgcatttacacacatataagtgtatatacacatgtacaaacataactgtatgtatacatatacaaaaatgtcactatagatcagtatttagaaattttttttactatgtttgtatttaattatgggacatctgtttataaattcgtgttggttgaaatttagtaaaatgttgtattttcctactctttcctattttcctttgttcatacagacatagtcaagtttataggtgcaaaagaagaaatgtggagtcaagctaaacatatcatatatataaaaactctttagtagatccatttatatatatgggtgaataataaatatgccatataaatgtaatataatactttttcagatctgaaaaagttaacaatctttgtatagtatgcttaaataattagaacatgaaaaacttccaaatgccattttttattatcctcaatttgctacatagtttaatagttttatttaacacttcaataaaaagttttataatgtatttatttgactatcataagaaaaagaggaatagcacataacttacctttcacaactgattctacagttttttttctttgatcacagcatttttttttatactttaagttctagggtacatgtgcacaatgtgcaggtttgttacatatgtacacatgtgccatgctggtgtgctgcacccattaactcgtcaattgcattaggtatatctcctaatgctatccctcccccctccccccaccccacgacaggccttagtgtgtgatgttccccttcttgtgtccaagtgttctcactgttcagttcccacctataagtgagacatggatttgaagaagtaaagcatacatgtaacattaggtaaaatggatgatctaaaatatgtgactaataaaaccttatcatttgaaactgaatacatcaacttttcattggtacagtaaagaaagaccccatttggcttgtacttgtagcattgcagaaaacaagttatgtatttgaggcaaattttgcttccttatctgacagttaagtctgccagctgaacgtttgacattctgtgcattgttttataataagctgtacaaaactttactcactgctaaatccaattttcatatctatgaaattctatagtgaatattacaaatctctaatctaaatggacatgaggctaggttttggaagatcacagtcctgaatttaagctacattgctgacttgctatataattgaaaaattaatgcaactttcctgtttctcaaatatccttatcaataatggaataatgaaaatgtctggggtataagcatttcactctgaagtccactatttgtgtaaccttgtaaaatcacttgacttttgaacctcaattcttttgtcactgaaatatggagaaaaacatttgcagttgatgctacaggctttgtgctaagatccactgaagtatatggcgctatttatattgtgtatgagttgtttccatgtggaaaaagaacaaaaatcagtggctagacatgaaaattcagcagagagcagaactttcaacaaacttattgatgatgatacagtcatcctttattggaataacattatatattgggaatacaagaagtttaatgccatgagaagttatactgggcaaatcacataccttaattttataatatgtcaaaatattattgttccggaagtgttttgagaaacaaatgagcttacacaatgaatttaatgcaattattgacacctgtgaagtgcttgagaaatagtataaattctacaaaaagtgctgggacaactggatatccacatgcaaaaatgcatttggatccctacctcacaccatacagaaaaattatctcaaaggagatcatagaggtatgcaatggcttggatatggttgtctccaccaaaaccaatgttgaaacttgatctccaatgtgtcagtgttgggcctagaagaggtatttgggttatgcagacagaaccctcatgaacggcttggtgatattctcgtgggagtgagtgagttcttgttctgacaaggtaagaacagttcttgaaggaaaagattagttttgttgaggtagtttgtttttaagcaaattccctcctcatgtttggctgtattttgtacgtgcccacttcccctttgaccttcttcatcatgttttgacacagcacaaaagccctcaccagagactggtgccatgcttctgctatggcccccaacaaccatgagtgaaataaacctctttctttataatttatccagccccaaatattccttttatcacaacacaaaacagactaagacaatttaaatttcatagctaaaatcataaaaatatttgaaaaaagcaaaagagtaaatctttataaccgtggttgaggccatgcttcccttgatatgatacaaaaagcacaaggaattaaagaagacggaaaggttaaattttaccgacattaaaaatttttctgctgcaaaggataccaccaagaaaagatagtccacataatgagagaaaatatttgcaaatactacatccaaaacggtctaataaccagaatatatagagagaacttacaagtcaacaacaaccacaaaaaccctaacaattaaaaattgggaaaaagatttaaatagacatttctccaaagaagacatacaaatggccaataagcccatgaaaagatgctaaagatcattagtcatttaagaaattaaatttaaaaccacagtgagaaaagccacaatgagataccatttcatacccactagaagggctatcactggacagatgataataggcactggcaaggatgtagagaattggaaccctctcgtgttgcttgtcggaaagtaaaatgttagagatatgctggaagacagttttgcaattcctcaaatggttaaaattactgttaccctgtgagtaaagaattccactcctagtttttctacccaagaaaactgaaaacatatagtaacacaaaaactagtgggcaaatattcatggcagcatcattcataatatccaaaatatggaaacaattcaagcattcaccaactgatgactctggacaaactaatatagcatacacattcagtagcattttacgggtcattaaaaatcaacaaagtactaaggtatgttggaatactgagggaccagaatcattaaagtaagtcaatgaaaaatcacaaaacaccacatattatgagatctcatataatacccaatgcctagggtatagggtggggagtcagggtagaacagaaaatgactgataataggtacagaacattttttaggggtgatgaaaatattctaaaatcggattgtgatgactgcacgatgatgtaagcatacaaaaattcatggaattgcacactttatgtggataaacttaaggatatgtaaattttatcttaataacattgttttaaaaaggtaaaataaaaatatcctcagatactgcagcattcaaaaaataattactatgacaataaagaaagacattaaagaagggcttatcacaccttgtaaattcttaaaaatatacatgatagaggcataaaatgagtttggaacatctacatggatgagatttctgctatttttccactttaaaatactattgccatttattatagtaattcctattatgttatacatctgtatatgtgtgcatgtgcttatagagatatttaattgaaagggacaatgttgcatcattttcaaacaaacactattattctttagacatttttttcttattaaatttgtcagcctgatacataagtatcaacttcattcatgtgaaattgatgtgaggtcactttctaagctcagtgggaaatacatttagcagaataattttgccacctacttagttaaggggagaaatacaggcttattgcaggatgtaattcaccaactgtttatataattttaagcctttagtaataaagcaatcatgagcttgtcactttacttctctactcatgacacttcaaaacgcaataaaatatagtgcttgacaattttaatttattttaattaaaagacatcccaaaagcgtgatgcaaatgcttgaaaatttaaagcttagctccctttgctttaactaaagaaatgttcgattcgtttctccatcaagtgaagggcacttttaagcatccgcactggcccttagatgatgtggtctttaaaaagaatagtttgatttgacaaaggaaaacaggaattttgaaagaacctacaaaagaaagacttgaaaataatcagccaaaaatgttcatgatcatgttgtagggtgaaatatttattatttccttttgtaatgataagaacaatgaaatccagaaaaaaatgcggaagatgaataaagtggtggcaacagccttttggtctatctctatcaaaatgcagtgttctctccatcatgctgtctctttgaaggacttcattctaagtactcatgttctaatcatgctgaaagcaatataaaatcattcatttgttcagaaataatttttgagtgatgacttgtgtgccaacccccattctgactgcttggcataaagtcaggaacacgggttctcattgcataaagttgacggtttagcagcagctgggtagggagatactgctatacacaaatacttcaatagacaagacaagacaagacttgaatggtaagctgatcactgaacccacgctggagaggaaacaggtagtgtaggtagagcttgtggtcaaggagattactcaaaggagaaaatattaaaccccaagttattactgcttcagaggctgaataacaagaagagcccatgcacagaaaacccaggggctgggcccaggacagaggtacgcaggagcccacaggtgggaaaggctcagatggttcatgaaggagaacaaagaccagtgtgtctgcagtggactcagaacatttgagcctggaaggagaggagggttcatagaggccagagtggcaccacgcagagatttgttggtcagaattaggagtttggattttattcaacttcagattggaagccagtgacgaatcttgattagggtcctgaagtaatttgagtaacatttggaaaatatctttctgcctactatgtggagaatggaccactgtagacaccttaataaacatggcaaagaggtgtgaagctactgaggagaggaatttgacttgagtgacaatagcagacaaggagagaaggttaagagacaaagtttctctttttttctttttttgaggtggagtcttgctctgtcgcccaggctggagtgcaatggcgtgatctcggctcactgcaacctccacctcctgagttcaagcgattcttcttcctcagcctctgagtagctgcgattacagacgtgcaccaccacatccagctattttttttgttatatttttagtagagacagggtttcaccatgttggccaggctggtctcgaactcccgaccccaggtgatctgcccacctcagcctccagaagtgttgggattacaagtgtgagccactacaccaagcctagagacaaaattttaaacgtcaattcaaaacatttaacttgcaggtgcagaatactaaaataaataattttttttgtgctgagaccagttgaaactctaatgcgtcttaaaagaagcagtatcaaaaatacccagtgtgaattaaccggacacaaataaaaaatacattaattaaattttgttccagaaaatgaaaaatactatttttctaaattgacatgacttactataatggactatggaataatggatttgatcactttattaattttaatagctataaaacatttacgcatcatgttgctataaatgagattagcaaaatgcagtcacaggtccaattttttcttttatgcatattttgtagtatctttttcatttaaaaaatcactttacgataaaatgcacacataattcaaaatagaagtgaaagaaaaattaagagaaatgtgagtaggaagaaaaatgtaaacacatatatttgtgtatgatatttgcttcaactgatcatgaaattagcctttaattttacagtagctgagaaagaaaatatgtttggtaatctaattattcatatctaataattgagtacaacacatcataaagaaagggtaggttttctttcctgttacatgattataaaaaagtagcatggattagtgaaaaatgactactttagagtttcaggttagtagcacagtaatgaatgacttctccacctctgtggccagagaagcaattgttcgttccactttcacagttcacttcttctggtcttgaagaggcctggttggtcatattcacactggaatataacaccacttaggcacagagaattagaataacagatactacgggaaccccactgttatgaatgggaaggggtctagaattgcctcagattccactaggacagcagcatcccattcaaagagaccacaatattccccaggactacaacatgacaagggaaggagtcagtttcctgcgggacaccagcatcacaagggaaccaaccaccatttctcctagggcatcagcatcgcagaggaaggagccacagattccaccaggacaccagcctcaaaggcaagaagctacaactttttccaggataccagaattacaaagagaggagccacaagttacccctaaaaccctgtaatcacaaggaaagaagtggtcacctctcagcagctctgagtggagcagaaatgatctactccctccctctttctgacctccactctgattcctgaccatgttcagggatgactctgagtcctggaacactttcatctgcagtggaaaagattttttgtttgtttgcaagaaacaggtgaaacctttctgaatcagttttccagctaagagttatacctgtagaaaggatattaccttggtggggagtaaaatgaaggcaagttgggtatttgattgtactactgtaccattgtgtttcattctttcctatctttcttctttttttaattcgagaatcttacttgtttgtgatactctttgagtccgtcccctaccccagtctttgtgagtcatctcattcactctgtgcagaattaccattcaagccttttcaacttcctttatgacaaaaatttcatgcctcagtttcccagatttctattctggggcaaaccaaacacttcttgtagtggacatgctcaccagaaagcactgacacacctgctcttgaaaggctccttcttcttccgtcttcagattctaggcaagacttttgctcaggcaaactgggggagacctggagcagcttcattgcacattaacttcttcaatggattttaatttataattggacaaaaattgttggtttagtggtctccaatatgccttttagttgtagtatttatgaaagcatcaaaacagcacagttctgcctgacacaacccatcatataagataccttgggtcgtccattcaaacgcagagtgctttggatttttcttcctctcagattatggagtacatgcaggttgttttcacagtaggatggaaggcctagttttcattctgtctatcgtaatgatggccttaattctttgggtaattaatagattctttacaaccaagtatatagaaatgaaaataataaccaatatgcccctgaagcctgtgggacacaaaagcgtgtgtgaagccctcaagcatcctgatacggccatggcctgaataatgaaggcaatttgaagctatcagcttctataactgagtctccaaaagaaccaacacagagccacggtgctctgtgctttgaggcatattcactcactacctacacgcacacttatcatagaaatgtaaactcctgcagagcttcttcccagagtagtaggaacaacatcaataatcaatgtaagtcagcttcatatgtgcatcagacaatgcgttgagcacttgaataatcttatcaaatcttcaaaacaatctaatgagaggtaatatttccattttaggtatggaaaaacaaatttaacaatgaagacaagtaatgcaaaatgttagttgttttagctactaaatactaggtgcagcatagttcagaactaccttttctaaccatttggtctagctagcagacacaatgtaatctagtaaccaattaacagtagttagagacttaatataatttaatccagtagtagtgaggtacttattctaattgtcagataggatttaatccaactgcttaatctgatgatttattctagctactaggtgccagataaaactggctagagggctagaaatattgtaacccaggcagtctgactcacaagtctggtagcttaattattactatccatggcttcccccacgcactgggggaaggttaaattgactttaatagggcacatttcctaaagaaaagtttaaccttgatccacagcctttaattttctcttgtgaccttctaaaatggaaattttcatgaagaagccaggacattgataaacctatatttaatgccatagtaatttccattctttgatcaacagaaacttaagcaacctataccgcatgccagcaaaataaaatacagtatctggttttgtacttgacaaagagaaaagtaatagaaagtgattaatctgggaatattcccaagccctttatagaaattcaatactgtattcagcagaggatgttttctctgattttttttatatgtgtaatgaaaggcaaagatcactgagccagaaatgtcaagttatctttgaaacatgaatgcagcattaccagggcagagcttcaacagatactaatgatatgttaattagttaattgcacattttaataacagacttacaaagccacaatttctttgtgtttaaataacataattgtgtttcagttgtgttttcagtaaacactgggaagttttcattcacctacacatctctatataattaagttttggcttttcttccttgagctataagggatcctaatgtctttattacacaggaatcatctttagtcatctatttttagttctctctctgagatatctagattgtcattcaggcagatgcacagaccctcactgagatcctagcacatttacaaatggaatgactgtgctcccttggggtaatgctaagtacaaaagcaatccccttcttgccaagtaatcacatagaaaaaataaattgtaatttttgaggctaggtggcttgcataacttgtcaaacaagacatgcagccctattcctgtgtcatttaaatgctttaaagtcgtctcattcttgagctctatttttaaattgccttttctacagaagttacagcagtggctgaagaaaatggtttgattatagaagacctgttcaccctcagccacgtcactcaggaatgcatctctgtgaaatcatctataatctctatgaaattaaaaaaatgtaacctattaaaattgtttttgcaaaaacatctgtgatctaaaatatactaagagatatactacaaaattcactaagtagtcacatttactaaggaatataaagatttttttcattgttgttctttttatattaatgggagcctctcttctctaaagacaaatttctggaaatgtttgggtcttggtatattcaaaggactgactgtgataatgacaaccgtggtaaaaagtaagttttactactcaaccaaaactcattggaatgagtcttcaaaagctgtgtttctctctttatacttttcagtaatatgttttctgccttatgaagaaagactaagagcatgctaccgtggtgaatttacatgcaaagtctgtctctctttatgatatggggagaatcctcatgtttgaaaataattgcacactgctgtcactattatcaaatactattgcatcagagatagttcctgagcccaagggacttaggtcttgtttgtaggatatttctgaggtttggcactctagaagttcccacttgcgtaaactttcaactctctctctttcctagcatagccttgcaagaacacgagttagctttaggtagtttgtctcggaattggaaaatttcaaggggcatttggcagtagagcaaggctatttatttccaaaggaaagcgcagcccttaggtctcaatgagaattctgaagtcatatcagggattttaaacttctagtcaggcaagcctcaattccgtgttagtgctatgtagaggggtcgtttgcaagaagagccaaggcactggttaaacaggtttgagtcaacatgacatggatgattcaaggatgctggaaggcatgaagagatacacttagctttccaacagcccctggggaatcacgcagcttctatcatatatgacaacctgccaccgggcacatgctctgccctctattgggaatatcttcctctttccccttccagcccccacagacctcattcttactgtcctttactaatataacttctcacccatcaggtctccagttaagtttcacttcatctaaaaagacttctgaccagctgggtcaggtcagctccctttgccatatcacaacacaatgcacctttcattgaaagttcttgttcacgatttttatcgataaatatttgtttacgcacttgtttatcactgttctactcactaggctctgtttcagagaattagggactgtaaacctttgtttccttctccatcaaaagtgattagtacaaactacctggttcctggggatagttcatactgggctgcgtgatccttcagtttccttttaattgggtcatcccagaaattagtgggttctcaaacattgccatgcatcggattcactgggagagcttgtgaaagtgtagatagttggccccacctgcagagtgtctaattcagtctgtctctggtggcggctaagaattctcattctaacatcaggtgatgctgatgctgctaatctgggaaccacacttccagagacactgccacgaatctataggtcttcaaggaaggttttcctaagaggggagttgagacaacaggaaagtattagaatggggggttctatgtcattaggagaaaatgcactgttcacatactgaaaacgcaagaatgcagacctctagaaaaactggtgagaacgtcaatatcacccgttacgtacctttgcctttctcccatctttaatctaatcctcatttacttcatatacaaccaacatttacttactcaagggccttccaacttctttgctgcaggccaaaatagacaccagctctgactgccacatgcaaaattaattgctgccatgtctgtagtcctctgtcacacctacatatttttattatcatgcttgtcacatttaaatgtttattcagctgtctttctgccttggtttgccaagagtgctcccaggccccaactgactatcatagtgccaggcatatagcaggtgctccatacatgtccaatgagtcaggacagtctagtctttgacagtatagagaagttttcatagagatttcaaaaggaatgctggtacttccatgtattcctgatgtttcacaggacgaagacaagacaaaacccaaacaaccagagccactgggaaagaaatagtgcttctcagtcacaaaaatcaaaatgggatttgggaaatatggtgacccttcagggagagctaagtccaagtgttttcttgttaagaagggatcgaagggagcacgggaggacctgggcacactgcagactctgaggcagcctttgggacctggggctggtcatggaagaggtcagaatgggatgcctccttggtgtggtctgtaatcaaccgagggtcagtctacaagggttagaaggaggcttctccgacagttctcccttgtcactggtgactcattattgggggactggagtctttagtttataaaactttgagaaagtagcttttctgggatagaatagaaggaaatggtttatctcttgtaaaacattgaatttgttatgaaaaagccttggttcaattcctggctttggcaatgatcatggtgttgcatcactgggtccggcacatcatcaggctgacctcactctttgtaacacaaaattcaaagatggggccattgatctttaggctcctgttcagctttaaacgcaggcattttcaccctgagatgttgagaaaagtgcttcctcattcagccctttatctttgaaatggggataataacgtttgttctttattaatataagtacaagtactttaaagctatgaattaacactgttccatccgtttgatcactccgtcttactggcaggggatgaatcttgaattctaaagagctgtttttcctgagatcgtgataaaggtagttctaaggtgactcctctgtgtgtacctatgtccataactcctctatgatattaaatatccaacaggactgtgagatctgaattctttttctattcgaattattttttaagggagaagggcaatctgtgagtatgaaacacccaagttaattatgaaacttagagagcaattaccagagataagtttatgagcacggaaaactgctaacctgctataaccttcacactgtaccttaattatggacaattatggttttaaacttcagcctttacctgtgattcttacttgttctgatctatagaccatgtagtaaggcatttgcttcatgttcgacttactgggagtgggcatggattttatctagaatagacatttggtttttcccaaccgagtgcctgttgagagttttagcagagttgttccctggtgttccttgacaatgtgttcttttctctgcacgcctgaccacatcctcggtcaaggccatcatgggacaaccacaggcacacactccttcagaacccaggaccaggctcaagtcaggccattccttgccaccatctatgccaggaatcaatattcaatactagatggatgtttgtttttgtaggaaaattgtgaaagcggatttcacaatgcggcggagaaagggaacctccatggacaatagctgagtgagagatgaggagaatcagtgctatgtctacactgcttcagcaactttaagggtgttcatctccattagccaacacatttttgtcttacttaagccactatgtgttgtgtttttgctcatttgaagcctacaaagtcttaacaaagcacatatagataaaagtcctggaaaggcttttgtttgtttttgtttgcttcagtgtttttctgagatgcttacaacctaattcaaaccatttactaatcttcttatgcttagtgagaaaaaaaaaattccataaagcatttcacgatttcatcagtcactggggtaatgaataaaaagctacacaataatttccttaaacgggtgtccatatttgtattcatattcacatgacaattctgtaagtctaagcagtgagttgtttaataaaagagaccacatacaaacaatatatcgtttgtactcaaaagatacaggaaagggaacttcacaaaataaataaaataataatgcattgtttttggtggggactctaatctcacagggtccttttctgagctttgcctctcaatgagtcatgtgaatgacaatttgtcctcagcctctataccaggtagtgagatacttaaatgcagggaaattaaggactgttgacacctagatattaattaaagtgctcacaatgatgtggctagattaaaataagacacgatccccttgaaatggtccatgttcttttcacaacactgaaaaacagtttgtggggaagagttcaaaagctaagctgaaattcaactatcctcggagaccttgcttatgaggaaataaatacttacgctataaagggccaaaatggaaaatacattgactgacaaatctgtatcctagccacagtaaagaggaattaaggaagagattgcaacgcatgcaaatgacaacatgagctgtttgtttcctcagtagactccacaaacaccacatctccccaagtcttgcctattttaattaaccaagggtcaatgtatagtagctattgaattaactgtctttcctttgaggttgctaggagttttgaaacatttatttcatcacatcctgaattggccaacgaggaccagtttaatgacatgccagctctttcgtggctgtgataatgtgttttgtcctctttgataacgtcaggtatctatcatggtaaagggaacaggcagtgcaatttcttgggaggaaatctggaattaactcttagattacttaatggtatattgtgacagcatttaaaaattgagtgttgtataaaggctggtataccaagaaaattctattttaagctagtttttttttttttttttttaactagatgaagactttcacatatgttcccactggcattgtaacacaattacatttcaaagaaattcatgacataattttacttcagtcaggtatccttgctaataaaaaagagggtgaaattgtcctgtcatcattaagatagcaatcaaattgctatccatgcaaatacatttaattgtataacctttaatatctgctaagatatcatatgatctgttatactgcaagtaaatttgattttgcaatgatgtgaagtaaataaacagtctaggagatttaaggaggtgatattttccctaggggcctgtaaaagaactattttaattaagtctataagcatggtatttagtaatgtcgtatcttttggacttttatgtgcattaaaagaagggctggcgtgaatatgaagactgatccatctactctaatataacacaacgtaggagtctataacacaatttaacaagaattttaagatattttaaaaagaaattcttcaaactgcctttatgcaataatgaacatattatgttaattatacaaaattatttaagtggcttaaaagccctgtactttccaatattcaactattcactcctcctataccaaatggtccatggtccatttctggaggtatgagggatcaagaagcaacagaaaatgatctcactctattaatgtcttctgttactgaaaaacttaaagtatgtcttcttgaaagcttcgaagtttatgttttctatcagacaagagaaaaagaagagaaagtgatcgcttttcctttttgctactcttcttacttgttaagtctgttgcttctggagtcttttctgagaaatgtaagaccctgaaatatgtgattcttacctaagtaaaaggagaaccgttcaacagattaatgcaacagattaaaaactgtctttaaaataaagctgatgcttattattctgcaaaatgtgtttcaaattccctgaaggaagagcttgagatcagaacccatgttctttgcaataacgtaccagctcagccccagattctggtacccccagcgtggaagtcaagatgcaaactgcaagacactttcaacatgtttcccagctcatcagctcgtctgcattctgaatagaaatgcgatcttgcttatacttagttctgaaattctgtatctgaatcttgagtcatttgttctttctactcagttcctgcaaaccagagccagttatctgaccaaggacatctttgactctagatggctttacctcttatacattatactatatcagggagtaaacttaaaaacaaacacctgtcatctctagagcatgacagaattgtcatgaaataatgatttgcacactccatagctttcaactgtggccgaattcatcctcccttccgtgacgccatttggcactacctggagacgcctgtggttgtgatatcagggtggataccacttgcacctagtggtaaggccatgggtgctgctggacatcccacagcacacagaacggcctcccaaacaaagagctatccaacctcaaatgtgaatagtgctgagatggagacattagcttagccctctggtgatcgctgattctgaagtagaaatcttaacttaggtatgaatccacaacttgcatttccaatggactattctgccacgattttctatttattcgtcacggtgtgattatttcaagccaactccagtaccatgaagaagcggactccttcatactagacacacccacttgtgttaattatttaaagtcatggtgaaaataaatgactttaaaaaccgacactctcattacttctgaagtcagccatcccaaaaaaatgatctttgaaagacaatcatctgcataataattactaaattacaatagttacatagagactaaactaagcaatggtagaagaggcacatgaagatgtttgggaaaaagattaaatgtcccctgatatttgagctgtacattttttcagaaaataattagacatgggatattttgcttagtatttctcccagatatagggtgagaagctgttaagtttctatagtcccaggtcaacatagtttctttctttgctctccttttatgggaacatagagtacccatatgatttgggtaaagtgtctgaggatgtgtcattgataacagaagaaagaataaccaatggtgttgagtattagttcacttctgaacaaatcatgcattttcggaacacatcaggagttagagaactgtgttaaaacttacagatgaaattaaatctggaatgaattgagattaattatattgatagtataatacactgacagatattgtgccagtccctcaggtttctgtgtaaatataaaagttaaactcaaaaatatgtgtaagactatgtttaaacaagatatcaaacaaaataaaagaaaaaactgtgcttttgaaaaaatactgctttgaaattacataaaaattaatatgacttaaaaatgtctatcactgctagactttctttttttttttttttaacaaataaacaacctagacaatatcctcccagtctcttatcaatgatggtgactttttcatactctgaattctttggacttggagattctcatgtacataacatggaaagtcataaaaccacattgttcatttgatctatagtagtgagctagtgaacgggcctagaaagtctaaattctagcctttgaatcccagcatgtggcagagaaactagagccagtgatgctccagacttgttacactaaattatcatcaagagtaaatagaaagaggaaaaagaacaaataattcactggactagaaatctcatttattcctccaataggtttacttgatgaaagcattacaacatcaaacttaaaaatggcagtaagatattgtctgtgttattaggtccccgtgggttggttctgatgatgacaatacttgccttcctgacaaacctgccttcacctttaggtctctatctcattaacacaacaatcgcaggctcagtctcaaagaaaacaagattggataaaaaccttccctctgtgctctctgcatctgggagaatcacgacttttcagacagaagggcacgtgttatattcgatcctggttacggtgcattcattttctccacattaaactagccagttgttcctcattctctgcagtttcccttgctgtgttttcagctacccacagtcaaccactgtcagaaaataagtgagcacagcaggaaaagatattctgagagcaagatggagaagcagaccacattcacataacttttattattgtatatagttatcattgttctattccgttagtagctgttatgaatctctcgctgtgcctaatttataaattaaacttcctcatagatgtttatgtatagttaataagtacaaatatacaggttaatggaagaaacaagacctagtatttaatagattagtagggtgactgcagttcacaataatgtaccaaacagaagagaataatttggatgtttctaacataaaggaaaaacaaatatttaagatggatatctcaattacactgattttacctttacaaatcatgggaatgtatttaattatgaccagaaccttgaaaatatgcatacctaatgtgtgtcaataatttttttaaaatatggtatactgtatatagggtttggtactatttgtggtttcaggtgtctactaggggtttggaacatatttctcaggggtaagggggcactatatatttcactttccacacctcataaattctatatggtcctccctattctactattctaggcagcgaatcaagagaaagataaaccaacaaataaatgattaaacaggttcgaacaatgcttctcattgtgttgtaaagaaaaaacaattttaggagatgacaagagagaaagaaacagggtgaaggaagataatctgttgagatgaggtctctgggaaagagaaatgaagatcttatagagagagctcttcatgatgaagggacatgtgttcctcgagtagaaagagacgacccctccccctccccaatgaaaatggtcaattgtccactctggaaaggatctccaaatccaaagtggtcatatcttcttcttcttttttttttttttttttttttttttttttttttttttttttttttgagatggagtctcgctgtgtcacccaggctggagtacagtggcgggatcttggctcactgcaacgtcctcctaccaggttcaagttattcttctgcctcaacctcccaagtagctgggactataggcgtgcgccaacattcccagctcatttttgtgtttttagtagagacggggtttcacctcgttagcgaggatggtctcaatctcctgaccttgtgatccacccacctcagcctcccaaagcgcagggattgcaggcatgagccactgcgcctggccatcttctttatttagagtcacagaatatttacgggcaatattcatctggcattttaggaaaacactcccatgttaaaaacttaaagctcttctttaatggaactttccacttctctactctcagaaggtatgctgagtttcagaataaagagctaaggagaaataacttccagaaacagaggtcttccaaaagccccaatgcagaccaaagtcaggaatgtttaataagcacgtgcatctggccacaccaagtccagctttcccagagtccagagcatacccttcacggcttcacactaaggacattcttgctaagatgcagattcagccctgttaactaccagacaaaaacctggtattagctaagtggattcttttggtatctttggtatacttacttgtattttaagaaaaagcccatttttactttattttaaaaccttccaaccccaaaccacgactctcgttctattcggcttggagcaggcatggaggtccgggctcagccagcctggcaccatgttattccctgagagcccaggacccaaagagagtttcagctaagggtagtgcctcctctgacactcataggatgccaactgcacactccccacagctgctcctccatgaaaacgcagagcccaccccaagatgcagcccctgggtccgtgcagcacaggtgcttcaccctctctattcagagccacagggtgtagtgggagagaagaacatacacatgttccaaagaaactccctcatgtgagagagctaaaccccttcctaaggtctccaaatgtttactcttggagggaaatctgagtttcagaaaacagcaccaaacaattattaactaattaactcctcatggatcagctatccagtgagctcaatgcatgtgctaaatgctttcttaggcatgagagatacaactgcagattagaccagggtaggcttaccccaagaagacaggagactagccagcatgaagacgtgaaggaggtgcaagaatgagaagtgctagaaaagggagaaacagggtcccatgggtccccacagcaagggatgcccggcatcgtctgatgacagcaatgatgaccttctgaagaaacggcagtcaacaaaggaagggagatggaaaacacaaccagaggaatttgatcaagatagacagatggtgttaaaacacacctggcataaccccaaaacacccgacctacgtccctctttccctttgagtcgctgtttaactactgtgaatgacaagatcccttgcatgatttaacagccttgctcacacttccttcctgcaaacttgaaagcaagaccaccgcacatgcccacactcactcacactcacacccttcttctaaggggtttggtagttgacaaacttcaaaagagaggggaaaagctgacatcaatgatttatcactctcttttgacatccagattgacggtaaaacatttcctgtttgtaggaaaatggcacagcttcatagcttaaggcagagtagagagaaaagtgtaggaggagatgggggaaagatttgctggtctagcaggcggaaaggaatctgacatcagaggatgagtctgcccacagtgaaactcaatgtctcccaggctaacactatggacaaccctctttgggctgtgtagtcaaacacctctgcttcatacctttcagttataaggaacttctcacctcatgaataagtcacaggaagctatgaagagatgagagagtgacaggtaggagattcatgtcatttcattttatcattatagctaccctctttgttttgctccagaaagtcaagtttacattaatattttatcaacaaggtaaagaaagttggaagctagaagtgcttccaacttcaccttcaatcgtcggtggcactgctctttctattctccaagaatgctggagctcaaaagcgaaggtgatttctacacacacacacacacacacacacacacgtatgtatataaacgccaacatgcgtaacatatatatgctgagacaggatctcactttgttgcccaggctggagtacagtggagcaatcatgactcactgcggccttggcctactgggggtcttaggtgatcctccaatctcagcctcctggggaactgggaccacaggcacatgtggtaccatgatcagctaatttttaaaaattatatagagatgtaagcaatccttttgcctggcctcccaaagtactgagattacaggcgtgacccatcgcacctggcctgaaagtgattttgcaaggggtaaactaaatcaagcagggatccagagtgctataatagaggcagactggacaagacacgccacagcttcgcctctcccttgaataattcatcgtttcccgaattgctgtccccagacttgaatcccttcagcgtactttccacttgaacatcacagtcatcttcacagatagaaaaatctcattcgagtacatttccacttaagacgctcagtgattctgcattttcttcagggacagatgcactgcttgaatgcagtatgatcttgaccctggtcagtttaatttgaatgccttgcacaaagtgctctccaaagtgctgggtgctatatataaaccatgtttgttgaggtcaggggtcagccatatagacacacttcccagaccatgtggcaaatgggaaggtagaaatatgtgtaggatatgtgagctcagaagaggacacagtagtctaagatgaattcctcttagatatatggtgtttgaactgggatatatggtgtttgaactgagtaccaaagaaggactaaaagtgagtcatatacattagcttaggcctacacagggtcaggacaatcaatatcactgtcttccaacttgataccttgtcccactggaagtttgtcagggtcaacagcacacgtgaagctgacatctcctatggtaacaatgcctttttcttccatttgtcgttgttgtgtttttgtttttgttgttgtttgtttgttttgagatggagtcttgctctcttgtccaagttggagcgtagtggcgtaatctcggctcagtgcaaactctgcctcccaggtttgagctattctcttgccttagcctcctgagtagctgggactacaggcatgcgccaccgtgcctggcaaattgttgtattttttgttttgttttagtgatggggtttcgccatgttggccaggctgatctccaattcctgacctcaggtgatctgctgacctcgacctcccaaagtgctgggattataggtcacaatgccttcttcggaatacctccttaaggacctgcctgagggtgttctatcttttttttaattttttgagccggagttttgcttttgctgcccaagctggagtgcaatggtgcaaactcggttcactgcaacctccacatcccgggttcaagcgattctcccgcctcagcctccccagtagctgggattacaggtgtgtgccaccacacctggttacttttttgtatttttagtagaaatggagtttcaccatgtaagccaggctggtctcgaactcctgacctcaggtgatccacccgcctcggcctcccaaactgtggggattacaggtgtgaaccaccgtacccagctctaggttaacttttttaaaagtagaatgagtacacactaaaataacaatcaaaagtataggaaatacattaaccagcaacacagtcattattattctcaagtattatgcactgtacataagtagatgcatgagacccgtctaagactggcagcgcaggtttgcatatggcaccatcaccacacacacgcgcatgtggattatgcattctgctatgacgcataattatatggctacaatgccactaagtgtaggacatttttggctccattaaagtctaccaggagctgggtgcggtggctcacgcctgtaatcccagcactttgaaaggccgaggagggcggatcactgaggtcaagagtacgagaccagcctggccaacacagtgaaaccctgtctctactaataatacaaaaattagccgggcatggtggcacatgcctgtaatcccaactactcaggaggctgaggcaagagaactgcttgaacccaggagcgggaggttgcagtgagttgaaatcgcaccactgcactccagcctgggtgacagagtgagactctgtctcaaaaaaacaaacaagcaaacaaacaaacaaacaaaaagtttaatgggagaaacaaagttagtcatggcaaggaatatgggaaagtcacacggagaaggtaaaaaccatgaactgtgcttccagaagctggatgcgatgaagacaacatggagaggttttcctacatttccaggcccttctctcatgtttcccttcacattctttgctctggttgtaatacaacttctgcatcacagttcctcagaacaccatgcggtctgacatctctgccttttgacctatgctgttaactcttcctgaaatgtcctatgttttgtctccgatttttctggacaattttttttctttaagagcaaagacggaacttctcctttctgagccaacccttgaatcgtttaagcactgctagtcacttcattccttgactagacactctgccatgtgcctgcttccatcacttaacctctggacgcatcccttaaagagacatttacccttgtaagagcttgtgtctagggggaagaacaggtgttttaaatatccctgaaatcttgacatcaagtactttaaaagtcgttgaactgtatctatgaagcaagcagtaaaaaagagtctgaaaccttgggcattttttaggttgaatatctagaaaaagaacaatgccacaaagaacaataggtattcctaactgtaatttcaggatagacaagagctgctaggtactcatgcacagcaaagttaattaatgtcttccccgacaggcaattctttgcttccgcctctatcacttcatgggtttattggtaacttttttctctgggcaccaccttctgtcacccgctacctctacttgctttattacattccgtcttcatttatgtcttctcagcttcacagtcacggcaatgacttcctcctgggcaggtgacaccctaaagtcctttgggttttgtttggcaccaaagtggaaatacaggtttgttgagaataaagagaggatggatagttgatttgtggaacagaactttgggcttattttttttttagtaggcacataaaatgagctatgcatgtggtatttagaatttagtgtgtctaaatgagaaccagagtaactcactgtgcagagctaagtaaagactgtttggtattctatccctgggctaagaaaagttgaatcaacttttttagtatattgcccaggttccctttggttacgaaggctgagtcagctgaaaacataattcggcatcagtagtttatgatttctatggttccggaagagatttcaagaggaataaattacctgggatctcatggccctttcatacaaatgattctcatcccaaaggtataaactgtggcttgtgtcttcatatcttctttatctttaccacatcagagaactcacagtttgcaatattggtgggttattagtttaggtcaaaaataaataaaatagctgagaacttcaaagtaattcagttttgccagataatgtctggaatcgcttcctcctgcaaaccatcttctgggtgcatgtgtaacagggacccagtactctcatttttaatcccggttgcattatttaaaggaaagttaaatactgttagatttcaaggcaagggatgatatttcttatgcaaaatttaggaaaggaagtataaaacgtttgcaatttttatgcaacgaatgtatttttgaaccatttagcttatgcttgaatcaaataacattttgttataaaaataaagtataacttaataaaataaaaaatttacaattataatgcaatggatacatgtttgaaccattcaacttatgcttgaatcaaataacatttttataaaaataatgtataacaataaaaatacaaaatcatttacacgttttatgcaatggatatatgtttgaaccatttaacttacgcttgaatcaaataacctttttaacacaaagtaaacttatatgtttttctctaaaatacttttgtcagtcttggtcagtttaacataaatatgttaaaaatgacttgatcataaagatggtaatttaaaaaatttttaaattaacttaatttaaatacttttctgatcctcagtttcattgtaacgattaaatattcatttttaattctacctttacatctctggtaattttatacaaacagatcaaataatttagttttcaaatagttctgaaacctaataatgtttttgcttccagtctctgtgcctgaatattccctctgcccaaaagtctgatatttcattcttcatcctggtgatttgtagaaaacaaaaatgtcacagtgaaattagtctcctcatgctatgtcggaagaaatatctcattcaccagccgagtcaaacattccaatggaaatatctatagctttggagatgatgactaatttatcctgacagagttgttgatttatctgagaaagaaattccaaaaaaacaaaaaccaaaaaaaaaaaactgctgactctttcacttaattcgatgttaacaaacgggcacaacagcctaggaatactgagaggttgccagatactatgtgcaaagtttgtcaaatgacggcgatttccctcccaaagctcagagtggcaaagctcccaatgggaaagatgaatagacattacaatcctgtgtaacttttcattctgcacctctgtcccctaagtgccgtacctcatacattatccactagccataagcagccacgacacacttaaagcgtgatgagtctgaattaacatgcactgcaagggcaaaatacggaatgcatttctgtgacttcacaggaaaaacatacggtaagatattttattaatgtttttctactgattacatgctgaaatagcatttgttatatattgagttaatgatgtatattaatattaattttacctgtatctttttactccttttaatttggctactagagaattaaaatgagatgtggctcacattggtggctcacaatatattggacagcagagttctaaggtctaaactgatggatgagcaaattgaaaaaaggatttcaataaaatgacacagggtttcaattaaaacctgacacaggctttaataaaatgagaattgtaaagatttcagccctgttaattagcaccataaaaaccgcaacaatgattaatctgattttttaactgttgtttaataataaacacatatttttaaaatttttaaatatgaaatgtggcaggaaatgctagcactttttcatatttagggagacttcgctgtgatgagggcttctaggtatgtgtgctttatttcttcaggccaggcattttcgaggaaaatgatttgaaaggaagcacaggggagatttctcattctctttcccagaagctgtaggtgagggtttagcgtgctgattccctgaaggagtcataaaataagtgaatccaaagtcccatcaagagcccttgagaggccgggtgtggtggctcacgcctgtaatctcagcactttgggagaccgcgacaggtggatcgctggatgtcaggagctcgagaccagcttggccaacatggtgaaaccttgtctgtagtaaaaatacaaaattagccaggggtggtggtaggcacctgtaatcccaggtacttgggaggctgaggcagtagaatcgcttgaacctgggaagtggaagttgcagtgagccaagataaacaaataaacaaaaagcccttgagaagaaaactctgcaatgggatgcaggggcaggttcaggggtgtggggctgagggtggtgtttgattacctagaagagtgggggaagggattaatagaagagtacagttggttcttaggaaataaaagacaacagccaaatgcgactgaggccaagttttactctctaggctcaagagctccctcaaagacatagtagctagctaaggaaaatttccactgaagcaacaaggaggcgattggggccacatgaactgtggaaatgtagaatatattcaggcttagtccagatgatatggaattgaaaggctttaaatcccatttaaatatgaaatagacatatagagacgcattgtacactagggcaagatcagaaaccaaggtatcatgacaaaatcagacatgcaggtaagaattcattttgataaattccaacttaagattaaatgcatcgttttaacttggctttcagcaggatcgtattctttatcactttattcacttgcctttttcaaaggccaacgtgttgtctttcaaatggaggcccacatagacatcttttgtaacacccaagctatacacaactatgcttctgtaacaataaaccggccgtcagcagggaactcacactgcgaatgaatacatcaaagtgacgaggctttgactgagttgaaagccctgtggaggccttcacggtggagctggacacagttgctagaaagatgaagtgatgcatctggtcagcccaggcacgggtcacccaaaaataccacccagggtaatgaaggaggttgagattgtcttaactgggggcttgaaatgagctaaaagaatgtttgggtttgaaaattgcctctgatgcaaattctgggagagttcccaagacaactgatcatgagacacgagttattagggagaccgctcttctgggcttcccttgctcccggcctacagcagcacctttacatctcctaggcagggggaccatgaaagctcttctagaaccacattttcagatgttctgtcttccaagtcccggctgatatgagcgcctctctctgggttgagattaaccactggcccagcccagctttcctctcagtcccgttctgctgagtattacatctggattctctgtttatctgcagctcgggcatgggttttgaggaaccaactctgacttggtccttgataatttctttattttcaaagaaagagtttgtactgaatatccctaggaggactcacttataagcattgaacatatttttatttatttttaattttaatatttttttgagacagggtctcactctgtcatctaggctgcagtgtagtggtgtgatcatagctcactgcagcatcggcctcctgagttcaacccattctcccacctcagcctcttgagtagctgaaactacaggcatgtgcctagctatttttttaaatataatttatagagacagagtgttgctatgttgcccaagctggtcttgaactcctgatatgaagtgatcctcccatcttggccttttgaagtgttgacattataggcatgagccaccaagccagcctagaaacaatatcttctctattttagatgtaaaaaccgtaaaagaaaaaccctacatgtgctcacacagtttagaaccttaatgtacttatgttcttgaggtattacatattctcccaaagagtagggacaaacttgtctttcataccgactttttcatcaatagctaaaataaagcacacatatccttgcaatgttacatttgaaccacatgtggttagagtcaaaggctctatataaaagaattaaacaaaattaataactatagacaacaatttaaaagacattctgtttcagtaccacctgtacttagatatcaaatacctatatagttggaaaaataaacacatcttattaagcaaatattttaatagtgcaaaacctgtgtggtctttcacgacgtggtttttaacttgtaattcctctgtgacatctaggtttccccaaggcactgtcatattcctgaaatgttttctgctagatcaaagcccaagacaaaatttcaaattacatcaatgaaatgaactattcatatggaactaatctttctataaaaacctcttcgaataaaacatgatttttgaaagtcagataaacccaatttattgacttcattgtgagttttgtcaggatttattccatccacctcattgtacttcttcactatacgataatgaatagttgattgggaaaagactatcctataaattattgccagttacacaaatatgacactgtaaaagtcggtccactaataactcacagtgcatgtcacagaagagcacttctgatgaagtttcatccccatgggctcactcaaaggaaacaatatagtaagcactatttaaaagagaaaataaagtatctatcctgacattgctaaccaaatagccatcttaacataaacagaaacaacctcatgcatggcaagactttacaattatatggatttgtgtgtgatatactccacttcaatgagcaaaaagttatgccacacagagcttaattacatcctatacagcatgttaatagcccatatggcagaacctgggaacatcctaattgaaagtcacttaacatttacaaaggcaatccaagtttaaccagtatgcaatccttgatattcctggctagaaaagacactcttattatcatgaaaaataaatgacaacgttatgtaagatctgatggctcttccgaacatgcttattttcagtttggaacacctgtctcagctttcacttaagtataatgaatctataattaagaatctgttaggattttcatagaatatttagttttgaggaaactgcgttaccatattgtcatattgcaacagcctctgacttggaatacaaaaagaataaaatatataaaaacccatgtgaatacagaaaatcacttgatctttatcagtgtttcccaaacactagttatctataattcctctcctttttccaccttcttgtgtcttacagaacttgtcgtattgactctctctgcaaagcattcgacaattttcttccatttcttcctgtcccaatcccagtcatcgtcacacctattttaatccaagccatcgtcatctttctacggacctcttttcaggttgcttattggcctccctagtttggagcctttctgcaagcctcaccagagagaccttactaaacatcagtgaggtcctgtcacttcctcccaagcatccttccactgcacctcaagttacagcctcatgcctcactcttgattgcaaaactccacgagattttgtcttatctctagccccgtctcacatcaccaaccccatgttcactgtagtggccttcagctcacccattacttctgcacactggtcttctttctgtttcttacatatggcaacacagttccttagggtttttaccccagctgtttcctctgtctacaatcacctttctttttttttaaaaaaatgtatttttccgtaagttactggggtataggtggtatttgtttacatgagcaagttctttagtggagttttatgagaacctggtgcacccatcacccaagcagtgtacactgcactctatttgttgtcttttatccctcgccctcctttcacttttcccccaagtcctcaaagtccattgtatccttcttatgcctttgcatcctcatagcttagctcccacatatgagtgagaaaatacgatgtttggttttccattcctgagctacttcacttattctacaatcacctttccataaccaggtctttctggttactgagaactctgtcaaactataccccttcagagaagtttcaggtttcaacctacaacagtcagaatgagataagtcaataccggttccacatgaattcaggttatctgcagagcccttgccgccaccctgctgttcttgagtatttttcctttgtccctctgtcctgcaccagaacatgattacatgagtttgggagagttgctactcttttccctgctgtaacctccagtacttagaataatgatgggcccctcaggagagctgaagaaaaagatgtagaatgaattaagaattagagatgttctatgatgcaaatgtcctcgtatcttaacatgcttgagaaatatttggttgaaaatcagctttcttcctgtagcagttctcaaaattctcattataccccaattatgtgatttctccaagacaggaatattgaatgaggttttccaacacttctttggccactgaataagttcgttttaagaaagctctttttgaatattaatccgcttagaaaacactgttatgtgaacatctatctacatagatctattgggaaaatgaaggcttttctcctttgaaaaaaaactgatttcaaggaaaattaaaaattttgctcatatgttttttgtttatacatttgttttcctttgttaacaaggtaagtggatttcaggtctaactcttctaataactttttgggctgacttttgacaaatcaccttaattttcttctgtgcccgttttcttgaccctaaagtgaaggagagtaatttctctgatatcatttcatactatatgctccagagtttctcttccatgaagctgatttatgaagtggaacaaggattgtttgaggtaaaatatgtgaaatttctaaaggtgatcatacatgatagagcaaaaatcagcacagttagtcacattacagagcatctggctctggggcaaactaagcgtcagccttcacttgccgaatgattggtcgttggttcacatctctgctcagaggttgctttccctcaaggagacgttacctggaccgcttccaatcagatgatacccaggttctaattatacgttgactactgtgattgttttaacaccatttctttctctaagctctgcattctgtgcaactgagaatcatggagttgtgaagactgttatgtccttagtatctcaaagacctcctggcatgtagaaaccctccaataagttattattgaagaatgattgtttgcaagcaacactggcagaaaaatattgatttaatgctctgccatggccaatatcaatgtgcctaggaattcacactcagaaaacagagagaaaaaaaatgccccaattcctcccagacctgctgaactttgtgtttattaaaatataataattattcaaaagaacttaatctcaagatgaatggatatgcacgccagtaaaatgctaactgaaataaaataattaggagttattaagctctcctttcatgcatgcctaatgacagttttaagtgtgtcttcatcgaggttcactacgttaataaaatctatatttccttcctctcacctaaaattatttcttaagttctttctgagggacagttcacctaggacgattaacacatggtcaccttttccttcaccaaaaaatttctgcttgttggctctgaaggcagcttaatgcgcgaacagggtttgggtgttggaaatgtccagaagaaaggaatcaaatattgagtgtccaataccattcagaattaaatgttaacaatatttcacaaatgctttcacaattcaaaagaaacccaatttatctagagactctacattgatgagtggatagatttttcacaaaagcatgtggaaagttaaataaaaaaaacaaagttttgagagaatactgctcttagttattcctgctcgtcaggggagctgccctggggagctgtggcatgttgcatttcggacagctccatctgtctccttctggaattattaacagcacttgcaaactcgtctttccaacagagacaaatgattcttggaactgccctcacaatgaccaaagctatattaaaattccataaggaaacatccaggagattccttataaacatgatattgaggtactgaagcccacagtgtagatgcttaaaaattaattttggagaacaggctggaggaaaatgttgttttcatatgcctctgtgctcactacagcaatggaatatcccaaatgtcctctctaatattatagcttttcattgcactacttatgggttttccttcaaaaggaatctatgacaaattaaaatctttaccggcaaaggatatatgtttggaatgccaatgaatttactattgaaaaagaataggtttccaaatacagttctcggatgggtagcacaacacatagccatttgggatatttttgctcacacgcgggactgtgaaatgctgcccatcataatctggaaagctactgctatccttgttcatataacatagcatctttgtgattcaggtcatacaatatggtaacccagaaatatcaagacttttaaaataccccccagagattagtcctggaaagtttgcagagtgtattaggttttgtacatttgtgttgccaccatccacattttttggtaaatttttaaaaatctctgtccttctctgcgttgctcttatcactgttaccagcccttcttaatcaagactgggtatctcatgtgtggaatcctgccttatgtgcatgtgggcaaacagtaattctttagggctatttatgggccagcctctgaaaattaagaaaggcaaacagccgtggaggctgagtcacgtgggatggaataagctgtgccctgtccagacctggtacctgaagtcctgcgcttccctgcctgatttcccttattcctgagtacacgggattattttaatctttaccgttaaaacgcaatgatgttccttgttcaaaatatataccgcaaatctcctgtctaaaatatttagttttttctggtgacattttctcaattgaattattttaaactactatatttctctgaattgccttaattataaagcgattatgtaagataagattttttgtttcttgttctaaatgtgtatccacatttatctgttgcatagcatcacttattttaaactatttttgtcttattgtatatgtctgaagcaaaatcatttcaagacgtaaaaaaacaaaaacagaaataacacagcaatgatggcatgggttcttgaaggagtcgaagatttcaagtacttacaacgaaactgagattcaaggaccgtggacactatagattcatgactgtatttcagaacgaaacaaaaataggacttacaccatgatgacttctgataactaaaatatgatcagatttttaactttccatctgatccagattagaaataccttcgccttattaaaaataaaataaaaatcaatttgtatggttatagaaacacgtagaaacatctatttggagaatccaagaagaaaacccatattgcataagcaacacaaataggagtacgtttccttcaataaaattattaaatattttaacaagtgaatatcaataattgagaaatatagacactgttttctttttatattaaagtgtcagctgctaagttgatactataaagtagtgagggctttccatttcatggcagctgtttgaatgtttctgatttttatttttattttttcaaaaacaacttcccactacagggagcatgtcaaacgatcaacttcctctctttaaaatttcaggaaagtatataatcactttaatttgtccaaagaatttttaatcaagaatttttttgtccgtactgtaattctaaccatattacacatgttgataatatctgcattttgtcattacaacactgatatctgtttattttatgtttcagatttctattcggaaaacattattctaagcctctgggccattttatatacaacggcatttcctcacctcctaaaataatttactgcattcaactccttttatattttaattttgccatattttatatcataaatatgacagtttacaaatcatttattaatgctatcttattttcctactataacaaagccctttcctcattcatattcagaatttttttcaatgaagaagcactttttttgtgtcctaagtggtaatcaacttttttgtttttcataattttgatgatactttgaacaataatttctttaaaacacatggaagtgtctctcacaggatggtgtttgtatgggacaactttaaaaataaattatccttttcttcaatctttctgactggttacatatatataaggtctatgttggcacttacatggataatttttaaaatgtggccctggttctcttctcttggtaaacttggaaaagagaggctcattaaagataaaacaaaatggttaaacaatataagacgtttttctttaactcccaaactttgatttgaagtgtagttgtaaacaccaagtctataatcctattttgtgaaatatcaaatttatgtattattggttggttgttgctgttgttattctttcaattcacctttcctatacggtttgaacaccacttttcaggtgaattaaggatttaaatatttaactcttgacacggtcactaatgtaaagtttggtcactactgaaaaaatattatactttgatttcctttcttaaaattgtttttgttttccttacatttctaattgtcttcaattttactattgctttatctatatatacctattttttacctattctatcaacagttattttaaaattttttttcttttattttgtaaagaattgctcctaaggccccctctgtccatatattctcatctgtatctagggctcttccaactgacattccatgacttccctttaccctctgtggatgtggcttactcactgcttataggtaaggtggggactgagtttaaccttgtctgcagttaatcaaccaattgtgcctgcacagtaaaaccccaaataccccctggaagtggggcagactcactgggcttccccggcaggcagtgctccatgtgtgttgttccaggtcagtacctcggtacttaaggggagaaacggggtagaagctgcactgtgcgtctcttccaaaactggctgatttaaatgtatcctggctgtattacaaatatataaatgtaacaaatgtgaaggtaatacgtttcagagagttctttgagtctttttagtaaattatcaaacctgatggtggtttagggatccacagaacgtgtagttggtgtcaaaagtcttgggcagattagaaatttggacggctccattctcggaggtggagccaagatggcggaataggaagagctcaaggcaacctacaaaatgggagaaaattttcacaacctactcatctgacaaagggctaatatccagaatctacaatgaactccaacaaatttacaagaaaaaaacaaacaaccccatcaaaaagtgggtgaaggacatgaacagacacttctcaaaagaagacatttaggcagtcaaaaaacacatgaaaaaatgctcatcatcactggccatcagagaaatgcaagtcaaaaccacaatgagacaccatctcccaccagttagaatggcgatcattaaaaagtcaggaaacaacaggtgctggagaggatgtagagaaataggaacacttttacactgttggtgggactgtaaactagtccaaccattgtggaagtcagtgtggcgattcctcagggatctagaactagaaataccatttgacccagccatcccattactgggtatatacccaaaggattataaatcatgctgctataaagacacatgcacacatatgtttactgcggcactattcacaatagcaaagacttggaaccatcccaaatgtccaacaacgacagactggattaagaaactgtggtccatatacaccatggaatactacgcagccataaaaaatgatgagttcatgtcctttgtagggacatggatgaaagtggaaaccatcattctcagcaaactaccgccaggacaaaaaaccaaacaccacatgttctcactcatagctgggaattgaacaatgagaacacatggacacaggaaagggaacatcgcacctcagggactgttgtggggagcggggagggatagcattaggagatatgcctaatgctaaatgacgagttaatgggtgcagcacaccaacatggcacatgtatacatatgtaacaaacctgcacattgtgcacatgtaccctgaaacttaaagtataataaaattaacaaaaaaaaaaaaaaagaaatttggatggctccacccttaaccccaccatttggctaactctgggtgattgtgtgagttcctaagagtaatttttcagtctaggagttcttctgttccttagttcttctgtacctttagtgcctctgtaccattcgttttttccatgaaggctttgataagacttttttcaacatattttctccgtaggaacaatatgggtccaggaatagaacttttggattaagaccttgactctcttattatttctataagattctatcatttctactgtcctcattttctgtttcattagctttttctaattgtttattgattttctatgtctctaatttcttaattatctttttaaacttttacctatgtaaaaccacctcctatcctttgaaaggtgtgaagttatttttttcttactatattcattgtctcagtttattatagatttttccacttgtttattttgatcatgtcatcggacattctttaaatatctttaatatttggttatctgctcttatttcacaatgtggcattaaaaaactgattgaagcttgtaacaagtcaaagcagtttgccagttttgggtttacttgacaaagatctatgaggaactagctatatccttgtgggaatcccaagggtctaaatacaaagatgttttcttaggtgatggaaaatttctccaatgcagaaatctccaatttctgcattaatagggaaactgtagaggagatgtagcagagattgttgctgtatatactaattttaagccacatcttaccctttagagcaagaactaggatggagtgagtcagaaaagtggtgatattgaagcttggtctttgaagcatatttaagtaatttatatttactaaatggtatttgacctgaatcaaattacacattcacaacatgagacacgtgagttcctgtaataacctttgttcaatatggttagaattgggaaaataaacagattagcagagtttcaagagacaatgaaattcagggcaaaaaaatgtattttctcactgcacaatcttagtgttttatttatttcttctcacagtttaaataattttataactcaattaaatatgttaatatttaaatgttaagtatttaatataacttgactaaagcagttctttaacatttttttttcaggacattattttcctagttaaatctcaatgcactaaagttggcaaaaataaaaagttttataaaagaaaacagaactaagatccttaattagctactttaagtgaagttactcccttcttggtggccaggctgggtcaattgatgcccatgggtgattttcaacatgaagagctaggaagaacgctaccattgagtagattaccattcagtattaaatgcaaaaattgaaagtgtagtcactaaaggaaaaaaaaaaatctgttcacatcagtttcacagtctgtggtcaaagaaaacattggccaattattccagaatagatgtgcatagctaaagcttattcaaccctttgtaatatcattttattagatagatgaatctcttcaacaacagaagaaaattagattgcaactagtattcatttctacatcagagccccaggctggagctatattaagccactaaatggtctgcagaaaattgaagtagcatgcactttgatctcaaaggactgcctacgtcacatatgacaggcatttataagagaagagatgtcctcctgggacctaatgctgaacagcagaaacaagatgtgagatcctgaggatgcagagacatttaaaaaacaacacagcccccaagataacattaccaataatgatacttgaaatgactgacaagtaagtttagaagtcttaatagaaattctagcgtttgtggaattttctgcggattgtaagaaaatcccatcctacataggcacagggatgtctgctcttgagtaggaagagtaatagaggttgagaacacataactaccctctccttaaaatcctcctggctcctcccagtttatcagttccatctttgttttctcagactgcactatccactgacaaagaaccagtgcttccctctctatagtcgcaggaaattctattgccacagcttcattccaacctcacaggactagttttcattttcttctgtcacttggaaatgcacagatgaatatactgtttttcaaataaatgtcctttaatttatttcttatttttcatgagttgaaatctaaactggcttcttggacttctgatgccctccccaactaattatcataaataaatatgtatgtattgattagtgtgacttggaaacggttgtagggctttgggaaagctgtagcagaaactggaatttctaacttgggattagaaaacagccgcaaatatcagagtcctatactaagtattgcagaatacaaatgaatcagacacagaccctgccttcctatggatagataactatgacagaaatatatagtacaacctgcagtcagaaattcacaagtctgggcataatggctcacacctgtaacccccaacactttgggaggcaaggcaggaggattgcttgagtccagtagttccagaccagcctgggtgatgtcgtgagacactgtctctactatatatacgcactatatatatagcctatatatatagagagagactatatatagagggagtgtaagagtatagactatacatatataggctatattatattatatatagcctatagatatatagcctaggctatatataatataatatagcctatatatatagtctatatatgtactctctgtagatatatatagtctctctatatatctatagtccctctctatataaatatttatatataataaataaattaatatataataaattaatattatatagtataatatataataaattaatattatatagtataatatataataaatattatatagtataatatataataaattaatattatatagtataatatataataaatattatatagtataatatataataaattgatattatatagtataatatataataattatatatactattaatatataatattaattatatatactattatatatactattaattatatataatattaattataatatataataatatatactctagatatgtatagtctctctatttatatataataaaaaattaatatctataaattaatattatatataatatattatatatcatataattataatattatatatttatatgttgatattatatatatttattatatatataaaatatatagcctatagatatatagcctaggctatatataatataatatagcctatatatatagtctatatgtatactctctctagatatatatagtctatatatctatagtccctctctctatatatttatatataataaataaattaatatgtaataaattaatatatagtataatatataattatatatactattaatatatattacttatatatactattaatatataatattaattatatatactattatatatactattaatatatattaattatatatactattaattagaatatataatattaatatatactctctctagatatacagtctccatatatatttatatataataaaaaataaatatatataataaattaatattatatattataatataatatattatatattatataattatattatatatttatatattaatatatatatttatatagaatataaatatatgttaagattttatatattatatatatattataatatataatattaatttattatatatattaatatgatatatatagttgcccactgcactccagcctgggcaacaagagtgacacttcaactcagaaaaaaaaaaaaaagaatctatctccttcatttgggagctgttgtggagaatgaacaagtctctttaaagcacttcgcttgctgttaaacccatgagtgctgccactgctcagagagtttatatttgttcccagagaagctggtggccaaactagagaccaaagtgcacagctaaatggagggaacattatggcctcttctacgggcggcagtttctaaggatcagaacagccttttgaggtagtaggtacctagaaggaattcacagagatgcagtgatcttctgctctggatatttggagactgaagcattgggtgagatgttgaaggatgcatttaaaggtcatgtcaaagctaagctcctaagagtcctatgtttctaggaatcctctgggttgattttttaatatataatagctctgcctatactttcaatgaatattttcttaattgttaaaaagacctattatgaacagcttgcttcctttatacttaatgttttctcaacatgcctaagctatcaaagggccttcataaagtaactaaatgcttctgtatgtttgaacctttgaaaaaaaaagagacagcataaattagccaaatggtgaaacagatgttcaagaatggcaaagctcacgcaggaggctgaggtgccaactagcatctcgctgtcctgttaacagaaatatccttgaaaactctagtgcacaaatatgctgagggagaataatagtgtgtaaataagcaaaatagataacgttgtactttattttattgtgttagtagcaagagtacctcttgccctgaacataataggcattcaataaatcattgactgaataaaaaatataggcaaaacaaaacggtagaggaaatgcattcatgtaattcaatcaaaatgcaagcatgcctccttatttcaagttaaaacatgtgagtgtatgtataggtgtgagtttatgatatatctgtgtgtgtgcacttgctagtgtataggatattgaggtcactatacagtgacctcaattcttttttttaattttttttttttttttgacacggaatctatctggctctgtcgtgtaggctggagttcagtggcaggatctcagttcactgcaacgtccgcctcctgggttcaagcaattctcctgtctcaaccttccaagtagctgggcgcctgccactacgtacaggcgcctgtgactacgcccattaatttttgtatttttagtagagacgaggtttcaccatatcggtcaggctggtctcgaactcctgaactcaggtgatcctcctgcctcggcctcccaaagtgctcagattacaggcatgaaccactgcagctgtccggtgatctcaattctttggtacatgagtcttagggcaaaattccaggacaaacactaaactacactgattgatgttaaatcaagtattaaatagaacttttccaggaagcctggcactattggccccctcatgagggtactcatcgataaaatggtggaaattgtgtttttatgtatgtaatacaaaggaattccatacaatttcaataaacttgtttggaaaggtttatattgaaaagttttaaatagttcatgagcttgattttgaactatctttaaaactaaattaaaaaatgcatagattggcaaaataaattggcatcaagtgcatttttggacttctttaaccatgctttcgttatgtggttctcaacctcaagcaatgtgtttgattgcttttatggagaaaagaagaaaacaacaaaacaatctttgacattctttcacttgcaagaccaagcactgcattccccattcccttttcattgctcttctatgatttgtggggatgtctagggacttgtaaaattccacaaagcacatatatcaattaaattgtttatcacaaaatcaccaaatattagcactagaaaggattttagaactggatcctagtttttcaggtcacacatttttagaggttcaaataaaaaaaaaccatgaatatgattctaattttagaacctagtgattataatatataatatcaaaactacaatagttccctcctagctttaactgagctacattaataacatccacagacaatgaaaattagtaaatacgtgcaaatcagcccatgatctgtgttcaaagcaccgagactttgcatcaagctagcagctcctcaagggtcctggcccttgggttggccacactggccacggcaaagcctttcccatgggatgatcttcccctagctgatcctccaaaaagaaaaggaaagttactgcttccaaaagcagtttttttccatcgtgttgcagcatcaatttgtatatcgagttaaaagctcctttctttctaatgcatacccttgttcttaattctgatagttaataaaacacacactaaatgtaactggaaaacacacatgccttcattctgcctaattcaaccccgatctcttctccttgtcaaacaacctcaggttttcttaaaaactcgttttcctagcatcattgtaatattcccattttccaagcctcttgtagaatcatctgcttgtccatttctctgttaaacattcaaaactaattcccaatcttcttatgaggttctttcacttttcattccagtagtttctattggtacactctgactcaattaggttttagatacccatatcaataccactaataatgtatacttaaacaaaaatcctgacagttggctgtgcatgtcttatagtctcaagactatattttaaacagatgttaaatgattttattctcattgttcattactagtattaaatattttttggctaaatttctagggaagaagtgggttccaattgtagatctaggtcagaaattgtaaatcctggggacacagtagtagaaataacacataaatctcttgcctatatggaagttacatcaagaagatgttgacagctagagtttctattttttagaacactcataaattatgttgcatttcaaagagcatttgaaactaaaaccaaactaatgagaaacctgcaaaaaatgtgtcaagattaaaattgggaaacagaaaaaaaaagaagagttaatatttgatttcaaaactgtcttttaaaaagttggaatgtcagtgttcaaaaatacattagcagatggctgctacaataaatgggaatataggattaatatcatttgtttcacaaacttgacattacaaataaaaatataaaattttaaaaacgcactgaagatgttcctagaattgaaactacaaaaagtcaacattagctcactcaattgtttagtttgctcagtttgatttctaaagcaaccctgaaaagtaaggattattagtattcacattttgcacatgataaatgttgtaatgagtttctatttcagtatcgttttctctttttatttattctttagagagtttgaataaatgattccatagcacatctaatggaatcaattctcaatttttcactgtcatggcttgtaaattgtttgtttccttgaaaaccttgctttcccatttttttgtaattaacacaaaatcatctgctgataaactactccactaaaaatactttcgttgtttgttaatgagtttatctttttatactaatctttacctcattgaacgaaatcgtttgaagactttatttactgaatatttattgtgtgcttacagtatgtaattataagcaaagatatttcagatatttaaagtcaaagttggtttcagagtaattaagaataacagccagccaaagatcaaaatgacaaattacactcggactttgtgtacatgaaacatgagacagatatgagaaaaatgtgaaactatataaaagtaaaaaaaaaacaagttattcacgatgcttttatgtcaatgcatccagttggaagtttaatatttgaatattttaaagagaaatttgttataggataccatggaatgcattttcaaagagacaggccacggagtgagtgacgggagcccacagtgggtggaacacagacctagtttgagcactgaaaggaggtggctggtcttcgggaaatgttttaaagcatttgattctcagatccaccatctgcaaaatgtgcatgaaagtaatacttccaaggcttgttttaggaatcaaatggatataatgtaccttcgaaagtaaagagggacagatattgtgagtacaatttagagtaacgtaatttacacccagcagaactttccattgcatgcgcacaaggttatctgagaacaatgatgaggaactcagaaaatgtactcaaacggccaaatgtctagcatccagcactgataatatgtagtcattgttattacaatggcacaatgttaatataattaaatttccatcccactctcaacaaggccatctaaacctgcccctcctaccatttttattatatacataagaatagtactttaaaaattttaaaaagacaatattggcattaacttagaaaggcttatttttatttcctctttaagaagggtgttgaagaatgagtctggcttgtggctaaaatctctgttgagagcaagttcctgacggatgggtgggtgatatttagtgagtcaaggaaaattaataacagcattggtggatcaatttcaagtcaatgacaatacttcaggaagtcccagaagttctatctggtagacacacatacacctcactcaccaacaaattattgacaaagaataattctagaacctttacactatgatccataggaggtccagggagttgatgtatggattcagagagagcaatctctttggtaatgtgactaaccgtaacttcatcatcttttagcagaattgtcacagagggaaaaattggatttttaggaaagtaataactagaggccaatgtcatttgaaaaggcaagggggtgtcctcccatctgcagatggaaggagaacggtgggtatgcagctggaaattcactatttgaattcatcattgtcgggaactgcagcctcactagttttatttctgataaactgaaatacagatcttccttgacaatgaggtcatgtgacctcagaacttatgagcgaaacatactctgccacttctgttcatagaagaatcagaacagattttgtttttgtttttgtcttttgaagggaaaaatgtctcttaaaatttaaaactaaagttttttctaaaattcttgtcaatatttgtctgtgcatttaaaaactgccatcagaatgcttgatttttattttaatgaattaagattttaaagatgtgatatgcagatactgcacaaactttaaaagttaacaaaggttattgatgtataattttataacacaataaaggtctcctgtgattagactttcatattatagtttaaaatgcatacatatatttagaagcaagaagtatcaactataaggcaaatctgtagacattgaattgaaggcaggaagacagtttatgggaattagaaaacacataccgttaggaaaatagtgcaactatgcatctcctaacaatggagatacattttgagaaacacatagtttgctgatttgtccttgtgcaaatatcgtagagtgaactcacagaaacctaggtggactagcctaccacacactgaggctctacgatacagcatgttgctcctggaccacacacctgtactgcatgggactgccctgaatactgaaggcaatggttacacagtgatagatatctatgtatctaagcatatctaaccacagaaaaggtacagctgaaaaatcagcataaaagatagaaaatgctacacctgtacagggtacttgccatgaatggagcttgcaggaccagaagttgctctgggtgtcagtgaacgagtgattatgaaggcctaggacatctcagtacactactgcgggatctataaatgcagtgtacttaggcacactaaattcatttaaacatttttttgtcttcaataataagttaactttagcttactgtaacattttgtattttataaagtttttgatttttcatcttttttactcttacaataacacatagctcagaacatactttgtacagctgtataaaatatcttatttctttatatttttattctatgtgctttcttctatttaattttttttttactttctatacttcttttgttaaaaatgaagacacaaacacacacgttgtcctaggcctaaacagtgatcatcaatatcactatcttccaccttcacatcctgtcccactgcaggctcctcaggggcagtagtacccatggagccgtcacctcctatgagaacaatgccttctggacatcttctgaaagagctgcctaagactgctttacagttaaaattaaaaaaaaaataataagcagcagtagacttctataataaaaagtatagtaattatataaaccagtaccatggttgtttatgatcaggatcaagcattatgcatggtacataagtgtatgtgctaggcttttatataacacactatacgtttgttgccaccagcatcatcacagatacgtccacaatgcaccacgctatggcattatgatcgctaccatgtcaataggtgataggaatattccagctccatgagaatcttatccaaccacctttatttacatggtccatagctgattaaaatgtctttatgtggtgcatgactctacatgtgaaatagataaacatatgtaagttttgattagccccaactgatcaagaagatgacagttactcaaaataaccttcctctcagttttttcacgtgtgaaactcagataagcatagaaagtatttcacaggaatggtgggtggattaattgggctagagcatatgaaatgtttgactttagattaagttgacatttaaaataaatattcacaaacattagcagttattatcattaactcaccttatttctttagcctaaggatttatttaattatttatttagtttgagatggagtttctctctgtcgcccaggctggagtgcagtggtgcaaccttgactcactgcaacctcgactcactgcaacctctgcctctctggttctagcgattctcctgtctcagcctcccaagtagctgggattacaggtgcctgccaccacgtctggctaattttttgtatatttagtgcagacagggtttcatcatgttggccaagctggtctcaaactcctgaccttaggtgatccacccgccctggcctcccaaagtgctgtgattacagccgtgagccactgcgcctggccccaggatttactttttaaatatgaattttccagatccacagcagatcagatgatgcctcttagcaatctagtctcaggtttagaagcccttccagggtgggggaaggcaggatcctaagaggacctccatgctcctgaggtctcctcctcttgcaagtgggcaggacctgtgactggcttttaaccaataatgcctgaaccttacaggtggcgcggtgtcactcttaccattatgttacattacagggcaaaggtgaagacattttgcagatgtagaaaggtccctaatcagttgatttttaagttaatccaaaggcagttgatttgggagaacctgacctacttagaggaacccttaaaagtgttccaagtcagagaaggaagcagaagtggtcccctcctgctggcctcccggaaggcactgcccagtgtggggagggacagttggctgcgagcagtgggcagttttggggtcctgagcatctcagccctatacttgcaaggagctgagttccgccaacatcaatatgagtatggaagataattccagcctaaggtgagatcacagactgaaggagtccttgactgctgcttcttgaggccctgagagaagactggggtaaggggtccttgattccagaccgatggagccccgagaaaacacggatgcactgccttcagctgctgcatttctggtcatttgctactcagccatggaaaaactaatacagaatgcttccttatagcaagtctcaatccctgacactgcagttccagctccatatgttcctttttatcataagtgattaggaaatatagttgggtgccaataattgcacatcaaacctcatcttgactgatttagatgtatttgctcccattatgcgctccctatagctagtctgacttttcaactctatccgttttctctccttataaataaaggtaagtgcatattttcttggcttcaaaacaaccaatgatttttatttattatttatttattcatctctattctgtgtatcttggatggggcacttctttcctgacacatgtttttattttgtctaatcttcttaccatcctggtgatatttctctctctctctctctctctaaatatatatacttacttagtgctcatattgaatttatttttgctgtgactgctgtatgtggtggatgagaagttggcattttttacaggcaaaagccaatgtcaggaacaatcagaagttgtcaggacattgatcctgcccttaatacctgcaaatcctcagctggacccaagtgttctgcccaacaggggagctcattctactgcgatcccactaacaacagagatcaccacatcaaaaggagcaatcttattaaagagagtaactagaaaaagactcattttttttctcagccttctctaggcatagttggtgttttttaaaacacaattaggagttatttcaactaatagttacttaagttctctgagtacttaattcagttaattgatctggatttatactttccgattttatagcaaaagcctgagaagttacttaatttactcaataccactttaatttcacctttgtgctgctccttgtaaatatgtactttgaactgctcaatttccctcactgttctaaagtgcagagaatagatggaatttaattttaaagccagatttttcatttcagatcctattatgctccttgcaccatctgtgtgatctgatctctgaaaatgcaatggtcttttaggtggtcctgaactacatgtgtctaattataattgtcaaatatttagtactgtagaaaaaaatgattagcagcgattttaaagaaaaagtggtactttatgaaaggatgtttataaagcacacatttttttcagtccagaaatgctaaagagtgatataaagaagatacatatctagatatcatatacatatatcatatatatatgatatatatatgtatatactattgcaaaaatatactcctagttaatcttataataatggactttcatacagaaggttctctgctcatataaacttaaacttagtggcatgcagttttggccctcaatatacaagattccatttaacagttgaagggatacttttgtaacagaaagttacactgaaagacaaggaagcctaggatgataaatggaggtgtcttaaacgatgacattaacttagtttgaatgaaaaatcaacctgggaatggttgatgagaaaatgatggaaaagaggaataaaacgaaacaaaaccacaggaacacgggtgcatgtgaatgtgcacagacaaagatacagggcggactgggaaggaagtttctgcaccagaatttggggagatgaagtggagagaggtggggtccactacccgcagctgccatcacaggcgccaaggaaggacggacgaaagggagtccttgcttaaatgtcagaaagtaaccctgctccttctggcggttactccttttagttacatctgaattggaatccatcaaataaatgagtaaatgagtagctcgacggttagaatgacgacttcagcagaaattggtatctgcaattcaaatgagttcagctaatgctccacatgggaaaagaacagtgattcctgggcctgtctgctggagcctacctggggaacaaggtcgaagtccccagggaggggtcgattttagtgatgttgtcaactgctgaaatcaggatcggcacaggaaacacagggtgtaaactcaatctttatgaagctcttgtacaaatatcttttgagaaatgatatgtttttaaagatgatattgtgagacagagtatatctttttttgtttggtttttgtttttgtgatggagtctcgctctgtcgcccaggctgtagtacagtggcgcaatctcagcttcctgcaacctccacctcccagttcaagcaattctccagcctcagcctcccaagtagctgggaattacaggcacccactaccatgctcggctaatttgtgtatttttagtttcacgatgttggtctcaaacttctgacctcaggtgatccaccagcctcagcctctcaaagtgttgggattacaggcatgagccactgcacccagcaaagagtatatctttttgatacatttgggcgatgtcgccattcttagggcatatcccttatgaatttcaagtgtctgctgtataggcaaattttgagactgtttacacttttctttatatcaaaggctccaaacaaaagaataaaaaaccaataggtaagtccaaagatagaatcaatatgtgcacagtgttctctattttggtttcaatagctttgttttccatagggtctcacccctgactctttctactatccttgccttttctctttgtcctgtaagcactgacactgaattcaactcctcaaaattcgcattaagcctggcatggtggctcaggcctttaattccagcattttggaaggctgaggcaggcagataacttgaggtcaagagttcaagaccggcttggccaacatggcaaaaccccatctctattatggatacaaaaattagccgggcatgatggctctcacctgttttcccagctacttaggaagctgaggcaggagaataacttgaacctggggggcggaggttgaggtgagccaagatcgcaccactgcactccagcctgggtgacagagtgcgactctgtctcaaaaaataaatataaataaacataaaaaaataaaacaataaaaaaattgaaattcgcatttatacacatcacaggggtgtgccttagtagtgtgtgaaagtccagtcaaaggaacaaagctcaaaagttactgaaggataaaaaatgatagatactctacagactcaagaaagaatttatttcagcattattatcacaggaaacagagtttaaagttttctaatttaaaagaaataagaattacttcttttaacttgttgttatataaaataacagatgagtataataagtgcttcagcttagataaatatctatgtgtttttcctgcagtgatgctcacataacaatttgtagaaatgaatgtagaaggaatatttcaaatctatttaggtataattctagatatcattaaagatgaattgttttccatgtaaaataagatttctgaggagctaatttgtgacaggatatattatgatatcagttttcaaagcatgagcctgctcattatgctagaaggtagaatatttgaaataatgaatttgcatctagacaagggtgcatatcagggcaacacaaagtctttagggactggtcttttcatattgacattacacacataaaagtgggaaattccaacttgatagcccatccattccccaaatggccatccctgaaccacttttgttatctcttttggcatggacatatgtagcactaccaatttctcagtgctgagtattgcacttctactcatcaattatctcaagggaaaaagtacaaaaagaaagacctagtgtcttgagactttttggctctgtttgatcaggtggtccctgaaaggtgagcctctgcaccttgagcagcaactccctgctgcaggccaagggagggcagggttgtctctactttcactggagaaaaaaacatccattgctaacttaagctttaggtgatagacaataagaaacaaagaaaagggtgaatagcagaagaaaagagaaaaaagcagaagataaataattaaaggaaagagagagaacaagaaggtgaggaatgaagagggaatgtataaggaagtgaccacaagtcaggtgtgagtagaacacgtggttctaaggatgagagactgagggcgccaggagggtcgggtgggagcagacatggccatgcaaagccagtgggctccatggatcagagattctggcggggtagaagtactgggggcctgagcattgaagaatatgtgagctagagagatagcaggttagagagaataattcataaaactgagagcatggaggggctgcaatcaccggtgaggacaagttccctggacctgtatgaaaaataagaatggttgaggcagactggaggagatctttgcagaaaaggaattcaagaaacagaggctcaggttgttgcaaaaaccatcgatacaaatactctataagaatacttgattctacaagaatctagtggaagtacggagagtatgtccctaaattcaaggactgggaatggaggcgcaggaacatgcaccagatgtggggaggtggtaaccatcctgtaggcagtggatgcagcgaactcctgccccagaatcagaggtggggtttgtagggagcaagggagaatggcccgaaggaagcagtgcaggataagggacaccctctctactcccagccaagtggatgagcatgtacagtgaaccacactcccctgtgctgctggtcaagacgtcgggaagagggtagggctgcagggctgcattcagagaataagctgggatatagaagatgctgacagttgacgataaattccagaaaacatagtagatggtgttagggattgaggaaggtgggaggagggatggagtagaggacttactcgtgtcagctatctcagcattcacaaaagcagaatcctggcttcatcaaagtgaccaaggggaaactgaggcaggccaagatgaatggtgatgggggtggggaggagcctttggaggctgtgagggacgggagagatggagggtcaggtaagcgtctgcatctcccgctgcacaggtttgtaggatccattccagcctcttctgtctcctccaagcgcacgcttcaacaattctccgctttctgtaacccaccagggattcctctcagcagaatcaatccctccagcatccacgcaggttcctatttctctcattttaaaatattttatcttgatcccaccttcctcactaaatattgctccatttatttgcaccgctttatggcaaggctccccaagagtgttcttgacttgacatcacctcgtccccaacatccaactacatctcccgtcctcatgtcatcagtcgagcaacccacgtcactccatccaatgcctgccaccctgacctcatcattcttgatccaaaagcagcagtggcagcaggtggctgagcccgcgtcccttggcttcaaggacactcctctgagatgctgcttcccttccttcacgattgcatgttttcagtcttctttgttggttcttccttttggggattcattcctgaggctcaggagaaagctgtgagttttctttgtgatcttcataccctgatcaatttttcttctcacctgacacttattatttcataacatgctccacaatttactttaaaaaggtattgttatgtaatgtaatgcattggtatagcacgctctataatttactttaaaaatgtattttcttatttactcccaggaaatggtaaactctgtgaaggcaaggatctttgtctacgttgttcacagacacttctcaagcatcaatatgactgccttgttactagaagatgctcaatcaatatttatgtaagaaagtgattatgaaaaaaataagttaaataaaaaagaaggcacttatgaaaaaagaaggagaccttgtgcccctgtgagcaatgctcctccgaaggaccatcttccctagtgtagaaggtggcagtgtgcagttggataagcctcagtaaagaaaccacctcggggtggggggagcagggaaggacagcattaggagatatacctaatgctaaatgacgagttactgggtgcagcacaccaacatggcacatgtatacatatgtaacaaacctgcacattgtgcacatgtaccctaaaacttaatatattatactttaatatattaatatattatactttaatatattaatacattaaagtataatatattaatatattaaagtataatatattaatatattaaatatatcatgtcaatatatttatatatttaatatatgatacataacatataaaatattataaatatattaaatataatatactaaagtatatgtatattatatttagcatataatatactaaagaaaaattacattatactttatatagttatatattatacttatatatataaactctattaaagtataataataataaaaaaaaaaaaacacgtcttggaaatggaccaattctcatgctttgggaacacttaaaacatgtgaaactttcttaaaatctcaggagtaatacatttaactccaaaatatgatcaataattcttgtaaggtgaaattttagtagtgtgcactgccctttttattttgtagtcttttttcagataaattcttttccttttgattttaagaacacagataatgaattaaagtatcatattttcagtgactttttaatgctactgtttaagaatatccaaacagtacaacttcaaaattacttggcacacgttatagctgtattaacttttgagatacagataatacaggcatagtggcttaactgcacgggttatgggcagtttcatttctgcttacttagcttttctatctccctgcactggaactccctcacccaaggagattcctaaatctggtagctccattgtcaggccttatgatatagaatctggacaatgtggaagagagggggatggagagtgggcgagaagggagtcgggaagatgagacagcgggggaaatgagtaagagaaactccagagggggtaaaaaagaaaaaaaaaagatcgattaagaagtggtgatcaaaattcatatcgagctgttgattataatattactaaacataacaaaaacagggaattgttaaatcaattctaatccatttcagagtaaaatattatatggacattacaattcactcgcaaagcatttctaacatgtaacaatgttgagaacgtgatgctcaatggaaaaacatagcatacatacacacaaatgtccaggcccagtaatccatacagccatacacattcggaaataaacacaaaaacatgcatatgcagagagcttgagagaaatgagaataccccaaaatatcaagagtatttacctactactcttgaagctatggttttaaatatttttctgtactctctattttcataatgtttctaattaagacaaattactttcaatataacaaagatgtattattaaaactaatggacaaggctgcgacagctattttgtaaaagaagaaataaccatagatttttactatattgcatacaaaaatctgtctttgcaatttaaacttgaggcattaaaaattatctatattttttcatccagaaggaaatacactcacatcctaattttaatttgctagtctgaacaacagaacaaaataaaaacaacaaaaataaaagcatattctataaaaaacaaaaaagtttaaatatcagaaattctattttcatggtgaaatgtgctagttatgaagatataagctcatatgtcaaaaaacttgttttttaatcgccatgttgccactgtaggcattaatgagtttaacagaaatactgattaactgagtttcagttggtacaatgccagatgactgagtatgctaattcctatgacagtttactgcttgaaacatgaatttaattttcctgacttcattaatcataactgttatttaccatataacagcgtaaccattttcttctactgagaaaatttcattttcatgggtcatgcgatgtgaaatcctagagtctgctgactttctgagtaaagacaagctttctgtagaatttttactagtagggtattacgtaaacatctttgatttagagttcaactgcatttattatgacactttggaaacattgtcttattttcttgctttatacttgcattgccaaatctgtacgggtgagataaatattgaatcccagaagcatctccctactactgagtttcatgatatctgtcagtattaatcaatttttttttgttttttatatctagacaaacattaccaaacttttatgtcattcacatcatactgtggaatggtttggatctgtgttcccacctaaatctcgtattaaaatgtaattcccagtgctggagacggggcttggtgggaggtgactggattgtggaggtggtttgtaatggtttagcaccatcctcccagtgctgttctcatgatagagttctcataaaagctgtttgtgtagcacctgctctctctcttcttcctacttggcccatgtaagacacacctgcttccgcttcatcttccgccatgattgtaagtttcttgaggctgccccagaagctgctatgcttcctgtacagcccgcagaaccgtgagccaattaaacctcttttctttataaattacccagtttctgctacttctttatagcaatgcaagaacagacgaatacatactactcctaacatgctgccctatgagttcttaattggtgaggaggagaactgcatgaggatcaaatggaaatcacgtaataaatgcaacgactgtccacatcatgcggcactggggcctgagtatggcagactgtattctaatttgccatattttatagtccttttctatggtgcccctccctgcagcagcagtaaacgtttgcaccccagggaactcctaagtgcccacatggccagtgaaagctgggaagatagggtatgctgtttcctcaaaaatctttcaaagcctgtgtttcctttgccatggtgtctttgtctctgaaggagactgagcatattacagatacaggctactccctcaggctggggcccaaagttaacagaacaggcaactgagccacagcagatccagcatggacatgagtcatgaaatgaacacttgtaactactcagactggaggtggtttgctaccacagtgtagcctagctatcctgacaggtacaaagaatcaagtagaatttggaattttttttatttgcacagagaaatttttgtaatggcatggcaatgattagaaatatatatcgagggcttcttgtatatcccacacttacttcaggaaaaaaaaaattaaaaatgactaagacacagctctttagtcataaaagtaactaagacaaagttgtctacgaagttagtgtaaaatgatgggataattacatgggcttcatgaaaaaagtgccaaagttgtacaggagggagtaattaattgatacaacctaggtggtagagttacaagcaatatttacaaatggagtaatctttaaactgggcctttagcattaggagggtttttcctaattagggaggtgagaaagacctggcaagttaaacaaaactacacaaacaaagctcctaagatttaaagagattggcctatatttggaataacaagtgaaaaacaaaaactgtgatggtaaatccaagccagatgggaccttggagaacttctggacaaatatcccacctatatatatgaggatacctaagtccagaaatagtagatgatttgcttaatattactccactggaaatggcagagtcgtcttccacacctgttctgtttctacgctgtgtagacgtgaggtttgtggtggggccaggtggagttcacagagcagagggtggggacacagatggtccgaatgagtggaattttaatacacttcttagattcttcataatcttcaaataccaggtgtgatgatccatttacaaagacagtttttgacagagcttctataggtaaaaatgtgaagagagatgcaatgggggaaaaggatacaacaccaggccagagtagaaaagagcttattcttttataaaatacctagagttacctttgctgagtgagagattacgtgatatgtaacagggattgcttccgtccttaaaattgaccaggctttggcttccagccaatcaaataaagcctacactgcatggtgacttctctgtataaaattgttcggcatggtgcggtctctgcacaagattgctctgcacatgtgttcttggaaaaattagtgattatgtgttgatggttgtgtctgtaaagatagcaatttgtgactgtccaattgaattttaataacatagtcaaatcacttcgatcttagctatctctcactagaggtagaaatggaggctttttgtcaattaagtaattttttgactctctatttccattctttaaaatcataattcaaagtaaaagttatataatattttgctttgataaagtccacagaatgaggatgggccttatcaaaccctcaggatttcattaatatgaataaaaacttcaaaggctcttcttttgagaaaaatgcttaaaatatttcatgcttgaccttggttttataacaatgatttaaaatgaattctatgctgtttcttaccttttaaatcagtttttaatctatgtttcatttaagccatataaaactactactctatctttagataataattccaaccatttgtagaaatggaaggcctacttaattttgaataaaagtgcatagagcaaggtgttaactgcataaatggactactttcacgagtagtcttaaattaataattttcaccaagttctcgaaggcctatttaaaacattacctttttctatgtatttaatgctgttataatcttcaggagaactttttttttttctgttcgtaataccccaaataaaatagtccataaatcagattacattttcaaaataactttggatgttacactcctgtataacttatttaggatttaaaagcactgaatcatttcttctaatgttatcgggaaataacatgacttgcatgttgcatttttgtttctgtagaatgctccagtaggatcaggtttatcgtgacaatgtaaatctatatattttacaaatggatttggcgagttggttgaagtcagtttcagcagtggaagcagaattaaagtataacgacatcaatcccttcttctactccacaccttcatagtgctatgaagtgttccctaaaagaccttattataagtgaaattttacattattcatgtgttatgtgatattcatcttctcatccatgcacattcaatcagaagctctgagtactatgattcaacctatctctactccacacaggcatagcactgtgccagacacacaacaggctctctaaatatgtgcgtagcagaggagtacgtgggaaagccaccattcaacttctcaagtgaacgccattcaatcccactcactggtgagtctttctagttttccttcaacacctatccatggcaacctacattcgctcggcctattttttgtcactttcattctccataatattttaggtccagaaatacttctttttataaatatctttggaaatatattttgtttacagatgtgtagtaaagaatttggctccaacctcagaaatgcctggactttgtgcttggtttctgggaggagaatctttgccatacttatatcttcgtttacagcaggagctggccacagttggatttcagggcgaggctaactacatctaacaatcttagtgcgaagttgggtcatgccagaaagaccaaccatgttatttatggtgggagctttggtttacatgacgtcagttgacctgaagagtgagttcaaccatatgggcaattaatcaatgagtcgtgcctacatagtgaagcctcagtaataactctggacacagaaacccgggcagtcttccctggctgacaatcctgaatactgctgcatacttatgctcagaggtcaatgcatcctgattccgcagggaacaggcaggagaagctgcacatttggaagcctcctgggtacagcctcaggcatctcttcttcagatgatgtttaacatatattcttcttctgtaataagctataaccatgagtgtaatagcttttcatgaattccatgagtcccagtgaattttcaagcctgagggtggttttgggaaacccaaacttggagtttgtttgagaagtaagaatgtgcttgtggagggtcatgcccttgcgctttgcagtatggttagttgtggataataggtcacactttaaaaagtttgccttcatattgatcccctttgaagcttagaatctaatacatattaacccctcatttgatagagcaggcagtagaaagtttgagtgattcatatgaaagtaggaacagcaccaggtcgtgttctccaactgcctactctgtttcagtcagaccattgtgaagttactgagaactctgcccttgggaaacgtccataaaaacaaagatcttttagaatttcaacacagccagcaagtatagggcaatttcagttcatttttattttatgatatattaaaaaaatcatcagtcaaaatggactcaatgtttctatgttactaaaacaataaaacttttttttcctatttgaatgtaggagtttgctaatatagtttttaaaatgtacttgaagttcctttatgcaaggtaccttgtacataaattactctggtggcctggatttaccaatgatatcagaaaatacgcatatgtattgctaaccatattacacatcatatatgaacataagagacactattagttacagtccattaattttcaccataatccggttaattattatttttcttattcttaagaccacagaactttgtaagatgaactaaatgcaatacacgctaatagcaaagtccacattttgaacccaggtaagtttgaagggagagagtagagctgttttactctgcaacacttaactctaaccatagttttctggtgaacaaacgtgttctctaagaaaaatatacaatcatgaaaagatccaaagttcactttaagttcaggttagcactagaaatctagtctctatactatagaattatttttaaaatatattttctagttgatatacttcatgcaaaatgaaatgacaaatgaaagacaaagcatggaaagtatgacagatatgtaagttttccttgtatgaactgctgctcttaatttgctcctctcccctcctttttcagtatcagctgtaatgccaacttctagtgagctcgaaaacaggacgtggctttctatcatatgccaaaaacacacctttaacacactgtccttggttccttcatgactcctcacctgtttcttggcaacgaggttcagttgtctaatgtgattgcagtcgcctgtgggtttctaacggagaccaacgtactatgtacctgcacttgagaagatcattaaaccttcctttgtcctacatgaatattttatcttggctggcataactgccgggctccacaactctgataaaagtaaaatatgagctgtcttagcagacagcattgttcatggtgaaaataaccctgattggtaaattgcatctgactgggggtactatgaatgaacaacctatagcatttgagaggccatagatttggactcgtgagggctgtgcctttgaacctgcacctgatgcctcttgggagaattctgggatttaactccacgtgagcattacttgggaatggctcctatggtatgtgggtttctgagctgaagtgacctcacattcatctaggtgaagcttgttgtcttggagatgtatatggctctcctgttattggaggtccagagaatagggttttttgtttggtttggtttttattcgttttgtgttttgtctgctataaagattttaccaaaagaaatatcctaacttttctactggcccactgagtatcctgtctgcttatctttctaagtgtgccgattacagatgtgacctatgaagccactggcttttaaatgtctaatggagcctaagaaaacccacagtggaagtcatagcatccaacatgcctgcattccaggatttccttgctcctggaaagtcaatctttgtaccctggtttaatatctgttttctgtgatgaatgtgtttatatcttgtggaacatctaaaaccaacacaatcattccatgccccaaccattgcttgctaaatcaaagttttctctcccatgtgcctttctttttgccatcagtgaaaatacactatcatttttttcaactttttaatctgccctgctgtgaatttaattcagttctctattgccttctacctatacaacatcatagcaggtttttctaactcttttacaaattatgacacataactgccttaacctacctcatacacagcttccacttaggggactgtgataacttaccattacctcttagaacgaatttacattctcctttctgtcatctgcccaagggcgtccaccaggtgacctcactttgcttcctcagatttatcctctgatgtggccctttcattttctcttcctgaatttttctctcacttgtctttcattacattctcctggaataagtgttccttctcgtaattcaaatgtgagcctttcgccagaactcaaagttcgcctttcccagaccttacaactgtttgctaccataaaattcaccttttctttgagattttcagcacctgtaattatggtatattttacttaagctagaatttgcttatacatggccatactatatttctctatttgctgaataaaccaaatctctaaatatttctttggttatttgcattcaacgtgcttttctatataggaattcaaatgatctccaaaacaactgagtaagggaggctaggagaaatgattatgtttgttttgccactgacgagattacacacagagaagttaactgcctatcacaacagcattgcctgccctcaaatggcaagttagggcaggtgtcaaaatctcttggtcattagttttatgctattattactgtgtcttagttcattccaggacctatagcaaattacatttgtctggggatttttaaacagcagaaatttatagttcacaattctggagtctggagattccaatatcaaggtaccaacagatttggtatctggtaagatttgctttgtctctgcctcaaagacggcacctccctgcagcatcgtcaaagtggaaggagaggcaagagagatccctcaagcttttttaaaggtgcgaaggtcgggcgcggtggctaatgcctgtaatcccagcattttgggaggccaagtcaagggattacttgaggtcaggagtttgagaccagcctggccaacatagtgaaaccccatctctactgaaaatacaaaaactggctaggtctggtggcaggcacctgtaatctcagctactcaggaggctgaggcaggagaatcgcttgaacccaggagatggtggttgcaggagttgagatcgtgccactgcactctagcctaggctacagcaatgatactctgctcaaaaaaaaaaaaaaaaaaagtgctaataccattcatgtgggtagaatcttcgtgacttagtctcttcccaatgaccccatctccctgcctctaaatacgaaccacatcagatattgggctccaacattcaaattttaggaggacaccaacattcagaccacagcgcactgtttacaaaaatataatctaagcctgacatcaaaccttgcagtaggatgtatgttttgttcacttcagctactgtaagttacaaatattctaacacacacacacacatttctcatatatgctcagtgaacaaaagaataacatacatggtctctaattcagattttgttttcatttcaaatgttaaactacccagaagagaattttctactagtttttctgcttaaaaattctacaatcttctattattcatgacgaaaaaaaaaatcagaaaaaacagagtttaatttcttccacttctttcagtttcaaagattcgtatgatgactataaaactgacacgtatcctttagaagcttatggaaaaatgacctccagaggtttagaggtctgattctttttcctgaggctgcagtctaggtttgtagaaaattcataaggcagaaacaaacagtaaacaggtttgcaaatcttagtgaagatgaatgtgaagatggcccagataatatttaagtaaacatacaatattttcacctgatttttaaagctgttgatattttaaaaaaaaatgtgaccagcatttatggatcacctttaatattataggaaatctgctaaatgataaaaacagaataataattcagaaatactccttgctcatacaaacccatagactgttgttaaaattaaactcctgtgggaatcataactcaataatttggccaatatttgttgagctcttttcctatgagaggacagttatggttatgaaagacgatgcatagataaccacagaaggggcaggtatatacatttttaatcaaaaggtgcaaagatgaaggtgagaaaaagcatgagaagaaaggaatacagtatgagaaggggttaaggaaaagagggaggaagacactttttttattatactttaagttttagggtacatgtgcacaacgtgcaggtttgttacatatgtatacatgtgccatgttggtgtactgcacccattaactcgtcatttagcactaggtatatctcctagtgttatccctccccagtaaccccatcccacaacaggccccggtgtgtgatgttcccctgaagaagacactttcgactgatgaaggtgccctactgggaggttggaacattatggtaattccacactcccctcctctcctagtaaattaaactataggcaccatcgtggttaactagatgttattatagctcttcagggtctaaagagctatttgttatacagaaacatttcctagacattttcctagttttggccagactagaattaaataattaatttctttgtatacttagtaaaacaagaagtattgctctacgtggtctcggacttctgttctgggtgaacgagcagcttttccttccagttttggcagcatgacatcatctgctttagtctggttgaggtgctagctaatctcctaatttgtcaagtaagacatgctttgattctatttctcggcatatgccaacagtgttactttggtaacaatactccacacactattctggcctcactttctcatcatttgttctgtgtgtgttccagctcaggctccgattccttgggtgtagaggcacctctgatatttaacatcttggaaaatgacagacataagtcatcatctctgtcctcaactaccaaccaagtagggacagtaagttacttctgcctcacatctcagagagcggtacttcaatgtgacatacgcactcaatttttaatctgtaaactctgaaatgctcttgctggtatgaaactgggtttgcaactgaacacattccctcagtccctgggctccttgcacagctctgcctgcaagcgagactgtgagggctcagaggcagagtcacaggtgctcttcagagatgggaggtgctctgggaaatcagaaaagggtgacaatagtgggggaaagagttgggggtggaggcaatgagggaccaagcaggcacgtacagtgggaagccgcaggagaattcaggtgcctctcatcagcaaagcgccaatgtgttattccttcatgtatttattcacatcatcgatgaaattccatcagtcctgttaagtaccaggcactgttctaggttccaacggagcagtaaatacaacaacaaaatctccattcacagcttacatgctaatggagtaatgctatttgctaggtttccgtcatatttctctaaaataagtgcctctttttttggtatactgtaaatacccttctcacattgctccatttgagctggaaacacgtgttatagtatactagaattataaatagcaatatttacaagtaattgtcaaaaccacattaattaactcctcatgtttccctcgtgtctgggaatgtaattaaaataatgaaaagtgaaaggaatttcaccatcatctgtagtcatgttagtgagataaatcgccaccagaaaacacagtaacacttaaaaagaacaagtaaaatgtctttaaaaattctattcatgagctttcttccaaataaggattacattattccatatgtaagtgtttatgaatactctgaagatataacattaaggttttaattcacaactacatacacatctaagcctaaatgagtaaagcattattcctaattctagttttgttgccacagattttgaataccatttgtaattacctataaacaacatttttaaataaatacttcttaaaaggaagctgctgtaaaaggctggctgaaccctggggattggcatttctgtccttttactggaatacagaacattcatgtatttcatttaccattgcttagctcatatggtttagtaaatggaagcgtttccaatttgattacctgatatgtttaaatagtgtgtgcttgtgatattaatattttacacatttcctgttgggtgcctgacgtggtaaagcatcatgatctaatgtgtacgttttggtctttaaatgacctttttagttctggtgatgacactagccactgaaaacaccttatagtctcttctttccatccctcaaacccaaagtcactatttggaatgtgattcaggaaataataagcttataagatttctatagatacagctgttctcaaagctattccataaggtagtccttggccactacaaagccacagggattctcctgatggtacaaacatatgcaaagtgaggactctttccttcaataacggctcacaaatccttaatatgaaggacttcaaatcggtattaatcaactaaatttaccatgttactaggactccagttctgctgcaaatcctcctgcaagacatggtgatgttttcatactgccactggacatatgcatgtatggatttgtaagtaccaccattttcatgaaaaaccattttgcttataccataaaagtggtgagtcagccaatatttttaattctgtgcattaaattaatgcacttgtagaattgctatttagtttttacttttccaaccagttttttaaaaatattgtaaccattttgattgattgattttttttctactatactgtttttccactgagtggtggaaaaaggcagaatagttcactggtctttggtcttgtcaattgtatatatagacaaaagagtgaattaatgcatgaataaattagtaactagctagctagtgtaagaagcaagaccataccattacatatcttgaatataaggaaaaccatgaccagtctaatgattaccacaaacagtagggtagcctaggaggacagactggatgtctcttctattgaactttataataccccaaatttccattcttttcttttaaggatacttactcaggagtatttgcccttgagtcttcctggctatggtttaaataactaaacaaaatatatctgacctgctgaagagggtgtcagaataaaacagatatgttttaatgtgtcccagacaacagaaggctagtgagagacgtctaatcctctaatgaactgtgtggatatctgaaacctaaacaaaaattttaatctatacatatatctatatatttatatatctatatctatgtatagtatcttggttaatcttcacagaaacctagaaccatgtactacacttaactcatgcagttgttaataataatagctgcttatgcaaacactggcacaggaaccctcctcccagggccaggcagcttcctgtatatgtggagtatgactcacattccaactgaccttccctcaattctaggcctccatttccaggattgaagaagcatggaccactggccagatcttcctgaaccgttcccaagactctgtgtcacctccgcctcctgcctggacacccttacagccaatctttgtatgtcttctctggtgtttatgtcactgtgggagacccaagattctcaggtcacacacctcatccttccttctccaatcctgatttggccctgcaccctgatctgtccctatcacccattgccatatctctcatgatgcttaattccttgcatgcacagtatttaaattatcctagcactttctgcttggcagaaatcacagccctaattccactccactctgctgaaccaacacctggtgcagttggatgtactgcgcctgtagaaaaaacccagaacgaggatgggggggcatctccatttaactttatgaccattgctctgaagtgtgccttttcagtcgccctgcttgcaggagagatttcattttcacccggagacatttattttttgccttcctttctccctaaagtctccagtagtgccatctgcaggccacaggtccctgctgtgcagatggtccacacaagggcagctggggggcagctgtaagccgatcccatgccacctgcatcagccaaaaggaaggggctctctcattcaacagacacaaagaacacttaccaacaccaccaattcccaaatgcgtacctgcagcctgaaccctgttctgaaatgtggatttgagggtccagcagcccactcagctcacgcaataggacccgaacctcacatgcatataaacaagttcctaatatttctcctcaaactcatacctctgcaatctttccatctcatgaatgcagcgttatccttcctaaaagccttgggggcactcctgaccctctgctctctcaacccacatccaacacatcagcaatttctgttcgctataccttcaaaatataagtagaatctgatcagtcgtgtttcatggccaatgtgctcatccaagccaccattttctcaggctggactgttaccatcgtcttctaattggtgtgcttgcttccatctttccaacatcctccctggctaacaccccagagccaaagagactccattacaacctaagtcacataactcttctgctcagatgatgccgatggctttccagctctctcgaagtaacagctgcaagcatatttacagtgccctcagggtcccttcgtggctgccacgctgacatgaccttagggacctggtgtctagtgtcactctccttgttcacaagccaagagctccagctccacctgtctccacaccgtgccctgaaatacacagatgtgctgcaccctgaggcttctgcactaggccctccacctcggtgtttctctgatgctctgcctagcactgcatgccttcactcaagggtctctttctcaaattgtgacacaccacattctccttctctgcttcatttctctccatggcatgtatcacctgtggctatactatatcctgtataataaaattatataatacatagagactgataggtctatgaaattgacttattttgtttactccttttctccaatcctgtcctgccttcataaagcgtgtctcaccttagttttaacttgcattcccctaaatggctagtgaggctgaatgcgtttgatatgcttaacaatattttatcatttcttcctgagagtgcctgacttggttcacaggtagatataaacctatctatcagatataaatagtgagagaaaacatgcactttctcaccgctgagctaacctggggaaagttctgcctttctagttgccacaggaggaaaggtgcacaggtgcgcgcagccaggagcatgtggggaagctcatcctggcaggacccaccccagcagaagcactagcaggcaacacggggccaggggtttgatgtcagggaaggcaagatgggagcttgccagatttccgtatcaactgccacttaataatcacattccatgcttttatgaattatccttactgatctaattttgtatcagtagtgcttgaagggcttaaaggaaaaactagccctttccttaagcaaaagagagtgagctagctatatgtcatctatatattttaaaattacaataataatacataactagaggaaaagtgtaaagaaatacattaaacaaaaagtaggcgtctcttcattgcttaactgtaagcataccctctgggtataatgattattaagttatctactaataacatgcactctataaacaggtagaataaaaacagagattacacattattttacaatttgaatcttggttaaagaggttcttccagaaagtcaagaagaaaatgtcaaccatatttctctttctagcaaaattaatagtacactgaaattaagattattcaactgtgtaaacgtgttacataccaatatttccacattatatatcctcagattttatttttatttttactatgatgatttgtagcacatatgtaaaaagaccagtgccttatggatacctcttttttcccccagctatgcacatagcactccatgaaacatttatatgcatatatctttacatgttggtgggtatttctctcaaagaaattattagagttgaaattgagggattaatgtctaagaaaaatttaccgtttgagagctatggtcaaattaccctccagaaatgtccagccatttctctccaactatttgtaacagaggatctctttccccaaactcttccaatatgtttatgaatcttacaggtgaaatgggatctacttatttttgcttttatttacctgaatattagagggatgttaagtattatctgatttatattcatttatatattctcctctgttaatgtcctatggccatttttaaccataaataaatgtatattaattagagctactcaggaattgcattcttattgtaaaacatacacaggagagaaagaagcatctccaacattaacaccattctgtcttaggttccttagatgcctgagtttaatgttccgtttgctagcttttcttcttttattgcatgtacatagctttttatgtattcataaatgtaaatttttgttttatattcttaaatataagttaattttttctcattcaatgtgttataatttttttaaaaaaattcaatacatataaatctccatctttgtgtattattccatgacttacgtatgttaagccttatttaacaattgtcctattaatagacatctagaatattttcaattttttaaaacaagtaatacctcactcatcatacttttatttgccttctaatgcaaatgtgcaaatatttttctacaatgtgtaccaaggaactatattaaaattagagaatacatattttagcacttaataatgccaaattactcttcaataaaaagctgcactgatttatactcctactagtagtgttggaaaatcacaacatcatagttgatattgacaactattatgtctcttactaaaataatggattaaaaaaacttgcattggtttcttcaacttgcattattttcctttaacatgcatcatttaatttcaacttgcattattctaaattactagtgaggttgaatttattttcatagacttaataaacatttgtatctccataatgaataatgcttgattttaatttttcttagtctattaggttattattattgattcataatttttatatattaggaatattagtcttcaaattcagattatacaggatatattttttctcactttaccattagtctcaacctttaatcttttcatacagaggtcaatcattttcacccaggtaaatgtgtctcaaaaaattgcttttgaaatccacccttctaacatttgagaatgtgggtaaaatggtggatgacataaagattaaatgtaagagttgttgatgtgaatgaagtgtgaagcttgtgaaggctattacacaattagcttgtgagccaagaactcccttctgaaagaaaataacaggtgttgattttgaaataaagataaaatgaattaacgtagccctaatcttctgaaaaacacagcctaagttttgccattttctatttgtgagctacaaacctgcactatttcctatgcaatggtgtgcagtgagtatagtggttaacacattattttggatacattatattgctcttttaggatacaacctgctgaaaggccaattcccttttggttttctcaaatttctttccattcttatttgttctttttctcatttcatgttgttttaacccgtgtttggatcctcagttaaattacagtgtttaatggaaatgtgagatcgtatacttcattctggttgttgtcgttgttgttgtttttagggaaaagggttcttctgtgaactgaacgtgtcaggtttggggtcaccctgtaagtgccatctggctcattctcagttctcccagctttcccccggcaaagtgccaggtgctgtgttggcaagatgtccctgcttcagtgactctcaactgttcattactaccttcctgaagtgtccagttaaaacgcattatccgaagcccactgtgcaaatgaaaaagctgtgggacaaggcaggtaaaatgtgctccctggtgcctgaactaggtaatgttctgccaggtcactgaaaggctgatctcaagaactgaggttgtctgtttcagaattgcttgatagagttcagtaaaaaggcattcatttcatgtcagtttccacaatccattcattttctcttaatttattaatgagtttatttcctgagcccttcattcatgaagagcctcgtgctacttagaaggccttgttctcactattaacagagtgaacagataaccttcaaaaccggagaaattttttgcaaactacccatccgacaaagatctaatatccagcatttgtaagcaacttaaacaaatttacaataagacagctccaaaaaaaaaaaagaaagaaaaaagaaaacagctgcattaaaaagtggacaaacaacatgaacagacacttctgaaaataagacatacatgtggccaacaatcatatgaaaaaaagctcaacatcactgatcattagagaaacgcaaatcaaaaccacagtgagataccatctcacactactcagaattgttgttattaaaaaatcaaacaacaacagatgctggcaaggttgcagataaaatggaacatgtatacactcttggtgggagtgtaaattagttcaactattgaggaaactagtatgatgattcctcaaagacctaaaaacagaactaccattcaagccagcaatccctttactggctatgtagccaaaggaacagcaatcattctatcataaagacacatgcaggtgtatgttcactgcagctctattcacaatagcaaagacatggaatcaacctaaatgcccatcagctgtagaatggataaagaaaatgtgatatgtatataccatataatactatcaagacataaaaaaaaatgagatcatgtccttggcaggcacatggatggaactggaggccattatctttagcaaactaacacagcaacagaaaaccaaataccacacgttctaccttctaagtggaaggtgaataataagaacacagggacacataaagggaaaaacagacactgagacctactgcagggtggacggtgggaggagggagagcatcagcaaaaataactaatgggtactcggcataatacctgagtggtgaaataatttgcatatcaaacccccatgacactagtttatctatatgacatgtatccctgaacttaaaataaaagttaaaaataaataaataaataaaaagcctttttctcagtattaaggatacagagaaaaatcagatggcctgaaccaacgtagcccttgattagactgggagaaagaaaagcacacatggtcacggtgtttgtagtttctggatgttaggaacacagaggagatattcatttaagccagactggctgaactgggggaggtcactgatcttggagacaactagatctgactttggattctgaaaagagaacagtgcagtcttgagggctgtgttggtgacataggtctgtttatacacactgtgcggctgtagaacttctctgtcaaattagcatctgtaaagctttccacttccctcccctcaaatttaggaagttctctgtgctatcctcaggctgggttctttcactgccctctctccaggaggcctaccccttcccctggggatgcaatctgctatgtgctataaagtgtaattatctagtgttccacagccatggagaagaccttcctaaccttcctgcaattttctaaaggatgaagagcatgtttattttactgttagaatgctcaaggtccctgtgtccctggaccacctgtactttggaaatacaggctgcgtaactcttatctaaagtgaggttttgaaaaattgtctgtatttagaactctttaaagacgtacttttcagtgactcctacagtcattataggttttatccctggatcaaactaagtaatcagaaaccagaaagctcagacttcagtgcttgaacttttacagacttcttttatgacgttgcattgaaacacatgctgtcggcgttcattgaagacatacaagcagcatcttagggagatgttgctgcctctgtgatggagatcttcttaaaagcatcattcagtagattaagtctcacatgtggaatatgttttttggtttccaaaagaagctgccatgtttttctctgtggatgatgaaaactctgcaagtccctcctacaacaaatgcgactggcgcccactgctcttggcaatggaggtgagaacataccatgtctgtgacggggaaggacagggtttggaaggagatgcagacattaaataggacacacaccaaagacggggtcaatttcggaggatgaataaacccattaagaaaacggcaaagggtggtgagatccactgcgatgctgcgcaccagtgatttgaataagacttggggaagaccttggggcctgacatttaatctgagagcttctaccatgaaggagccaagcaggatggacgtctggctgcatcatctcaagaagaatggatgcaagcacaaaggctggcatgagctggggcggctgaaagagcagaagagcggacacagaaaggtgcctggggaccagatcctagaggggcttcaggaacacattgtggggtttggaaattactcgatgtaaaatgcgacactggggaatggactgtagcgcagtggggaaggagtggaacagtgaggccattcgggagccaccacaatggtcctcatgatttgaattgagaccatagctgagaagaaggataaaaggcaatatttacactgcattaaggatcctaaactcaaagaatttgctgttctattaggtgaaggagaattagatactaagaaggacagtgagtgacgttttggcgacttctgcgtagacatggtctatgaagttatggattggaggagttcctgcaggagggagtgagatgatgtaggtgaatgggtggaaaagcccgaactgggttccgagggtcactggcatggagaggtggagaaaaggggaggaagcagccggcatggaagaaggaaagcaggagaggctccttcaggaggaatgttttattggagaggagtcccattgtgagaggaggaagaggaggaggaccagagtttcctcacagcctccggagcatggaagtgggtggtgaattccaggagagcagctctggctgaggtctagggagggggcagaatcttctcgagtggattgaggaaagaaaggcagtcaaagaaatggagacagccagtgaagacctcctcaaagctttgtggtaaagggaaggtacaaaaacagctgagagcttgagggaatttgcagatcaatcaaggattgccttttggaaacactagagtgtgttccaaacttggtaggaaatcacaagcaaatttccatgtttctctttatgaggagatcaatgggaagctcggaggcaaatttatggagtaactgtaaaattgcgaagggccacatgtcttacatttcttcctacagttctatttccagtttttataccctttgatcttaatactgcattttaattacctattttgaaatatacttgttgtcttttctatatatttgttttcttccttttaaaaaataagttaaaaaagcaagaaattaacctctggaaaccagtgacagtcatgttttgtgaaggaaactcatgtttgaaaggaggggaggggaaaactcctctcacccctgatatcgctaagccagacgtttaaaatcaaatgcattcacgtgttgttttatttaccttagaagtttttagaattagtatgggaaaaggtgatgcacatttcaaagcccaggatgactgttgtgttagttttcatgtatagtgttgtcctagagtactcaataaactttcctgtatttctaaagaattctgcacttagaagcctggagacaccattctccttttattcctgtctcttgttggagagtcctaacagaattgataaaatatgtaagtgtgtaagtgtggatgtaatttattaggagaaatttattcatatttattcctaaaaaattattaattctaaaatgaggtactggctttttatcatgcttcatggtattgtttttgtttgtttctttgtttttgagacagagtcttgctctgttgcctggggtgaagtgcagtggtgctatcagtgcgcactgtagccttgacttcccaggctcaagcaatcctccagccttggcctcctgagtacctggaagcacaggcataggccaccaggcacagcaagtttttaaaaattttttgtagaaacgaggtttcaccatgttgcccaaggtggtcttgaacttctgacctcaagtgattcgcccgccttggcctcccaaaatcatgcgtgggattacaggcatgatccactctgtccagcctctcatgcttggctttttatcatgatttatttagaagcacaagaaataattcataagtcataacacagatctcaagcaataacatactttcatatgaaatgtgagcattttcatttcgtatagtgtttttttgcctgtcgtaaccacaatgtcttaaggttcttacaagggagattcagcctgaagtagtgcaactcctcggtgaagcaggcgaattttgcactttccccatcccttcctctacctttcctacaggagaagtgacttttggaagaaggaagtggacactgggctcagcaccccacactgcttgctttgagacctgcctacagtgagcagatgtcctggtgtggcccttgatgcgtggtgaaaggaaacttctgcatgctgggagccctccaggtgtccagctgtgtccatgatgggggaggcatgtgctcttccatggctacctgccagacatggctgcagaccgaacccacgttccatacaggctcagaagcggagtctagcgttccagatgaattctcttaatctagcaggccctacagctctctcaatttgcttctaagacgagggaggaaatttacttatggataccctcaagcttcgatgttccccatattcaggtaaaggccagagaaaaaaatgagctcttcagggttacactgttagatctaacaaccagaatccacaatttctgcccagttcatctactccttacagtagaatgtctattttcccctgaataagggtctgagcacatggcttgtacattttatatattttcatatgcagtcacaataaaatagcaagtttgaccgttaataattcactttgatatgtaaatctagcgttagcatggcatgttaagttaaatggaacattatcatggagattgtatatttatagaactgacttaaattttgtctaataatgacaaacaaacattactaaaccattcagaaggaaaattgtatcttcaagtaaatcattttataggtcgtggccatgacctaaagctttgtctacatcaaggtcatgcaaagtttttttttttttaaacttaaactgaatgtaaatgataaaactttccaaagataaaatgatttattagtacctccatctaattacatattcatgctgggtggtcatgcattgaacatttgctatcagcttctgcctgtcttccttcctccttccctgcccacattcctttccttttgtctttgtacattttttgcacgagagattcaaatggagaattccaaattttgtagttcagggataaaactaatatcaagtagtgagaagtcgagatgataatttcttagattatatacaatttccaggaatgggactaaaataaatcaatctcttctcccagtgtataatattctctacactattctttaaaatattcttacacgtgtatcttctttatttgatacacgaagaaaatcctggatttgcctctaagagtctcccacattataacaataatatcaacaatgataccagtcttgcctttccagtgtaaacatgaacagactcttaaatattaactaagtagaacacaagctagctttttaatatttttatttatttaaaaaatgaaaaaggaaattatatagataggaagtatagaaaaaattgcgtgcattatttcaaacatttttaccgataaatctgtaagatctatctctgtttattgacagaaaaatctccaaaagacccaaataagtagtttcatattcaactagtctgagttgctagtatgtctgatgcttcagtgagacactgtgtcatgggaaatattagacccttgtactttatgttggacagttatgcttcctgagtttgtgcaaactttgagtaactataacgacgaccacaaatccagctttccatatcttatcaagtgtgtcctggacacaaaccataataaactgactgagcttaattattcaccaatatcacaagttatatgaagtctcagagaatgtacatgacagaaaataactttaatatatgactaagtttttaaaatcatgatgcaagcacttcaagcaaaaaataatatattagtactaataatttagtatattttacctctgaagtttggatagttctctaagaacagggatagcatctgagttattctggggtacccaagcatgtagtcatcttcttgaatcttaggtgttcaaacaatcattttgttttattagtactatcaaagcctggagcaggtggtggtttattacagcacacttctctttgcctagaaatatacaggtatgtatttatacactatacctgtgtatataggattgtatattacatactgttcatcaatatgtatcaatatcaaatgtatgtcaaaaatgtcctgcagccaaatctaaatcattacaagattattattcattagaatcatctaaggaatctctatagacataaagtattcatacactgtagcacaagccaattaatctggaggaaatgaatcagtccggtcattgagaacaatgtcccaggtttttgcttctcgttttgcttagaaatgggacagagaccaagttaccgtgagagcaaggaagatgtagctcctcccccgctacagtctactttgtcattctctattgatattaccttaacaatcacatagctatcagaatgagatttgcttttattaactggtttcagaaatgaaaaagcacaaacatctttttctgtgtagacaccaatatttcttgacgtcacatagttctcagaaaaaaatgaaaggctaactcctaacctacatagaaaaagtgttgcatgtggactagcacgtttttctatgaactaacattgctttcagcttcagatatttgtcatttatttcgtgtatagagtgtgtaccggtgtgcgtgtgcgtgtgtgtgtgtgtgtgttgcgttttagtcttcttctggtgtggatgttgtattcacgtttttatcccctataacgaaatagtgcttggtatgtgatacgacttactacatatttatttgatgggttagaattgtattaagatggactggtaattttgattctgtaccgaagttactgactaatgtaagtataaaatcctcgaagattataaaagattttcttttttttttgactgagaactcctaacctaacaaacgtattactaaattcatttactgtcacaagtttctactgtgactgctagtaccttcgaccatggtacagaggaaattggattcaagaatagccaagaggagcagttagggaaaataatgcaatttcaggtgcaattctatatgaatcaccttctcttaacattcatgagaactcaaattctcttgctctacatgctgatattagattacatttttcaaaaactatcccattattactgcatcgttgttctttattgttaattgacagtaaacaatatgccaaattgccatataaatgaactgcctcatgaccaaattagcttcagtttccaggatttgagtgatatttatgtaaattttaattcttgagatatctcgctgcttcactttatttccttagagttataaataaaatttgattttctaaagccacgtagtttattttactaagtgcttctcagtagcattgtgaatagccagttatcttccactacacaaatagtactatatttttggattctccattttaaatctaggacatacatgtttcttaacctttcctgtaaagtctaaaaaggaagaaagctttgcacacgtttcccaaatcctcagctccaatccttaaataagcaaaatatattaaaattatattatacagctattatccaaaatttgtctcacgaaaaacaatgtattttcttttagatggttggttataaagataattcctaaaaataacgtaatgacctgcgcatttatattttttctaatacaaatttttctagtcctccttcgtgtaccattgaaagtaaacacaatgttatttaccaagtattacattggatgcaaaattagtatagaaaagacaactgcatttttaagtactagcaaaggcaaatgaagatcaaaattttaaaaagaaatcatttacaatatcaataaagcctcaactatctatgagtgaattcaaaaaattatataaaaaactgaatgcacgaaatctgaaatattattgactgaaattaagaagatctaaaaaatgcagatatgtgccatgtttgtacattagaagacacaatattttaaagatggcaattctctacaaatgtattatatagattcaagtcactctcaacccaaacctcaacagagttttgtttctttgttttttgcttttttttttcactaattcataagccaattctaatatttccattgaagcaaagaagactgaatatatagatatataaaaagcaagttggggccgggtgcggtggcttatgcctataatcccagcactttgggaggccgaggcaggcagatcacaaggttaggagttcaaagaccagcctggtcaagatggtgaaaccctgtctctactaaaaatacaaaaaaattagctgggcgtagtggtgggtgcctgtaatctcagctactcaggaggctgaggttgcattgagccaagatggagccattgcagtccagcctgcctgggtgacagagcaagactccatctcaaaaaaaaaaaaaacaaaaacaaaaacaaacaaacaaacaaaaaccaacaacaacaaaagaaaacaaaaaaaaacaatttggaaaaaaagagaaaagcagagcttggggccttacactaccagttatcaaaatttactccagaaattaattacttaagactctgaatggtcgatgcaaggaaagacagctaagcaaagggaagaacagaagtgagaagcaaatccacactgctcagggcaaggggaaaaggattgacttctccataaatggggctgggtcagttgcatgttcatacagaaaaagttacctggattctttataattccacagagattacagatctgaacttgaaagatgaaacaaatttccaataaccaatcacgagagaatattctacgatgtctgatgatgcaactatttttaaaaggtattaacaataaaagaaaaaacatatcaatagtctaaacatattaaatttaagaaattctggtcaaaccattagccagaaagtgagaaaaaatcatcacaattggctcctccaccaagatttgtgtacagaatatacagacatcttacaaatcaacaagaaagagagagacaacccataaagtggaaaaaaaagtaattgatttgaactgacacttattagaaaaagacaccaaatcatcaatccaataaacacacaaagtcattcaacttcattagcagtcagataaattcaaataaaatctcgacgatgacagaatactgcatccccactagaatggttaaaatacaattttaaaaacaggaaacctgccaaatgttggttatgtggagcaactggaaatttcctacactacggtggtattacaaatcagtagaattattttgcaaaactattagactctctctgcctcggttgagcacatgcatacactgtgagtggacgatcgcatccttaggcatatacccaatattcacccaaggctagaatgttcatagtagcactatttgtaacctttgcaaactgaaaattatgtaattgccctcagggatataaataagttgtggtatgttcacaaaacaaaatactacacagcaatgaaaaggaacacattacaaatgtgcacaacaatgtaggtgaatgtcacaaacataactttgtgtgaaagaatccaaaagcaaaacaatgcaaaatctacagtgtcatttacagaatgtgtcaaaataggcaaattagtcaatgctgtcagaagccaagagaatggctacccctgagttgggactgacgatttcaagagcatgctagcatcttgtgggagtaatgttctgcatcttggccttgtactgaagtttcacaaactctctgcgaaagtttgttgactctcaatagctgatatgtgcacacttctgcatgcatattttatcctgaaccaataaaacgcctgaacatatctaagagccactgacataaatgtgtcttgactatttactctaagaattccctaagaatccttagtgtaaataacaaaataaaaataaccacatcatacttgcaagctcaggccttggaattaaatggctgggtgcaaatgcaagaaatgcaatttactagatacgtgtccttgaatgattcatttgacctgtaattttcctcatattaaatattgagataaagtatttccagctcacatgtttactgtgagaactgaacgacataatataatacacacaatgtcctggacactaaaaaagtcaattaacatgaagttttccagctatcgatttctcatagttttaaactgggtgtatgtgtgtgtatatatgtatgtgtgtgtatgtttgtgtatatatgtatgctcgtgtataagtgtgtatatatgtatatgcacacaaatataccttttcactgctcctttaaatgaatcatgcggctttatgtactatttaataactaaagcagtgaactgatgccttcaaggaatagtttgcaaaaattagtgttattatttatttgatatcaattaatatcaattattaaaattgatatcaattactgatattattaatttacactaacttctatcaatcatgtaccatgtattatggcatggttatgatttatggcttgaaagtgattcattgaaacaactgaaaccagtcatcttaaatccacagggaaaaagcagcttttaaatctacttaaacaatcccattaacaactactgatcagaggaatgaatgcatttaacaattttgacagaaaagaggaaaacaatacggtttttcatatgtgtatttaaatataaattaaatatatgttaaaatatatgaatataggcatacgcttttaaacatacatagatatagagtgtgcacatactaagataaacagacacatttgaaggtcagaatttgctaaatattttagttttcatgcaaaagataacattaacttctctatcagtgtttcaaaatcattattttccaataaaggtaaacagcgaattgaaaagtaattaacaatgtcagtttcgaatttttattcctaagaaaatatttagggaaaaatgaactcaggtggctttaaattcactttttaaataggtaagtttgtttaataagccttccattatcctttgatacgcctctaatggcaagtctaacctgtcttcaacttaacatacaatggccacttgtgtttgttatataaaacattatatgtgcaatatacaaacttgcataaagtaatcaactgattccctagagaactgttagtgacatggtgcttgccaaaagtggcatcttctagcacaaatcttgttacaagggacacagaaagacaccagagaacaaaaatctcaactgccagcctgagcagggccccgcagtagcataacttcacacctggattctcctccttcggggtcccaacactgcagtcactcaggactctgatatacctgggtgtggaattgcacacatacacatggaaacatcggtgagaagtcatttgttctgatttggttaaacaaaaagacgttacttaatgttgaccaataaattctggatattcttctcttttaaattataattttagtactaactcaactgagaaaatgtccatgattggccttaacttgtataaaacctgtgagtaaataatgattctaatcccaatagtattcacctctattgtgtaccttttggtacgctacgcaaggagaatctctacttcgtcgtcagtctgtgtatgaaaatgccaaggctgagaattttgctaccataaaaattataacttttatattaaaggccttctaaatatatatatatatatattcatatatatatatacacacacacacacattcagaaggcatcattcatatatatatatatgcacctatcaaatgagtaagctctgaaataaatgtacctagtttctaatggacctagtgtctatgattctaccatgcttataaagcaagtagcttctcatatacatgcttatcagatacatttgtcgaaactgtgtacctcattaacaagatcccatctcgtgactgtatcagcgttgagtttattaagagacattcacagatcagaaaagtggaagatcccttatgggagactatttattagtgttcacagaaaatcctgaaaagcctctagcatcagacaggtgtgagttatagaatcaatctgaccttttcaggggtttgtcagtatttattggcacacttagtgacatttatattgttaaacggttaaacgaaaatataaaagcttgaagctgccaatggagtagttatgaggacaatatcccatcacaggatgctatcaattatttgaaaaaagctgaagtacaaatttctgcttttctcagagatgaaaataaactctcgaaaaatgtctctagatggtctgttgtctcagaatactagggaaaaaagaactgttgctccacctagtaatgaaattaggcagtcatcatccaacatcagaatcggctatgatgagcgtctgctcctttcatttcttgctttctgttctctattccccctcattattctctccatctttctcaagctcacagaaatgcacgtgtgagctcatgaaatttcaggcactcaggaatatcagccccttctccatctcacaaacaaactggagtcaagtttatttatgacagaaagctgactttcttaaacaatcagttctagaataaaaatgtgtctgacctggcaaacgtctctgtgaacaaaacaatttgctcttttgctaaatttttctaaataggagtaaagtttgttgttaatctgtgaataaatataaattgttaaaagttgataagttatgggcataaatcacaacaaagcaatattgattcaaattatatatatatgtgtacatatatatgtgtacatatatatacatacatatatatatatacagacacatttattattatttttttgagacagactcttgctctgtcgcctatgctggagcacagtgctgcgatctcagctcactgcaacctctgtctctctgtttcaagcaatctcctacctcagcctcttgagtaggtgggattacaggtgtccaccaccatgcccagctaatttctgtattttagtagagatggggtttcaccatgttggcctggctggtctcaaactcctgacctcaagtaatccgactgcctcagcctctcaaagtgctgggattacaggcgtgggccactgtgccaggcccattatatattttttaaacaaactgtggtggcaaattggttgtgtgctagttgtggtagcagtgatttagaatgtaatcgatttaacatattctttacaaggccagataataaatattttggttttgtcagccatacggtctctgtcacactacccagcagtgctgctgaagtttgaaagcaggccatggacagcactttaatgacgaagcgtggctgtgttgcaggaaaagtttattttccaaagtccctggagtcagatttggcccataggctgcagtttgctgagtagtgagatgtatcttctaacaacagctactgatgattcaaaacctactacatgttagacacttatggaagtcttaatctagtgcctctaagatggctgtcatcagccctattctctgcaggacacagacttagggacagatatactgccaaagattacagaaggaaggagggtagaatagagatttgaacacagatctaattcaaaactttctgccctcaatggctacactatactggctctcgcatggtaatgattcactgagcataaacacagccaatcatcaggggactcaggtcatttttcagtgaaatgcatgtcttcagataaatgcattatgaacacttagagaagcattgatcacctggtaccacatggacttcagtgacctttcaaactctgcctcacacattttcccacctacacatcaagacacaatcccactctagctgagctctgaaaagtagagggtgggacttctaccaaaactctattgtgtgggtgaggatgatggcatgcgtagagggtattccagctgctgaagtgttcaagcgcccagaggcaatcagcgtcaacaaggaacatcttagccatgagaaggacatcaatgttcttgcacagcagtggtgacacaaccacctgggaggcccacggtacatcctccccccatcgccaggtgatagtttctgagacgttttcaggatagcaataaaagcaagataaatcaacagctctttccagatgtatccaagaacaagttaccttctactctgtctgaaatgtatggacaaattatagaccctatccatgaaagtggggctaattttgttctaggcgtccagttctcacctctggctgaacattagagttgcctgtttttgtaaacatgaatgtccagaccttaatctcaaccaattaaattagaattcctgtagagcaaggccaaggaaattatgttttaaagctccccaggtaattctaatataaatagagagttgagaacactgttccacacctagagttaagagacaatacctatgtatctgagttacacagaggtcacaggtttggaaggaaatagctttgatctgtggatagaaaaaactcagattactgtaatatctccctaaatgaactgagtgtgtggtatcagaaaaggcattttgcctctgtctgcctccgtttgttcatctgtgcaaggaagaaactaaatattcgaagtcttattcatgcttttatgtagagtgaacaaaataatgaaaactcagttgacatcaattacaatcaggaaaagaatactttcaatagcaatacttaagaaaacagagaaaacaagcttgtcaggattcttatctggttattaaaggagtccaacttctggcagagaaattaattaaacgtacaaaagatattggaaaatactgtacagttatcacttttctgcaatatcattaattaaaaaccaacgctcctttgcctaagtgggataacatggataactaacatcatttgtatgcaatgttcgtcatcccataaaaattataacatacctgacctaaaaacttcaaatcaaaacctagacataaagttagaggaataagcaaaatgtgatgatctgctaaatacacccaaatgccaaacccttgttaacataagcttgacactttgatcttcaaggcaagcatttgtatccaaagtcaaaggatggtgattactcagtcagatgagctctaaacaagcttcatagagaagcctatttcattctatacggaaacctttttttaccttaatgcaaggttcatgtgcaaatgcataattaaaaagaagcgccatttaggagatgattatcattagctcaaatgaaacacaaagcgctttgctggctcccccatctgaccttgtcatgcctcttgtatcaagtaccagctggagaaagctgagctaataatggcccagctgcataatctaacaagatctttgtcatacaagcaaggtcaagtgctctatcatgttgagattaatctcattgtgcactgagagagaaagaggctgccgggacagagatggtgctgctggctgaagaccttattgagtcccagtctctgggacaacaaaccgaccttccaaatggtccttccatttgggtccttccaaatagcccttctaaaatgagctaagaaaggtactattctagaaaatgatgccctctgtctataaatgtattctatttctgtgacttcaatatcaatgatgattttcgtcatataattaaaagcatatctttataccatttaggtttatgtgaagattttattaattgtattatatttaaagaaactttatcctttatgaccaaaagtacttacaaactcattcaattaccataattgccatttcatacaattcttaaaaggagcttaatatgttaactatcttttttctgctggtgaccaattcattggttgctgcaagttagaagttttactcccaatgattcagatgaaaaatcagtgtttagaaaacaaaatgaagtgtgacgatgcaagattcgaacaagactaacttagcagcagcaataataattaatcaaatttaataatgataaattaaagagagatttcttaaatgtttttctagaaagccattgccttttttttcagaggttaaaaggaaaagaagaagagacgataatctgccatgtcttatggtactaaaacaaattttgcttgtattttttaaaattttaatattttttactaacattaaataatgccttccacattgtagtcattagttgatatgcttctgatctttccatatatatatatatatatatatatatatatatatatatataaaatatgctcattaggtcatgatatatacatatatatacatacacacatatgtgtatatgtgtgtctgtgtgtgtgtatgtgtatgtatacatatatgctcattaggtcataagttcactcagctgacagtgtgaagaggaaatcaagatactggaagttggtcctatctactgtctatctgcaaaatgaaactcaacctggacttcctataaattgagctatggattttgtgaaacagacttattatgtatagtatcaccttaagcatatgaaagacatagagaattatataggtatcccatactcttctgttgcaaattctttatttctcttttgactattttgtattcatgaaataaaatattaccaaaggtcaaaggcactgaaatatcaaaattactttctgagttgcgcataatgccacatgcccgtagtctcagacggttggatggctgaggtgggaggattgcttgaacccaggagctcgagacaaccctgggaatatagggagatcccttctcaaaaaatataaacatttttttaaaaaagtttctgaatcccaatttatcattgcatttgtgtgtttttattttaggacaaatgagataatctgataatataactttgatagtttattattgggtgtatggactagtgcttcttttgtagcattttgataactaaagtatcatattccctaagaagaatacaattttacttttaataaaagataagaaatattcttgttgttcaaacttgcaaagaaacatcagatattttgctgggttttgatttacttgaaaaatattaatattaatggagaattgcacacttgaattcaacaggcactgggcagggtttactacttggtaggtattttaatagactgtggaaaacaaagacaaaggggacatcagacgccacctgaacaagctcgcagtgtcttggaggagactgaggattccagctgagtgagggaagttttgaaaatgaaggaaggcattgaggcacacttgcaggactcggtggggaacaaaataactctatctctcaaaggacaaaataataggtaacacataaggtttttatgccgatttcaggaaataaagcacgtggcatatttttccgatttcagagaaatggagcatatttctagtccccaaatttaataaaaccgattactccaaatgagtcctgccccagaaaacatttaaaggaagatattgggagcatgatgcaagttagcatgtggctctgttgtctgtgctaatgtttgagcaaatttttgtcctcagacatttccagggactaaaatatagtaatatctgtttaaataaaatgctcatactcagtaagtatatacaatgagaggatgaaagagcaagatttcttgagtgtgctagctactctctcataggactatgtgctagctactctctcatacgactctcatacgactctctcaataacctgtgaaatggatgttatggacattttatagctaaggaaaatgaaggccgtgaaataattgagcagcttttttgttttttttttgttttattttattattttgagacaggatctcactctgtcatccaggctggagtgtagtgttgtgatcttggctcattacaacctccacctcttgggcttaagtgatcctccctcagcctcccaagaagctgggaccacaggcatgtgccatcatgcctggctaatatttgtatttttctttgtaaagatgggtttttgccatgtttcccaggctagtctcaaaaattccttgctcaagtgatctacctgcctcaacctcccaaagtgctgggattacaggcgtgagccaccgcgcctatcctgagcaggttcttgaaattaggtcaattcaattccaaaatccatccgaggccaggtatggtggctcacgcctacaaacccagaactttgggaggccaaggtggcagaatttcctgtatacaggagtttgagaccaccctggacaacataacaagaccccatgcctaatcacacacacacaaaaaaaagccaatagtgggggtgtacacctgtagtctcaactagttgggaggctgagatgcgaggattgtttgagcccaggaggtccaggcttcagtgagctgtgatcacaccactgcactagagcctaggtgacaaagcaagaccttgtctcaaaacgaaaaaaaaaggattaactcagtctcctaacactagtctcccaggcagtataacactgactggagactgaatctctgcttcataacgtcattactatgtgatttaggcacatcaattatttctacaagcctaattctctcatctgtaatggtaatccattaaagcttgcccaaaaaaaggctagttactgacacgtttattatgtccacatgatttacaaaattatcagaacaccaaactcttaagagcaaaatgaacattttccagcgtccaaaagcacagcatcggctacttcaatattagcacacgatactatcaccaacatgatagtcgcaaacaaaaaaaaaaaaaattaaggaaagtcacatttgggtaaggttcattgtgtgtgtgcttttcaaagtttcctattcaggcaggacagatacataagctctaagataatatcagtaaagtgaaaggtaacagccccaaatatatgaggcatttagcctgcttccaatgtgtagccctattttacaaggttaaattaaagtgctgaggtcaagcatttactcagatacctgaacattcaataatccagcacaaagaacaactacacatcactcaacgcttaattgctgaaaagggaaactgtcttcagcctatgtcttcaagaagacgtgtggggaacgtattatgctttctatgtgttatcctttacctacacagatcatcaaggagaacttccccaaagcttgtgaagtgacaggcttcatagcccctcattcattcaggccccaactaagttctgcaagaggatctaagagaccgtgcatccaatcctatgttagaggaattttgcaaaaataataataataataataataataagattactctaagtaaaaccagttaaatctgttctctccccactcctactttcactctggtgcacgtcagtactgttgcttggcacgtcgtgggatttttggagactgggttcaaggtgaattaagtaggcacttatttgagtacatttaggcaggttttttttttttttttttttgccacttctgtgcattatgaagttattgctagccatcgtaggacaatttggacagtcttctacgtgaactcaggtgagccatgacgcccaagtgcaggttctgagaatgtgttccacgggccagacacagagcaggtgagtggagaggatggcaagcgttgatgtggacagagcaagaggcctctctgtgaaattaacttgaaggaagttttctcaagtctgaccacagtgataaaaaaaaaatatgacataacaatcatggttcagttttcacactgaaaataacttgtcaataatagtgatatggattaaacaagtttgaccaagtatgctggagaaatgctggaattagctttctattatctctgcaaaaaacatgacaaaatcatcctcacacaaaaaggtaatcaaagagtctttagccaaagctgcagtgaaaaaacatgttcccagggcacgtcagaaataaagtgactagaaacctcttaaaacacattttttcttcttcttatatttgtaatattttagcctataaaacaagtaatttgtgatttcttattgtaaagaaaaattttatgtcccaaactaataatattcacaattttatatatatatatatatatatattattttttttcttagagggtcatcaaaattgtatgaccttgaagcttaacaaaatctggatcaactcctgaaaccaatgaggacagtatgatagcttttgcaaaggataaagcaaaagcaaaaccagaacatttattacaatttttgttttacaaattaaatttataaatattatgaaaccaaaggcaaacgccactgctctacttcctctgcacctgtctagctccagtcccatctccaccattagaatctacttactgtgcatggtgtcttgctctcagttaggagaggtagtcaaggaaatgggcatgtcctcaaaacacaacaaccgcagcaaccgtggtaacaatacagccatcacaataagcattaacattcgctttgtaattgagctcattcaagaaagctatcttcagtaaggaatttcccctatagagagcatgcacactttgattttacctgttgccagactgaccctttgttcattaaaatagtaaaaaacacacccctggttggagatttaagatgttaatgagacatgcaattcatgagcaagcatgtacagttaccgcacgtgtgcacccagaggaccacccagaacttgcttactggcaacacctcttcccatctccttatgaataataatgtaaaactcccataaagggagtctccatagtgctggtcattgctgccacatcctcacaagcagcaagccgttaattgtctctttcacggtgttccgtctattctgcacctcacttaaaaatattctttttcctttgcaaaaactactctatgctacacttcttttgctgtgtgtcttttgtttgaattgttctaaacccagaagacaagaacgcaggtatcacaacagctgtcaacatctgcagtcccatctccacactgtaatctacttcctgtgcacctgtctcgctccagtctcatcttcaccactgaaagctttgctctggattttttctatcacgaggattaaatgggtgttgcaactcaaggggagacacatccttcatggcttagacatttccaaagaccagcataattttacgttttttcaagtaaaagaaaataatcttgaattatcttgagacctcaaatatagaactacaagtagttttaacatttgccaaattaaaaaaaaataatcctatgatagattcctcaaaagtgtacctaaaatagatttctacatcctattgatttgttgtctgtatggggctatttacagaaaataaatgctcagtgctaaggctaaacaagacttcactattaacctaacaagagagtctaattgaaaagttcattgatcctttttcctgcctccaactatatgaattagtttcttgattaactagaattactaaggaagtgtctctgcttccacatgtcaattagaagtgcatagggctgttaaatatttaggtgctctaattcaaattcactgacaagggtttgctctggctctattctaaaggaacattattttcacacctgtcttataaatcctataaaattacagtgggttcctagtattcaacactgtaccatacagatgacaatttccaatatgatgaatagggtaattagaagagtcaatcatgaatctcccatttggtatgaaagcagcttagtggaggccatttgtgaggtatttattatttgaatggtataggtggagtacagccagtggtcattataattaaacattcaaggacttcttaacatattgattaaatgtgattcatgaatcacctagacattggctttatctccaaatcactaattcagagacaccaacaaagtttcctgttactaagaaaatggatttaattaaaataattagtgtttaaaatgatcactgtgcttacaacaacaaagagatggtctactgctttctatttaaattatgtaaagtaaacctatctatgtttattaacatagatttatgtttggagttacaactgagacaatttataacacaagggaaatattttatatattaaatgaaatactgtgtgattgtgggtttctgtggccctattaacacaacagtgtcaatccacaatgtttaaatcttagcagacaaaaaagaaaaaatcaatattattaggcctattatcaatttaagtgtatctatccttagggaataaatatgatcctaaaaggatataagcacatgaaataagcatatatggatttacctttctaatgcccatatatgtaccatttagtaaagtctcaaaaagggaagaatcctatcctaaataattactatatttgagacacacatatttataatccaagtatttgtatttagttcctaacttgtcaatttatttgcttgttctttcacttatttattcattcctaattcagtcatttaagaaatatttcctacggtcataactcttcacactccagttgtacctgcagtgtgagccacagctctgacctggcttgttcccttccagacaagtcggatgggaatagtcaggttaacctcatcccctgaaactctgtatgcacactcaggtgggagaggcaccaaccaataggcactttaggtcccacttgtaaaagatagtcctgttaacctcccctattactgtaaatcattcagtgcagtgtggtttcttccagaaaaagaaaggaagaaatgactgcggagcgctggactcatgtagctgctgatttccatttacacctctgatggtaacttcctgatgggcccattcttggggcttgagtaacaagcccaatttgattcagtcaatgtaatgattaagacacaacaaaaacatgatctagagccctgtgacaaacatcttccaattctatagcctggttgctgtcaccaaaatttctcaaaacagtccttccagaacttgtatctgtctatgagtgacatcgccttgggaaaaatgcataaatgtatttccagatttccatatactcactttgctgaattagcaaaacattaagactaatagtccaaacagatgttaacaacagtgattaatcttcacatggaaaatgctacatgtaatgtctccaaaacgttgaacacttgggagagaaagtaaattcaataaaaggctaccaaataaggtcttgaatattattactattattattattattattattttgagacagagtctcgctctgtcacccaggctggagtgcagtggcgtgatctcggctcaccgcaagctctgcctcccaggttcacgccattctcctgcctcagcctcccgagtagctgggactacaggcgcccgccaccacactggctaatttttcttatttttattggagacgggatttcaccacattagccaggatggtctcgatcctgaatatgttttttttaattaagaaatatacgtaaacagcaagtatattgtctgagagtctgaattgatggtctgattgtgacatcaagtttgaaccaaaaataaatgtcaggaaaaaaattttaaaaagcgcttgtctatcacctaattctatttgatgtttggttctccaataacaacctctatctcacaaatcatgtcatcaatacccctaatgaaatctgcttaacatgacatcctagatagcaattctagttttccatttctcttgagcaacttacttgctccctggatctaatttttgtcttttattaagggaaattattgtactggaagtttccgaatgttcctttcaatactggatgtattcatgacagcactgaaatcacagagacccagtgtttttaaaacaggagtctgaatttcaacgagacaagggttagtagcacaatggtgtcaagaagttatcaaaacaaaggagtgagatgacacagcctaccctttctacagagacaacggtcatagtgtgactagcaattttaattatctacacttaagagctgtgtgcaggagcagtcaaatacttgggtcaggtttctcttataagcagtgtgctctaacagtgattcctacatttgaatacgtgtgggccaattataaaacaaaatgtttctcaaagacctgttattaacttttaattcaatttatgatcttaaagtcatgcatatataaactaaatttttatttatgatcttaaagtcatgcataaacttggaatgcttaaagcctgtgtacactataagttatataaataaatgcatacaaaactacctcagtaaaaaaaaaaaggctatgcattttaagtaaccctaaactgcaactcaaaatggactgctgtaacacaaattatcaccataatcgttaataatagaattattattatcaacttcctttatcatgcccataatcccgtgaggaagccctattaaagttactgcaaaagcctcctccatgaaacattctgtgatatcatttgctttcctttggcccagatgggctatttgcttcgtaagttcatctccatcttttttctcattagcctgaggatattaaagtgctgcttcttatagcctatggaatcttggccacagaacaagtaaggtggccatgtggatgatacagtgtatgtttagatatagttatataatcaccaaatgaagacacaaaatcaaaatctagtcacggagaactggagagctcctaggaggtgcccagatccccagtttgacaatgctattcttaccacctaaattatgtacttacaaacaaggtatggagggaaatatattacaatcgccctgacacccaatttctcaccatatagcagagtttctaccagctgagtcaaagtggagtcaactataagccatcaatccctgcaagccatccagcaacaagcttatgagtatggaaaattcccctacatattgagaaaataaaaatagctcagataaaactactgcaagaagcatgaatacaaccaaaaaaaacccaacatttgaacaattcaaggacaactactctgatgttatgtgagctatgtgtgtagtaaactctctgttatatggcatgatctgttatggggagaaagaaaagttactaatcaagtgccattataaagtgttaaagtttgtgtgacatgtcatcaagtaagttgaataatattatggatgtcgcatcataattgtacaaaacctactgttccagagaatacctgagagtctgtcatatctttgggttgtcacaataaacataaatctatcctgtaatggaatatgaagatagaaaaaagatttgcctgggggctgaatgtttactaaatcaaaggtgcacctatcactcattttgaatccacatgcagacctggtatttgttggtttgtttctcattcagagttcagaatggacaggtgtaggaattcctgagcagaaaatcctacttttctgctattgaaccactgtatatatatttgaggaagaccttctctaaaacattaacatcttccctaaatttaattaataaatcatcaattatttattgatttctcaggacatagctgatagccccaatactctgttggtccccttaggggttacagtcattttaaactgtagtgactctattcaagaacctctgccctcaaaaattttatgggaaaaataaaaaacaaatgggaccatacagtacatatttcagtgctaaaatatgtgctagaagccacaaaggtcgtacgcgtccaggaaaagaaaacaattgaggtcaataaaatgaggaataaatagagaagggttcatctctagttttaatgcataagtactgactggcgccatgttaggtaacaaggacacaaagattgccagtactgtcaaaggtgcttacggcctaggacaggaggccaatcaacaatgaacacaggacggacaagagcacaggaaagttggcaccagtgtgggcagccaagggaaaggagctccccgccctgctaagaaatggcactttcaagtacgctttgcaaaagaggtgctacttcagagcaggtgtgagtttgctggacagattctccgccctggcacaaagagtgactgaacatgacccatatgggtatgctgattacttcaacatgttggccacagggattgtacgtggggagatggggtggtattgatccaaccgcagaggtgggtagaaactagacctggaaggaccctcattttggatgctgtcataaggaagtggaaaaacatctaaggacattaaaaagaaggttgttgttgtaaaatttctgtttctcaaggatcaatatagctccaacataagtatgtagtgagaggaaaaggttttggaggctgagaaactagacaagaaggtggcttttgttataatctgggctaaatatgacaaataactgagcaactgtcctggtaggctggctgaggttagcagttggaagggctgtatgaccagctttcagggcacagttttgacctgactggaaggtgacagtggatagcacccttcagtatgaccctaccacaggtactgtgtcctgaaaatgtccatttcttcagttcctttactccaaaccctgagcttaagaacttgcttaaaacatgtctttaatgtgtaaaatatttataacttaattcccatgggaagggtagttgctctccactgggcttgttgagctgcagctacagctggttgacaatgcagctgggtgacactagctaggtgacactgcagctggccgatgctgtagctgggtaacactagctgggtgacagtgcagctgtgtgatggtgcagctggttggcactgtagctgggtgacactgcagctgggtgacagtgcagctagatgacaccacagctgggtgacagtgtagctgggtaacagtgcagctgggtgacagtggagctgggtgacagtgttaacagtggagctgggtaacagggcagctgggtgacagcacagctgcgtgacagtgcagctgcgtgacactgtagctgggtgacagtgcagctggatgacactacagctgggtgacagtgtagctggttgacagcacagctgtgtgacagtgcagctgggtgacagtataggtgggtgacagggcagctgggtgacagtgtagctgggtgacagcacagctgcataacagtgcagctgggtgacactgtacctggttgacagtgtagctgggtgacagtagagctggatgacactacagctgggtgacagtgaagctaggtgacagtgcagatgggtgatactgtagctggatgacactctagctgggtgacagtgtagctgggtgacactaagttgggtaacagtgcagctagatgacactgtagctgagtgacagtgtagctaggtgacagtgtagcttggtggccctgaagctggatgactgtgtagctgggtgacactatagctagctgccaccgcaactgggtgacagtacagctgggtgacactgtagctgggtgacacagcagctggttgacactgcagccttctgttccagagcttgctcttctcatttccgagcattactttttcagccagctgcatgccgtgctcaggcgtttgcttgatctgagtcctcgtgcatccaaacactatggattattaaatacaagaaggtctataaaggacagaacagagcctgaaactttatgatttttcattattgctagctgtcatagtgttatcattattgacattactttggtaataagatggcttttaataacgattttgtagtaaagaaataatttataacctggagtccaaggttaatgtgtgtatacttttgggggagggtcatgaatgtactgataaccgtggagaaatagtatatcctcagcatgcaaaagcagagaatttattgatcattcttcctggccaatagtatttttatttcaaatgcttagtaatgttcttttccagttgtactgaggtttctttgatttttccactttttccctttttctttctgcatcagtgacactcttgctagcttcaacccaatctccaatttaatttttttcaaagtgtgttgattggaagtgaagatgggcatatttcagtaaaccttcatcttccctgaaatccgtgctgatgcattttttggtcttactctaatgacttcaaattattttccacttgatagatctcacacatgcattgtcagttctgaaccaagggagccacgctttggaacatgtacaccaacctgccgatcacgtttgctcataaagtagagtcctcattcggagagccttggggctcagatcttttgatagtttctctgaaaaccaccgaagtaaaacagtatctggctcctccaatttatgttcacagaatgtacttctgtttaacaactttattagattttgaaatggcaaagaatggaacaactgtctttatgtaggcttaacgcttttcgatgtgacaagccaacataatttctggcgtcaaagtgtggtttattaagctcttggggtgttcacaagtattctttgtttgcatcctgatattaccatggttttattatactgtactcttctctagtgcttttcccattagatcattttagatctcatgccatgatgtgtgactatgaacaagaggaccagacatgtatttcagtgcttagtattggctttaaatggctgtttctcttattctttccctccttttcctcttactctattccatttattatacgttgttcttcttttgcaatgatttgtacagattgttgccagattcctatttgtcttgaaaaccagcctgaacacattgctaagccttaatatgacagaagtaacacaacaatcttcaagcactgtagcaacattgctactaataaaatggagaatctcacttctgatacttcagcattttctatgattttcagcccattgaccacctcccaacccacattctagggtccattgattaagtcatgccctcacccattactgtcaaatcctgttactccaactattacccagtaaggagttttttgtttcaaatcttggcttttctgtttacaaaaacatgtgatctgaggcaaattgttggatcttcctaaggcagcagtccccatcttttttgctaccagggaccaatttcatgaaagacatttttttttccatggactcaagtggcaggggatagtttgggatgaaacttccacctgagatcatcagccattagattctcacaaggagctcacaacctacatccattgcatgctcagttcacagtagggttcacgatcctatgaaaatctaatgtcgccgccgatctgagaggaggcagagctcaggggtaattcttgctcattgccactcatctcctgctgggcatcctggttcttaacaggctgtggactggtaccagtccatggccccgggattagagacccctgctgaggtacacatttctttgtatcaaatagagtagagctgtctactttgcaacattttatgagaattaaattacataatgcactgactggcccatcttggatactgaataaatagtagctacatccaactttccttccatctaacagccattgatcatcctgatcttaaccacttatctctttctccagtttccagctctacctccctgaactcagtagactctgacctcctgaacatgcattgttttattctttctagtcttacgatgaatgcacgtttctgtgttattaaagtagcgtgtagctgaccacctggattggataactgcctgctgtctgtattgctgctgcttgtctgctgagctaggtggagaccttcttactggcactttggagaaacctgtatgagctctgcattccatttagcgattgagtattaagtgttcttcttacccttcagtgtgactctgcaccagtggcctctaaaatttactccttgtctctgccatgtcgggtcagaactggttttcttgcctctgtcccacccatgtgtttttagaatatccaggatgaattaatctgtccagctaaaaaaaaaaaatgtactcaacctacagggttcaacaaaacaattgcactatgtcattatcataagctttccaatgccagagcattaatattaatgtgatattaacatacacattatgtaaaatattactctcaagaaagtctaaagtggtattatcgacagcagagaagtgtgcttctcatatacagatacagtaattgccggcattttgtcctgtttctgaatttcaatgtgtagaatattacggtgcctttttcttcatacttagttcactactctatttggcaactttgagtaatgtgtcagaaaataaggttcttgttccttacaaattgaccctggctgtctaatgatgtgattacacatcagatacagcatcctgaaagaagccaacaggacatcatcaactttcaggtgatggactttgccacctcccaattgagtccacatttgagcctctcggatcagtgttccatgggtcatgttttcttcgagctctgaggtctctttagtggtcttgtttgttagggagtcattgccatatatatatatttttttacctccacaggacacgtggcacactaccatgtacctctttggttcactatttgtttctcatttggattaaacctggaataccttgttctgtagtttcttgattaatgtcctaccgtcctatctgcctatctaggtgggtctaatgtcacttcctgcagccctgatttcctgcaggtgtgatatcttcagtcaaagattgtacattattttgtttatgcctaatgaagtaattcggccttgtaattatatttggataaatattattttcactttgctacaatacatgtttctggagaaccggcctgtgtctcattctgaagtaacttatggatatcaggagctgagttagggtagagacgaatagcaccttcccttaccaaacaaatcataggttcttcctggaggacacccctttctttcatcccaacatcatcaagcccagtcctacaaatagaaaatatgtgacagattcacactaactctttattgcaatggaaacctctttattgcaatggacctatgttagtgcttctcaaacttgagtgtgtctaggaatgtcccagagatttcagtaaatgcacatttggccatggttgttctacggtgcggcttggtattccacatttctaagaaactgacaggtgataccaaagctgttgtatgtgaaacacactttggagagttgggaattaaattatctcaaatatattttttatttcctttttctctttctttctttctcgttttctttctttttttttttttttgagatgaagtcttactctgtcaccccggttggactgcagtggtgctatctcagctcacagcaacctcggcctcccgggttcaagtgattctcatacctcagcctcccaagtagctgagattacaggtgtgcatcaccatgcccaggtaatttttgtatttttagtaaagatggggttttaccatgttgaccaggctggtctcaaactcttgacctcaagtgatccacctgcttccgcctcccaaagggctgagattacaggtgtgagccactgcacccagccccaaaatacgtattttccttatctgacatttaaggtcaaagaggaagaagtaccaagttacaaatatagaatactcttcagctagaacttgtactggtgactgattttctctgtggttccttctccataggacctatgtgtatccaaatgtctgtagggaaactgaggcaattttaatattttccaagaaattcagagagaatccttccatttaaagaatgattaataacaggcaaacatagaaaaaatatgttcatataaaagataatattttttctgcataatataatttttcaaacaaaggaatatttagattatattctttcatacaagagttagggaaaatattcactgaataacttaaagaaggttagtgacaggtacctgatcttaaatccaacataaaagttgatcatctaaaaaaagttctttagattttcttagtaactgtaaatactggtaaggccacaattaaccaggcaggtggcgtcaagtcactgtgcaatgtaagaccccccaacacgggtccaatgacggtgactttcctacgtgtgaaagatctctgtgcacctgctacccagcgtttctcaacattcagcatgcattcccatctcactgggagggcttgtgcaaacacagatggctggaccccacacccagagtttccacttcagtgtgactgaaaatttacatttctagcactgtcccaggcaatgctcatactgccagtccaggaaccactctttgagaaccacactcagtatctccttatccacatccaagtccacgcagataatagactcgtcttaaaattggatgctcatcaccctaaaccttgctcagaattcttcaccaccctctactgtagttaacaaagtccaaacatctgggcctggcattctagttccttccggactgtggacccaatttagcagaaggtttctgatctcttactatttatttgctcctttgcaatgggccaatttataaccatgtttttggtgcccctcaaccataccttttgattttatcaaacctgttcttttaccagatggttgttaggcctggagttctttttattttccccgcttttcaaaaccctaaatagcgagaggaggtgaagagactcacagacatgctctctctttccttcccatgatgctaacctcagagttgctgtgggaattccttccaccccacagtgtaccaggtaagcatcatactacctgcatttgtgatatgggttaatgtaagtgaatcacaagtgcttcattatcttgattgtgaccacaaaatgccatagcattgcattaagttacaatgtgtgctgcttcaaataaaatcaattgtcatagggaaaaaaaaaaccccatgaaacatcaatttggtgtactaattcaaaatcccaagtatacctgagtcacctatagtatggtctagaaatatcctgtgaaaaatgtaatctgtttttaacgaacatgatatatagtaatgtttaatgccttagaaatcatgatatgaattctgaaaagacataatggacaaagtgtatccgataagagaatgaaaaaacaaggttgtgctcactgtaaagagtgaagacaaggttttaggcagaaatataagctgtaccatgaggtgtgggatatcatcataaaaggtaatactctagaatctaacaaacctaagctttttttttttttcagatttgcaaagtacaccttgcacagcagagagaaaataactatgttttatgtaaaaaaatgtgaattcattcactggctgatagattttcctcatctttgatactgtaaattcctacaagaggaaaaatgacttttatattgaacatatatacagacaaaatatatatgaatacataggcatatatcaagaaggacagcattgtcattttgtacataaagtaaaagtattagtaccaagtctttctaggcagctccaacattatcctgaacttgacaagtgaaccttacccatcagagtactgctgggtaataccagttatcagacaactgaaacgcttcaaacatgttgtaagaaggtcttcatattgccctttcatagatgagaaaaatggctgggagagcttactaaagtttccaaatgtcgtagctagtaatcacatcccatgactcaaaatcccttcttcttcggcttcccactattcataaacattacttttcatgttacgttgtgtattactttaaacggcacacacgcatgttacctgaatcagcgatctgatctcatacagcaaataaaaatttcttggaaaagtggaaaaatatattcaatttgatcgtaagtctttacatgcatttttaagactttttaagaagacattaacgtggatggtacatatttgctgtttctaaaagttataattagaaaaaacaaataagttcaatctttttgggaattatctaaatggggtaatttaggtcttttattatgtattccccttagaatttttagagataaagcaaagctgtcgaggtacactttaaggcagtatggtaaaaaatgttacagtggcctattaagtatcatctcacagaattgtgcagatctttgctttatttttaaggaatggcccagccaagtgtgagttaccagtggttgtgccaggtacaggccaacatcatgaaaaacaagcctaagttcaggctcattgatgagatgccacctttcactttgtattaggaagattcaggcagagatcctgagagcaatgtggacttctgtggattgctgccctgagaagtgttatgtgagtaatctcagacctgcctgtgtcagtcagtaacagactgactcttagaatcacccgctgctcgtatcaaacagcccaagatatctcttccgtagttcttctcatcatcaactctgtgctctgcggtccaggcaaataactttctctcttcttgagaatatttcagggattcttgtcctctggaaacaacatgcattcactgattgatttttttggggggtgtggggagagtggtaatttgctggggccagaaatgtgctctgatatgttcacagtttcctctttctaccaggaggactccataggtatttgaccccaaagtctgactctcaaattgcagtcactggaggtcaaagccctaatgtctgttgaggctttatggagcccctctgagaataacaaatacatggcaatcactataaacctgcatttatgcatcaatgaccatgggccaggctagatactaagcacataatagtcattatcaaatttaatttgcataacaattttaggagatatgagaaagctgagtcaggttcatcaagaaatcttcccaacatcgcatatatcatgaaaggaaatgtgaagatttcaacaaaatttttactgaatattttatgctattaatcattatggatacattttcccaatgggaatctgataaatttgcatcagcattctgtgggaatgtaagcacaaaactttgctcgcagattttcggtgcacacacattccctgggcctttacacatccagtatcccctggtaaaaaaacaaaacaaaacaaaacaaaaaaactcctaacctaagggaaacacttttgtagctatggagctcacatttgcctctcccttgtttaatccctggaacatacttttaagaacattgcttaaaaaaaaatctgtcttattttttgtaattgctctgcagggcctactccaataacatgaaacaactctggtgaagcaatcgcttaatagcaggccagaggtctcaaagatattattaatataccttccaaaggcaccaaactggcttacaggcattaggggcaattctggattcttagctattatttgaaacaggatctctatgtgaggaccaacgacattttgacttctcaaatgttactgtgaggtaatataataacacaccttccctaagaggaagatcactcatgcatctatcttgctttgcaagcgctggcaaacagggctccttcactactgttctccttcactactacttcactactacagtgttctccttcactactgtaggaggcttgcctttctttttcacattgtgggtgaaatgcggggagcagctgagaaggcctttggagaattctagtgaacaagtccactgggctggagacaactaaagcaatattctggagaggcttgaagtggatcgtgattggtcctttggagactgggtcaggctgtagctaagatttgtggatgtgacaggctgagacagttatcctctcaacctcgtcctggcttggaggagatgtagacccaaaaggtgtcagtgttgaggcactttccctcattgaagtctgtaacttttacttctcctagggtgattcgtgtgggcatccttgctgggaaatgccagtctgactcacattcgtcaggaggaacccagaccaaatctacaggaaaaatgagctcaagggtgccgagggcaggatacgcagaaaaaggcagaacacacggcgtgctcctgagacagcagtgcggaaatatccagagagctttctcccagaagcaggaatgttcccacagcgtggtcgctctccccaggtatttcaaccctagggaggtgggtgccttttcgtggcatagagggaaaacttctaataaggccctctgttaggctcaggagcttgtttgtgctgcaggaatgggtgaagagtcacctgggaaccctccttttcctaacatcatcattcctccttcgaaattcttgcggcttgtgtagcaaaggcaaaagtttagggaagggggtcttgactctggagctaatacgaactcgacaaatttgaaaagtgtttaataattctcatcacaattttgcatggtgattgtaatagaagcaccacgtatgtcctgctgtatacaagttgatggaatgggtacaaaatcgttaaaagactaagccctgtattaaagctgcttggactctaattagacaaggaagaaaaaatggctttttgactgatatgcagacaacacttgggagtaactagaatgttcctccatttatttataaataaaggtaaataattctttatttttctcttaaaacagaggcatcactagagcaaagaccagctgctaacatggcattggggaaaggagaacggaacatcaactgtggataataacagtgtgtgagcttttcttacaacttatgtcggacacatgttacatcgggggacaaggaattttataatgcacggaaaacaatgttcatgcagttcagtgaattgtggggtggggaggaaaatatgtcagaggcgtttcccagctgctcagctctctcaccacgtttgaaaatatgatggaattcagagcatgcctgtgtcctgcaaactgacgacagggtggcaggtgcaccgaggccacagaatgcaccaggaagagactctgaagatgctgccctgtctgccgtcaagacgcttaatcccttcataaaatcacgaaatttaagtgttcaggttttattttgttcactttatattttgaaagtgaaccaagtaaacattatacaaattttacaaagaagtcagattcaaatggtgccttcagaataacttgagcagacagtattatgaatgcattatttttgggttctaacacagcaaaagacagatgattttaatataaagctattgtgcttaataagaaaacagactgatattgctaaatctataatctattttcccctttgtatttgcatatgcttcttcagaccattaaggatataaaaacacaacgaattcggtgcttctttagagattgtagtgccttctctccagagtacattattacaaatataacttgttattggagagtgcatgctacaggccaaatctctatcttatttctgccttccttggatgcaatgaatttcaagagaactggaaaaataagtgcttcctacacagtatctacacagaactgttattagcttgattgatcacgaccaggaacgctttcttgggcatatttctgtagctattacaagacagatgtggccaagtcctacttattcaggggctgcccagctagccctctggggacactccagaactctagaaattggagatgaccagaaaattctgtcaaatcaccttggcagctgtggtttactggacaggttgccaatcacaggactcaaagagctctcagaaaatcatataatgcaagtgtctgcttccagacgggtctctggggactagatgtcagcatctctcttgaatgctcattccaaaatcaaatcacatcattctttaggtcatttttcttttgtttaactgaagtctctataatcatagatccttttttttttccttattgaaaggctatatatcctagctaacacactgaaaccccatctctactaaaaatacaaaaaattagctgggtatggtggcgggcgcctgtgatcccagttactcgggaggctgaggcaggagaatggcgtgaacccgcgaggcggagcctgcagtgagccaagattgcgccactgcactccagcctgggcaacagagcaagactccgtctcaaaataaaaaaaaaaaaaaaagaagaagaagaaaacgaaggctatataacaccagctggtctttatatttccagtttctctgccatccaattcgattaataactaggagtggctttcataatcacctctttcacatgtcattgcttgtcggagctgccataagcactcccaggctcgcctatcaaactccagaacttcctcctttattctaagacttttccatcagaaatctctcatctcaccagcctcatttctcaatagactgaaacttgtaaattctgtctaattaaactcattttcttagactgccacaaacaaaagattctccttcccatctgtgttccatcttcttacctccgttatcttttctcaccatcattttccaaaggattctcctctatgtgttttccctatatgtccacctgaatcttacatcttcccacaagtttcctgaaccgataaaaatagttcaaaggatcaccaattgtcatatagacacatatggagtatattttctttaaccaccttttatatttgactgagtcttttcaaaccctaaatcaataaatataacagcttgtccaattctgagactgattttctatttttatttaacctgattaatgggaacttcacatttctcatgaatttgtaatgatttcagagaaatcgttttctaactctgattcgacatacttctataggggcatgaacttactgggaaatatcactaattattcaaaaaacaatatacggagggtgaatattttatattttagtgatatttgatacgtactaatcaatctggtttcagtcaaaacatgtatttaggatttactacattcaaggcaatcttctagccaatttgggtgcagggacaaatagggtgggacgatttctacttagagtagaccagggaagacattcctaaaccagagaggctgcgtgctcctagaccctcaagtgaaacatattgcatacaatggaaatacataacagagggggctggttaatcttagcttctctgccaaggtggttttggagatgaaagttgaagcatgatagaaaagagagagaaggagctaaggtgaattgcacccagtgtttacaagcgtcctcaagtggaaaaaagtggagcatgtttgataaactgagaaatacatgcagaatacgacaactgatgggatgaaatgtccaagatgagcctgaagaggcagactgcagtctgctcttgtagctcaaggtcacacgaaggcatgcaatgctagctagagtaaacatggtaggattttatgatttaaattatattctgttgagagttctggagggggcgtagtagtgatggtgatgtaagagtgaatgaagatcaattaatcagcagctatggtggtcattcaggtaagagaacacagggtgtgaacatggattgagaggagtaaccaaatgtgaggaagacacaggaaagcctacgcactggtgactataatgagctaaggcgtggagagaatcgtgactttagcagcagggcaacatggcagcactaggaaaggagcttttggatggtgtgtgtctgtgttgcagtggtcatgtggggttttggcaccttgaaatttgaagtatccatgttacatcgacagggagatgttgagttgagaaccgaatatattggttggaggtcagaacagatatcagggttggaataaacattcaggaatccttggcacgagaatgacaatggaagccatggggaggtttttgtcaaaggatcctgtgaggaccatcgacctgctcaggagtgagaatccaaggccaatccgatatcagaacagaggaagcaacaagcacaaagggaaatgcaacttccagaccagaagaagcaaaccactgggatgtgtcccagaagcaaccagcgaagggaaatgtaacctccagactggaagaagcaagcccttggaatgtgtcccagaagtgaacaaaaatgtgtttcagaaaggatggagcgagccctaggtgcaagtaataataaggcaacaaagaatacggtcagtgagttccagtgcatttgcccacagatctggcaagaatgtacttagggaagtggtggagtcatccagcattgagacatttgggtcagggccatcgaaatatcaaggatgcaaactttcaggaagtttagatggaagcatgcagggaaggcaggagtggggaaggaatgtgggtcacaggatgagttcttaaagagataaacaacttgtatcttaatgctgggcaccagagtactagagtattagaaccaactcagacggtctaatcaccttgactttcctgtgtgtgtatatataatttatgattacctcgactgttttttgtccagctgtataaagtccagttttggactcaaataaattaacgatcacttttgacttcagataaaggaaagtactttagccaatatttaaattttgtaatactttgttattcttgaaacccttctctatacttctaagttaaagaaaaagtaatattaagtggaaatgatcacaataaagagtcatatttgaattatgtaagtgccttgtcttcagcgttagaattttatatgaatagagtatgatgagaaaaataattcagtcagagaaaacaagaaaaagtacttttaacccccaaaaagaggtaagtaacttgagcacctgcaaaagggctagaatagagtagataagagctagttagagaggttgcatactttggagagaaagggtcacaggtagctcatggtttttaagaacgaggaagagaatggggcctagagggtatcaggatgtgtcccattacgttggatagatgtaaaaacatacgggtacagataaagatgtttggtgcaagaaaggagagacaaccatgttctaaatcttctatttctaacgctaattattattatatcatgttttgagtaaggacagtgtgtgtgcaatctgtgtaaagtttaatttttgtagctcctaactaaagtatcaatagtttccactgttgaaatggcagtttactccttaaaataaaataaattaagaaaatagtaccagctagcattaaatgaaactctttctgtctctcagatctccacctagtccacgttagtatgcattaagtcagcttggttgtcaagttgaaagatgtctttattttttgactatccctttttttttcagatcctttgacatgtatctgtctttgctcattcttcatttttaccggttaattcctcaacaaagatttattgacatctactctactgagtgtccttatgctagaatgcaaatacttccaaggcacacatcatacagttttcagttttatgctgctgaaatcttacagaataactcaataattactgattgaactaaacacaacaacaacgacaacaacaaaacagtattgcagtgtgatgaaagctgaacggaacagccttcacacacatacaagtgttcaggatgaggagattctacaaacacatccagggatacaggcagggaatagttattgaattaattagggatcggaaaagccctaataatgaagagtcaagagtttaggtagcaggttgggagtagtagttcacgcctgtaatcccagccctttgggaggctgaggcaggaggaccacctaaggtcaggatttcgagaccagcctggccaacatcacgaaactctgcctctaccaaaaatagaaaaattatctgggcatggtagtgtgtgcctgtagtctcagctattcaggagtctaaggcaggagaatcatttgaacccaggaagcggaagttgcagtgagcttagatagtgccactgcactccagcctaggcgtcacagtaagactctgtctcaaaaaaaaaaaaaaaaaaaaaaagagtttagcatagtaggttcggaagatcacttcaaggacttcagggaagtgcaggaaaggatgacatgaaacaggacattactgggctttgttgatcatacgatcaaattctagctttaaacacaaggatgaataattctataatagtcagacatttaatgggattattactgaaatacttgaaaagcttatcatataattatatataatttaacagaacctgtgtacttcataactgatattactaataatgtagaactctatctctgttataatttattggttgaatgttaatttagctagcagctcaaattatgaactctctcgctttccattgcatctgttcctaaaattttcgtatcaattttattacctttatctagtatgcattttggggtttaacattttacatatcaccccaactagaaacttttcaattgtttttgaataacaaggaaattaaaatcatataaattgtgtgagttatctgaggcagacctacataaactggctccaaactttaggtaaacggactggaagcatttgagtgagattcataagattgatataatgcaattagttggaaaatgtcactgcagacacaagacaaatgggtaacataatactttgcttttcaaagtgtctgctctggaagtctttgactcaatgattctgtcaaaaaagataacatgccagtaaatttcagtgaaaaaaaatgctaaatgctctattacttcaagaaattgaagacaacaatacaatgatgaagtagagacttccagatgttgccaaccggtcatttatgaggtgtaacgaaaatatatacaacaggagcccagaaagcttttgtggaaagtctcatataaaatcacctggttctcagcactacgccggatatttatatagcatgaatattgtcagcgaatatcaagcctctgtacataggaggtaattccatgatgaaataactctcaatttctaaaactgtcttaacaaatgacaaaacacttatatgaaccatgacattacttatacataaaggcttgttagcttgaaatttctgataaatgggaattaacttcctacttagggatacgcctaggttgaaacatttagtatccgattatgtatgaagtatgattgtatgaacattatgtaggtgacaatatgaactttagtaggcgactgcaaatgtacttaacatataggtaccctgacaggcaacccggatgtattcatcacctgatgtaatctgtgtagtttcctactacagtcatcacaaggatagaaaaagtagagataatcattgagaatgtgtcacaaaactagagagagaaaaaataattgagtggctcaatttcaaaataaggctgtgaagatggattatggggggtggtcttagattgctgcaggttagagagataaggacttgcaccaaataaaagtccctagctggtcatgaaacagaatgagacatattaaaaaaaataacaataataatctgcactaaaagctgctccttctcctccaatttattatttcctgaggcaaaatggtgaaactccactgccctatgaagcattgttgatactggaaattgattttattttcttcctctttttgaatgttacataatatgtttcttaagacaccaggcatttattcagaattttaaaatctttgtcataaaagatagtctaagagaatgagtgcttacctgctgcacagaggaataacgattacaaatatttatggagcgcttaatctcagctaagtgtttcccatgagccatttcctgtggttgaaatgcaaccctatgagatgctgttgaatgcatgaacgaactgaagttcctgaaattaggtgatgcgttgggagtagcagactcaggagtgaatgctaagttttgcaaatatacagtccactcactttgacacttcaccgcactgcttccctctacaggagtttgggtttggttataccacgaaacacacacacacacacacacacacgctcatgcgcgcacaaatatgtttcctgctactatggctgaaagttttgttaaaagataaacataaaaaatacacaaataacaaccaatgttttattacctggaatgccttttttgaaactgcaaaatatttgcaactagttgacataaagttcagattggcttcatatttatattttacctttttcttaaaaatgcttattatggtacgactaacatgcaaaaagttgtacacatgtaatgccatgaactagattgttttggagatacgtatatatccaagaaaccgtcaccactctcaaggccacagacaaatctaccacctgccaaagattccccccacacctattattagttttgccattagcaatattagttgtgtgtatgcggtaaaagcacataagatctacatgcttagaaattttaggcctttaaaattttacttaaattttaaatgaaaatttaaagttctcagtgtgttttttaagcatttaaaatctaattttaaatgtttaaaatttaagctggtttatttcatttaccacgatgtcttcccgattcacgcatgctgttgcaaatggcacaatttccttcttttttaaggggtgagtaatatttcattgtatattccactttttcttcctccactcattgatcaaagtgcatttatgttgtttcctaatcctggcaattgctaatactgctccagtaaacatgggagtgaaagtgtgtgttcaaaatcctgatttcatattcctttggataattacctggaagtggggattgctgggtcatatggtaggttttgttgttgttgttgttgtttttagcagcctacaaactcttttcataaggactgagccaatttacattcctaccaccagtgtacagagttccttactccccacgtccgcatcaacacatatatttttatataatggccatcttaacaaatatcacgtgatatattcttgtggttttgatttgcgtttgtctgataattaattatattgatcacctttttatatacctgttggacgtttgtatgtctttgcagatatatctacttgggttatttgcccatttttaatttttaatttgttttctattgaagtatatgcatttcttatatattttggacattaaccccttattgaatacgtggtttgcaatgtggaaccagcataaattcccatcaaaaacgagtggataaagaagctgaggtatatgtttatatgatggaatactactgagccataaaaaggaatgaattaatggcatttgcagcaacctggatggtattagagactattcttctaagtgaagtaactcagcaatggaaaaccaaacattttatgttctcattcataaatgggagccaaactatgaggatgcaaagataattagaatgacacaatggactttggggacttgtggggaaagaataggaagggggtgaaggataaaagactacaaactgggttcagtgtgggctgctcgggtgatgggtacatcaaaatctcacaaatcaccactaaaaaacttattcatgtaaccaaataccacctgctccagaaacacctatggaaatatttttaaaaaatatgtggttgtaaaaattttctcccattccatagggtgatttttcattttgcagattgtttcttttgctgtgcagaagattctgtgtttgacgtagtcccacttcttttgatttggttgcctgtacttttcgtgtcatatccaaaaaaaaaaaaaaaaaaaaaaaaaagaaagaaatcattgtcaagatctatgccaaggatttttaaaaaatgttttcttctaggagttttgcgggtttgggtatcgcactgaagtccttcatcaattttgtgtggtctaacacgtgggccagtttcattcctctgcacgacatactcagttgtctcaatctcatgtgttgaagagactctcttttcccccattgtgtctttttggcatgttttttggttagttggcagtttttgcttgagttcactttctggctttctattctgtattattggtctatgtgtctgtttttattacagtatcatactgcttttattactgaagattggtaatataatttgatatcaggacatgtgatgccttcagctgtgttattcttgctcaagattgctttggttatctctggtcttttgtgattccatacaaattttatgacttttttttctatttctgtaaaaatgccattggaattttgatagagattgctttgaatctgtagatgactttgcgtagtatggacattttaaaaatattaattattccaatccaggaacacaagctatctttccatttgtttgtgttttcaattttcttcataaatattgtataattttcagtgtacagatcattcacctccttggttattttttccccaagtatttcattctttttaatgacattcaaaatgagatttttttgggaatttctttatcagataatttgactcagaaacacaactgagtcttgtatttttagtgtgtaatctgtgaatataccaaatttttttttactttaggatttaccaaatttgttttttacttttttgtttttcttccccaagacaagatctcactccttctgccctggctagactgcagtggtgcaatcatagctcactgaagtcatgactttccacactcaggtgatcttcctgccttagtcttctgagaagctgggactacaggtgtgtgccagcatatctggctaacttttcatatttttagtaaagacagggtctcaccatgttgcccgggatgctcttgaactcctgggctcaagtgatccacccacttcaacctcccaaagtgctgagattataggagtgagccaccgtacgtgccctatttttctaagatgcgtgtgtgtttgtgtgtgtgtgtgtttatgtgtgtgtggacactgtaggttcttttctaagactgtaacatctgaaaacataaaattttacttcttactttccaatttgagtgccttttattcttttactttcctaattgatctggctaggactttcagtactatattaagtacgtttggcacgagtaggcaacttgtcttgttcttaaatttaaagagaaatgctttcagcttttcatcattatgtacattagttatgggcttgtcatatatgacctttattatgttgaagtatattccttcaacacataatttgttgagagcttttatcaggaaaataggttaaattttgtcaaatgcttttttgtgcatctattgagatgatcctataaatatcatattttgttagtggggtatatccaatttattgatttgcgtatgttaaaacaaccttgcatcccagcgataaatctcacctgactgtggtgtatgatccctttaatgtgctattgaattcattttgctagtgttttgttgagaatttttgcatctattttgattacagacattggcctgtacatttcttttattgtaatgtaatctagatatgacatgagggtactgctggcctcataaaataagtttgaaaatgtttcctcttcttcaggtttccgaaagagtttgaaaagcgttggtttagtgtttctttaaatgttcgataaaatttagtagtgaaggtatctatttatgggttttctttgaaagaaggttgaacactgacacatttcccttatttgtattgaccctttgagattttctgtttatttacgattcatcttggtaggttatccacattttgcgtatataatttttacagtattgtatttatatttctgtaatacctgttgtagtatcacctctttcatttctaattttgagtcttctcttttctacttagcataagagtttatcatttttgtctatcctttcataaaatttcagtatttttcatttttctttaaattgtctttctagcctctatttaatttattatctaacttgtattattttctttcttctattaactttgagcttggtttgttcttttcctagttcagtgaggtgtaaagttaggttgcttatataaaatactttttatttttttcatgtaggccatcatttctgtaaacttccctcttagaaccacttttgcttcatctattttggtgtgcttggtttccattttcatttatttccatctatttttggatttcccttttgatttcttccttcccccattagttgttcaggcgtatgttgcttaattttcacatatttgtaaactaattttcctcctctccctgattttagtttcataatataagagtcaggaaagttaccaaatatgagtgcaatcttctttgatttgttaagagttgttttatggcctaacatatgatctatcctggagagagttttgtgcaaagcttagaaaaatgtatatgctgctgctgtggtctggaaggttctgcatgtgtctgttaggtccatctggtccatactgttggccaagtacattgctttcttattgatttgatgtctggatgacatgtctattttggaaagcagtgcattaaagttccatactgttaatatattgttttctattttccctccagttctgttaatatttgctatatatgtaggtgctacaatgttgggtgcatatataattttatatagttttcatgaattgacccctttatcattatattatgacattctttctttcatgtttccgtttttgcctaatgtctattttgtattataaaaatatagacaaccctactctcttctttttaaccacttgcataaaaatatccttttctatctctttactttcaacctatgtgtgctcttaaaaacatagtgagttccttttaaaaagcatatagttggatcttatttatgtcaattcagtcactctgtctttggattaaaaaaaaattaagtaacttacacataaagtaattattaataggtaagaacttactactgccatgttattaaacttcttggactgtttcatcattaatatattctgttctgtttctcgtcacattttctttcataatttgataatttttgtattcataggctttgattcttttctatttattttttgtatacctactagagtttttgatttttgttcatggttacaagtaggattaaataaaacatcttctggttaaagcagtctattttgtggctgataaaaatgtaaatttggtcacataaaaataacttttaattgtgcttttcatccaaatctgtattttatgttgttgatattactatctacatcttttttatattttgtatttattaaccaattattgtaggtatggttatttttagtacatttgtctgtacttttaaaactttttaattgatgaatataaaattctatatattcatggtgtacaacatggccttcagatattgggatatgtggaggaaaagttaaatattaaatttcaactcaactgaacatgaacacaaataatggtcaacaaataccgaaacagattgtgtgagccccttgaggtgttcatccagggctgtttcagagaaatctctatttccatctattcttatatgttagttattgaaaaacaacagacaattgcaaaaacaagttgacccttttgtgttcctggagcccagttgcgaagggcccttgtgactgggactcatgccaaacaactcattaaaagagagctagggtcccagaccacgccgaagcttcatgagacctctcctcatcagtgcactaatgagtggctgactctggagctcaggctattgtttccttgtctggtggtgaatcttccagagtctggtgagtggagtgtctgactctggagcccaggctgtcccttccccatttggggagtttatgtatgtatatatacacatacatccacatacgtatatttttttcgcttgtccccttcccattgcaatttccttattatatcatttgcttattttgtcaatttgattatattaatttgcttattggatcatttgcttattatatctgcattgccatttatgtgggacatgtttacccttaaaggtattgtgtgtgtgtcttttattctcaccttgcgcatttcccacacagaacaggatacactgtgaaataattaaatgaagctaattaacatactcatcacctcatatactcaccatttttgtggttcagtaattttaactctactctcttagaaattttcaaatatataatacattctttttatctgtagtcaccatgctgtacaataaatctctagttcttatgcttcctgtctcactgaaactttataccctttgacaaacatctcctcattttcaccttttcaccaagctcatagttaccactgttctactccctgcgtctgagtttcaattttttacattccatagataagtgaaatcatgcagtatttgtctttctttgcttgtagctatttttaaaatatattgtcctttaaatttcataaaagagttagatttttcaccattattacagtattagaatattctgaatttgactatacacttacctttacaggtaagttttgtgctttcttgctgctaataagtgtcctttcatttcaatttgaaggactccctttagcgtttcttgcagggtatatctggtggtgatgaaatttctcagctcttgttgatgcgggaaaatctgtatctctccatttatgaaggacagtttctctgagtatagcattcttcgttggcagctctttactttcataactttggatatatcgatccattttttcctggtcttcagaaagatgctgatgttcttgtagggataccttatatgttgtaaactgctttcctcttgatgctttcaatattccttcttgtctatgacttttgacagtttaaagtgtctcaatgagaatcactaaaagctcaagctgcatttaattcattgggcttcatatacctagacattcatttccctctccagatttggaaagcttttgtcattattcctctaagaaatttatctttctctgtttcttctgagacttctatgatacatatattgattcacttgatggtttcccagaagctcggtggacttgcttcatttttgaaaattgtgtatcagttttgtccctgtgactggataattttaaatgatctgtcttatatttcactaattctattttctgattggttgagtctgctgtttaaacacttctttaattttttcagtgtaatcattgttctctttagctccagattttctttgtttcatatttataatgttcacctctttgttgaactactcattttgttcatatcttgtttttctggtactcttcaactctctattcgtgttatcctgtaagtcactgaagttaagatgataattttaatttttttgtcaggcggttcaaaaattctcatttctttagggtttggtactggtgctttgttttgctattttggtaccattatatttcctttatttttttctctcttccttgaagttctgcattgctttcttagcatttgaagcagtatttctttagtccttgctgactggtaagagaaagactttaaatagttatcctgcctagagatactgtgggtctctgcatctgttctatggctatgcctgccccacttctcttattctttcttaccagtcagtaaagagagcctgaggcagagccacccagctaatccacttcccaaatcctgacccatagaaattatgagaaaagaaatgtgtgtgttttcaatttgctacattttgggctattttgctttacagcgacctataagtaatgcatttggggaatgtgcttcagcgattgctacaataacccaagaggtgaagcatcagagtaaagtacttgtgcatttatatattatatgctatcctattttaattagaaatattcaaatgacaatttaatattaagtgtactttaaaatataaaagcatgatgaaagaaataatatttaaattatacagttaaacctgaaatacagttcaaaagataacgttcataatgctgggtggtaagacactgatgcggtttggctgggtccccactcaaaacttccagaattcccaggtgttgtgagagggacccacggtgaggtaactgaatcgtggagaccagtctttcccctactattctcgcaacagtgaataagtctcatgagatctgatgggcttatcagaggtttccacttttgcctcctcctcatttttctcttgccaccaccacgtaagaagtgcctgttacctcccgccatgattctgaggcctccccagccatgtggaactgtaagtcccattgaacctctttttattcccagttttgggtatgtctttatcagcagcattaaaaccaactaatacgggcagtgaaagatatttggggacctttattaatttattttattcaagttttattttttaaatatatactatctgcataacaaaatgtagaaggtacagcagccaagcagtaaaggcttttccttatacctttaacctcagtcacccaatttaccctatgaaactaattgtctatttgtctatacacacacacacacacacacacacacacaaacaccatatacacacacacacacacacacaaacaccatacacacacacacacacacacacacacacacacacacacacacacacacacttgtggtgtgtataggtgggggtttatgtatactttctaagtcatatttttcccagacatgattttaagtactaataacgtatgttgatttatttcctcttttatgtgttaatggtaaaatcacaatccatgtcctctctaaccaatactccccttgtgccatgtatttctccttataacttttcaatctattacacactatttattttatcttatcttattttatgttttttcaccagaaacaggagggcagtaagattttttctgtcttttgttgagatattaccagtagctaatatagagtctgttataaatatttgttgaatgagtgaatacatgtgttgcatttcattagtattttaatactaaattctttattatttttcacttacaaaaagcaaataattgtttcttttttgatttaatttttgatgattattctaacatttatttctggttaattttatcagttgtttaaaatatgattttatgaaaagcatattattagaaacaattaattgacctatacttttatgtgaaacacatttgaaaacgcaattaaattcaagttaaattgacacctttttttttttttttttttttttatggagtcccgctctgtagccagggtggaatgcagtgtcgtgatctcagctcactgcaacctctgcctcccgggttcaagcaattcccctgcctcagactcccaagtagctgggattacaggcatgtgccacgacacccagctaagttttgtatttttagtagagaaagggtttcaccatgttggccaggatggtctcaaactcctgacatcgtgatccacccacctcggcctcccaaagtgctaggattacaggcgtgagccaccgtgcccggccaaattggcatctttaaaagtactttttgtgctttatgtttttataagaggtaatttagtatttattgtaattatctttaggtattattatcgtttttaactgagaataatataaattattataaataaaagatagggttgtcataaagttttgaagctataatttattagagatattatatctaacagcttctaataaataaatgctaaccttctttatattattccaacaattacaaataaatatatagcagacataagctaataattattaaggtgccagacagcatgaaaattattctgactttataagaactttatgagtattcaatggaaaaaggaaaggtatcactgtataacagaaaacaatacagccagacacagtggctcctacctgtggtcccaacactttgtggtgccgaggcaggtggatcacaaggtcaggagtttgggaccaccctggccaacatggtgagaccccatctctactaaaaatacaaaaattagccagccgtggtggtgcatcactgtaatcccagctactagagaggctgaggcaggagaatcgcttgaaactggaaggcggaggttgcagtgagccgacatcacgccactgaactccacactcggcgaaagagtgaaacaagtgaaacttcatctcaaaatagaaaagaaaagaaaacaattaatattttctttacctttgttaagcagaaaaaaaagaagatgctaatttgattgcgtataagcagaacactaagaaaaataccaaatctaccaaatattttagttttaaatttaaaaatatgtctctcagtgatgtttggcagatacttttttataaaatagtttcataaacattcttaatatgagagtcgaaggttacctaaaaaatcattttacatcaaattctttgttttgttagattatctgttaatttcttaagttcatttaacataatttttatattgaagaatatgatggttttaaaatattatcttttctaattgatgaacaattatagcatcaatttttttcttaaatttccccactttattcaaggaggcctgagtttatgaaagtataaaggacatacaaaggtaaataaactatctatagatttaattgcctgttggacatttacatttcaatgaagcagctcagaaaagaacatgagaatgatgttaatgtaataatactgaaaggaaaatagaaatagtaggtataattaatacagcctcataattacatatgctgtgatataaatgttacattgattattcaacttcttgaatgtatttttcttttaattgccaggactgagtggtaaacaaatgatatattgccctttttaaagtgcataaaaaaatgtgtaggtagcagtgaaatatcagcacaagcaatgagtcctaacttttcaaaaaccagtaactgctgaattaattcaatctttttgtagaaataaaaatgcagttaagtggaacagggggcactgcccagctgcattcacaggtttcacggccgtttgtaggcttcggtactgtactaagttcagatctacaagtagttccatccaccaatataatagatgatgtcataagaaggagaaggaagtaataagagtatacatgacaataaaaatggtttaaagaaggtatagatttttttttaaattgctcctgctctttggatctatgctatttcttaatatacgtgaatacttttgaacccattctgaaatcaaaggtggtccagatcccacccaccccgcccacccccgggccagttctatgcattcccagcgattccacctaccccaggtcatgctgtcactatacaagggtaggagaaatgtcatggagctttccactgttgcttatcagtgatctttcttttcgtatacctggaattattttatcaacctgcaataaaatgaatgctgtggttttgtgtgctaaaacaattggttgtcattgtataagaaatcttaccgatttttggtttccctgtaactctcagggccatcagcattgccatctactaattgcagaaaattaaaagcacagagaataaagaaagacttggagtgaggagagatgaaactctgcacataagcaagatgctttctactgccccctctggaaggatacacttaacaagagtgcaaggctgaggaaagctcttgcctctgcacatggtttctcttacataaaggaggtgtttgtccatatacacatatggacaggatgattttccccctacattccctcaatgagaaactcaatgctgaaattaaaaactcatcttccaggtacaaactgcatacataatttttaatactagacattatttgaaaaagttcgtgaatgttcacagccaagggtgacaatgtaatttcaaccttccccacatgagaagtgggtccaaaagctggaggggacagaacaaatcagctacaggtgctgtctctgaaggactctgcaatctgcatattgaaattcaaagtcaacgtccattggcaggaactgggttgtctgtctattctgatggaatgatttcatgttataagataaaaaataaatgtggctgcattattttgtctttaaaaggaagagtatattgtttcaaaacatatttgtatgaataaaaatactattttttttttttgagatggagtttcactctgtctcccaggctggagtgcattggcacaatctcggctcactgcaacctcagcctcctggatacaagcaattctcctgtctcagcctcctgagtagctgggactacaggcacatgccaccatgcctggctaatttttgtgtttttagtagagacgcggtttcaccatattggtcccgctcatctccaacccctgacctcaggtgatctacctgcctcagcctcccaaagcgctgggattacaggcctcatgtgagacactgtgcacagcctatatgattaaatttttaaaaactattttattgttaatgcaaggttttcttcttacactggtttatataaagatgtctctgagagggggtatgtgttacctaggcatgtttttcttccttggaagattatctttatttggtactgggaaaacctacaaaagcagtaccctaccattgtaaataagctctattccagtgagaacatcagttatacttgccgtatctattagatgatgattctatacgtgacaagtaaagtagaggtccttcttcaaagactttcctccccatctaattaggaataaatagtaacttctcttagaagcaaactttattcaaagacctgtgctaacactcttaaatatctgccagccataataaagaaatcaatgtattttatgttcttagctcacacaacttagccctggcatgcttatactggtccaagcaagcattaggtcaaagcctgttcttcttccttatttgaaggtctttttacctttctcaccattccacaagttacttcctccttcctttgttctcctctgcctttgcctcttttcaaaagttctaagttgctagccaatcgggacaaatacagaatctgaggtcccgttccagccaaaggaaacgggacacagcagtagggtggccgtgtcaggttataagtgaccctgtctcctttgttcggtgtactgtcatggcaaaactgctggcaagtgtaccctttctgcagaaaggaaaaaaatggccttgtgaggaaattaaatttatgttcaagtgctacttctttacggcaccagggaacaagcatttctaacatgtacaagggtcaagatttcttataaatttgcacttaaaacaaaataaagtaatagatatcttaatagttaacttacattttagtctagttttaaaacctaacaaatgtcacagaaaaataatttacaatggttcaattgttgctaggattcttaaaaacctaaaatacatcagcaaaaacgccctgtggaatatcatcttatttaaaggtgttaactagccatagtgctaatttccacagggaaaatcttaactgcggtatgatcgctgagataaagttttaaaaatgtgacatctttctttacatatatcattaaagcctaggccgatattgcagggtaaccatagataatttcagctaaacatcgtctgcatcttttaaagcatcttcccctcatatccatttaggaagacactaaataaatgaggttcggagaatgataatacattttgttagtttctcagaacgctctgcattttgaattgttaataaatggtattgtgaaattttcaaataaaatatttaagaactagaagtcagcagaaaagggccactctctctccctccctcatttctcaggcttctatttgaatgtcacattcattcttttacccattctgggtattgtggaaaaaaaaatctttcaatccatggcttttaaacctcctgacaattcatcagattggagcatttttaaaaggcataaaagctcatactttctccaatttcattgaattacagtaaatttgtttaacaaacttcttgtggagggaggtcaggcagcagtcagtgccatgaattgcctcaaatcattgcgccaagagttagagacagagaaaagtgcctcaggatgtcttttcaccttgtatagttctaaaaaacaaacaaacaaacaacaaaaggactatagtttagaagaaggacagcattacaaggctttaatctcaatccacaccagaggaaacaaggtgagcaaggagcacctaagaccccactaaggaatattaagtgggcaatgggacttcctattcaagcagaggactgggctatctttaaggcagagttgcaaagggagaagtgattttggttgtcagacattgtaggaaaagaaacagaaaaaaaaaaaagatcacagaacccaattgtagctgtagaatctaaaaaggactttttaaaaaattaaaatagtattgatttagatgtagaaatgggggaaaggagaaaacaataattttgtgacttcagttctaatttcatcagagagtaggattcaatataaacatatctattggaatgacacacatccagaataacattcttgaaagtagatgattttatggcttatatattgaggacagtgctggaatgaaactcagatattcctaactgtagacactgtttcatcgatactttggtcccatatcatgttactgaaaagggtcaaacttaagagcaggaaaatcgacgaaagtaatagttggttgagaattctcaagaagttttgttgctcagttaaacatgtgctcatggtctttaaactttccccatttattctgcgactagaggaatgaatataggcacttgggtgttttgctatgcctgcaacatatgccatctgcattgacatttctcatggtatttcactctcataacccagcctcagcacggtaataagaccttgatatgtaggaccttgatgctaagtctagggaaagcagcagatgttagccttattaaatcaatcaagccccacaattaaagttcaatgcattgcagtctaattagtactgtggctagttaaaaatccacaaacagtatcatatttcaccaaacatttatattgacattttgcatgttattagggaattctcaaaaagccggtccaataaactcataagatcgtaattcattgtggtggactctaatgttaattgattagaaaaaatagtgtaatgggataaaccactaataaccataaaggttaatgaagctgagttttcatttcaattggagataaaaagttactaatatatttctcttttttatgctattgttattagatttcactattgtgtaaagttaaatgtttttgaattttctattccaatagcaacacacttctatttagtaaagtaactaaatcttttttaaaagtgtatgtgaatttttaaattttttgctttctaatatcctgaaaaactttttaaatgtttaacattatagaacaagtgaaatgtatgataaaaaaaaaaaactgcttgtggcaaattatctcattaaaaaaaaacaaaagaaacaacattattttcctctttatatatctggtttatatattttgatttttaccaatgtaatacatttatctaaagtccacctccgtggtaatacctagtgaatctccattttttccaaaacaatttcttgttaagtagaaaaggagaagaaacaagatttagagtacgtgttaaattgactaatctaaaatattttgctttattcactttaaaatatatttatttgttaactgaagctttcattaaattacttgaaccattaagctgtttttggcgacatttcagtttagtactaactgaaataaataaatgagtctatcaggacttgtatgtatgacagataaaacatagactaagcatttcccgcctacatcttcactcccacccactcaacccctttcagccatggtcttctttaacagagaagaccacagtctgcaggcctttgagaagaaagagatgagagtcctggcaaaacaggatacattgagaaaatataggagtgtgtagaactgttaagatttgcttctggtaagatactgttagtctctatattgaagagatttcagaaaaacagttattattttacaaaatgtttcgcatgcaatttgtgctccttttgtatgcaaaattacgttcaaaaatcctaaaggagaaatgaggtgagatttatttaggttttatatattttcctgctatatttatttttataattcagatcttgcacttaaaaccaattagtccaacatggacatactgctgtgctctgaactatttttttcacatttaacaaagctttatttactttctctaggccacctagtaaatatgggtgaaaaatgcgatgaaaaaccagccagggacctaggcagggaccacacagtcgggctagtgaagtggcaaacccatggcaaatattcgcctaaggcctgaatccacaatgagtaggaagccactctgctctacactgagtatcagtgacaccatggccactatttcttttctaaggaatgtttttgaaaactaaaattaaatgattacccacttcacaaaaaagatgagctcatattttacagaaataactgaatagaatctcggctaaaccatgatcttaatttcattacactcctacctaatcaatgatgaaaactgatgaacttgctcagaataatcattccgctgttcttcatcaatttaatctgaaccaaagtgcctactatgtataaatgaaaatttcaaaaatagttaacacgtacaaaaagaggagaaaaatacatatttagtcttgcactgattttttcatcttgtattcattgaaatcagtaatgaacaccggtagtaattgttaaaaattgttctcataattttcaaagtaaatgaatgtctttttttctgaagtatttttaataattgaaggaaaggtaatgaggccagacctaaacaagtgctgcctttatcactaactaagggttaaacaattggtatatttggccaggcgcggtggctgatgcctgtaatctcagcactttggcaggccaaggaggtagatcacctcaggtcaggagttcgagaccagcctggccaacatgatgaaaccctgtctctactaaacatgcaaaaatttagccgggcatggtggtgcactcccagctactcgggaggctgaagcaggagaatcacttgaacctgggaagcagaggttacagtgagccaaaatcacgccactgcactccagcctgggcaacagagcaagactctgtctcaataaataaattaattaaataaaataaaaacaattggtatatctgtttgagttttccaagaagaacattataagtacgggagtagagggcatataaaagtaatatttacaaaaaactaaccaggcacccagatctaaactctgtaatacacataatcaagtgcatggagtatctgaactccaaagctagtctcgtttcttttgcattgcactggcttcataactacaatatgcttacatctaatacttaaaacaacatgccttctcacacattttctctgtatgtcagaagtaagatttttaagaagcaagaatatggccacgactcgtctccaagaaagttcttactaataacaaagctccaacagaacaaatggaaatcgttcttaaaatgtagaagaacagaatcattatatgaaagaattttcatagatactgtatttgatacactccatatcagcatgaaacacttatatatattagtgatacttggttgtttcacttaagaaattgtcatacacaggcatacctaatctctttggactttgctctattgcattttgcaaataactgggtttttgaaaaattgaagtttcctggcaacccgacattaaacaggtctattggtgtcattattccaattgcatctactcgtttttggtgtctgtgccacattttggtaactttcataataacccaggcttctaggtatatgattgtacttgctatggtgatctgtcatcagtaatttttgttgtaactattgtaattgtttgggggccccatatgtgtccatataagtggtaaaattagtcaataaatgtgtgtgttctgactgctccactgactggcctggtcactcccacatctctctacctccttcattgggcctcgctattccgtgagacacagcaataatcaaattaggccaattaataagcctacagtggcctttatgtgctcaagtgaaaggaagagtcacatgtctctatcactttaaatcaaaagctagaaatcattggccttagtgagaaaagtatacttaaagatgagacaggctgaaaactaagcctcctgcactaaacagtgagccaagctgtgaatgcaaaggaaaagttcttgaaatatagtaaaagtgctatttcagtgaatgcaaatgataagaaaggaaaacagccttattgctgatatggagaaagtttagagtgtcctgggtaaaagaccaaagcagccgcaaaattttcttaagccaaagcctaactctctgaaggtagagagaagtaaggaagctgcagaagataaatttgaagataccagatgtcagttcatagggtttaagaaaaaaaaaaaaaagccatctgcgtaacataaaagggcaaggtaaagcagcaagtgatgatggaaagctacagcaagttatccagaagatctagctaagatcagtgacgaaggtggctacactaaaaggcagatattgagtgtaaacaaagcagccttgtattagaagacgataccatctaggattttcatagctagagaaaagaagtcaatgactagctttaaagcttcagaagacaggctgactctcttcttaggggctaatgcaactcaggattttaagttgaagccagtgctcatctaccattacaaaaatcccaggatccttaagaattctgctaaatcaactatgctccatcaatggaacaacaaagccgggaagatagcacatctctttatagcatggtttactgaatattttaaggccactgttgagacgtactgctcagaaaaagattcctttctaaatattgctgctctttaacaatgtacctggtcacacaagagctctgacagagatctactaggagattaatgttttcatgcttgttaacacaacatccattctgcagcccaagaaacacgaaaaacttttgactttcaattattgttatttaagaaatatgtttcataaggctattgctgcatggagagtgagtccattgatggatctagctagacaaggtaaaacaaaaccctttggaaagaattccccattccaatgatattaagaatgtttgtgattcatgggaagaggtcaaaataccagcacgaacaggagtttaaaagaagttgatttcaatcctcgtgaatgactttgttgggttaaaggtttcagtggaggaagtaacttcagacatgttgaaaacagcaagagaaacagaattagaagtagaactgaattgctgcactgtcataagatcttaatggacgaggagctgcttcttatggatgagcaaagaaagtggtttctttagatgaaatctactcctggtgaagatgctgtgaacattgttgaaatgacaacaaaagattgtgattatttcataaactcagttaataaagcagcagcagggttagagaagactgactgaattttgaaagaatttctcctgtaggtataatgcttcttaaccagcaacacatgctatatagaaatatttcattaaaggaggaatcaactgacgtggtaaactttactgttgtcttattttaagaaattgcaagtcacctcaattctcagcaactaccaccctgatcactgatcatccatcaacattgacgaaagaccttccaccagcaaaaagatgatgagtcattgaaggtttagatgattgtacatgtttttaaaaacataatactattgcacactcaacagaatgcagtgtcatgtaaatataactttaatatgcactggggaacccacaatatcatgtcacttgctttcttgcagtcatctgaagccaaacttgcaatatctctgaagtacggctgcatatcaataactacagacatcttatcagacattatagtttccacattagtacaccaggtacgatattactgattaagatgtaatatatttttctgtcatgagagcctcacatagaatgttacttcaattactgcttacacaggaaattttatgatttaaagtttataattaaattcaaatattactcgaattactgcatacacaagaaactttatgatttaaagagttataaaactttattaaacctcagttctaatgtttagttacatactaacttacggtgaccatattaagttatatcacatgaatttcaaaataactaactataaaacccagcatctaacataaaataaaaatgctttcctaattgacttccaacaatattctggggattacacaggatcgtgtagtagaaattttgaaagtgtgaagcatataaaatgttagatgtaaataaatattttattaatttctggtaattgtgtcaataaaagttgggcattgacattgcctgtcatttttgggtaacatccagtcactgatgaagccatgtgtaaaatgctttactgtttaaaaaaaattaaatctacagagcacaagggaaaaaactgcatgctggagttccttaaataatttgtgttttggaagaaaaaagcatataatacaacataaagtaatagagtcaaaactgaatatgctgaatgcaatcggtggtaggctagttttgatttgggcttcaaaagaatagtagagcttaatgtctttgtgcagtggatctgtggtggggataagtaaattgagtacagaggatggggagaaggtttcctcggcaacaatggacagactctgttgggggatgatttgagaggaccgatgctaccaatgcatctctttttttcaggcatttcttggaaatcatgctgtagaccccgaataagggctaggctgccccagcaggtcactgcaagtctctttgaagtctgcttctgttaattactttgaatggcaggagttgactctacaacaattatagacccaaacataagttgttttcctcatctcagcaatctatgtcaagtgcctttgttgttaatgtgacacgtcagatgaatccaaacattttcttcagtaaaatatttagctaacatatctttattttagacaaagtaaaccttttcagaaggcaagtgaatcattaagtgtgacaactgtatatctatatgctcaatactctatcattctcaaacacagtaacattttattagttcttaaaaataatattcataggcagggagtatgagagtgtggaatggggtggggtagaatattacatgtatagtgaaatggatttttattccatcatagtaattattgagccaacagtctgacagaataaataaatctcctaagatgcataaattgttgagagtttattgaattacagaaaaactgttcttgccctgtggagaataaaccaatctaacatagtttctgagtgacagactgtataagagaacccaacacaaaagtaattcatcacgaataaacttttaaaatccatgttttacatatgaaaaaaaatgctcaacatcattaattatcagagaaatgcaaattaaaaccgcaatgagataccaccttactcctgtaaaaatggtcctaattaaaaagtcaagaaaatataaatgttggcatggatatggtgaaaagggaacacttttacactactggtgtgtgtataaactactacaactactatgaaagacagtacggagattccttaaagaactaaaagtagaactaccatgtgattcagcaatcccagtagattcatttggtatctactcaaaggaaaagacgtcatcatatgaaaaaggcacatgcacaagcatgtttatagcagcacaattcacaactctaataacatggaagcaatgaaagtgatcatcagccaattagcagataaagaaaatgtggtatatatacaccatggagtagtagtcagccacataaaaaggaaaaaacagtgccttttgcagcaacttggatgaacctggagaccattagtctaagtgcagtcactcagaaatggaaaaacaaacgtcatatgttctcacttgtgagagctaagttatgaggatgcgaaggcataataataatataatggacattgggtattgggagaagggtaggaagcgggtgagggaatgaaagactacatattgggttcactgtaaacttctcggatgacaggtgcaccgaatctcagaaatcaccactaaagaacttacccatgtaaccaaaaaccacctgtaccccaaaaactactgaaataaaaaataaatccatgttttaaacagaaatactgaagatgtgtagatttacatataaaatataaaaacttataaatgcagatacgccttacacattttcttttataaagtaaatagtactactatacaagttattttaagcttgtcattgtgtttcaaacatgaaagatctcatgcttattatttttgaaaaagttctaccaccaaaaaacagagaagttaattttgcctacagaagaaatcagactctgaaatatctattaatgatagacattttagggtggtgaatttatatatacacttaatatttttcaaaatttgtatttcagtatgttagcaatggtggggggaaaacagtatgttattttgaaaattatattgaaaataatgacaaaaatgtttataatatgtatgttgtaaagaagtaaaacataagcacctttcaaaataattcagtatattcagtaaaatttaaattatttcctctgtgtgtgtgtgtgtgtgtgtgtgtgtgtgtgtgtgtgtatgtatgtgtacataggtttctttgtgtggatataggtattcaagaacaacaacaaaaaagaacatatacaccacaacactgccaatcaatatgtaaccttaactttcttgtttgggtttcctagatgttcccaaatttctataacatacctacattgctttttataatacaaatttcatactagcattcatttttaaagtagcttatttttcaaattgttttgttgtatacacagttctctttttattaaaatattattaagactataacaaatatcttaaaaaccacaacttaacccaagaagtttattaaaaactaatcatacgcttcttccttatgccatctcccttctccccccgagattatgtctacatttaaaatatatgtatgtatttgtccatattttacatatatgtccaaattgtcatttacttttctactgtttttattttttggaggcataatagatgtacatatttccatgctacatgtgataattcaatacattcatataatcaaattggggtaattataatatccatcaccttaaaatttatcatttatgctagaaaataaaaataactcatatgtatacagttaagaagaaataaaagcacatttcaaaataaaatattcagaatattcagtaaaatttaaattgtgctagagaacaattcaaaagttcctagcaaatgtattaattaaacatttagctgaaacctgacttgctgaattacaaattcccaaaatattattttaaccagattctctggaaacatcctatgccatttacaacttttcttctacattgtataatgaatgctgataataattttcaagtaatttttgatttctcaaaagtttaaaattgtaaatatttctgtccatcagtctataaaatttgattgattcctgaaacactaaggtcctattaaatgcatcctcaaggtatctgaataaaaggagctttgatttaaatgtgcttagttttaaagtgctctctctccgagcagtgggtttccttggatattttactacctacacatttctattaataataagcatatggtaattcatgaagataagacttaatgaaaaaaattaaactctttttcaactgcaagcccacgcagagtttgactagaatgtaatgagattttttcccagatgttatttatttattttttaactacagagctaaatcttgcctaaaacagcatggacacacacaattctttgattccaatttttcctctgttccctcatacgcaaggaaaaataaaaatatagcgcaattccttaaaccaaaagggtccccaaccctggctatgggccagtgtcagtctgtgcccttttaggaattgggccatacagcaggaggtgagcagtgggccagctagcaaatcctcctctgtatttacagcccctccccattgctggcattaccacctgcactctcctcctgtcagaccagcagtggcattagattcttataggcgcgcaaaccctattgtgaattgggcatgcaagggatctaggtttcgagctccttgtgagaatctaatgcctgatgatctgtcacgctgagatgggatcgtcacccccagatgggaccatctagttgcaggaaaacaaggtgtgggctcccactgattctacattatggtgacttgtattattttcatcatatattactgtgtaatcttaatagaaataaactgcaccataaatgtaatgcgcttgaatcatcctgaaaccaatccctcctcttccagtggaaaaattgtcttccaagaaactggtgtcaggcgccaaaatggtagaggacggctaccttaacccaagcaccttttctcaaagtgacactgctaaggcaaagcattacatttatggtacctgaaccacaccacacctggcccatttgactatttctacacagatgcctggatgagcaatttaccttcagggactataaccctcaacccaggaggacaccggtgcatgaggactgaaaatgtgctcagttcagcttcacagagagatagatgtagtttttcctctaaaggcgacattggtccggccattctacttactggttagcctcagtttatctttaaaaactgtttatgatttataggtccttttccctaatgcccttttaaatttctgtgttcttaatataacatacgctcaaaatactaatgcatgtgtgaagtctgtatttattactggttatttaaacagttactgggataagaaaaatattttggcaatacctaaccataagggcaatgattgagctatagtatcgtcccacaaattgatgtgataatgtcataaaatcaaatgaatacatcattgtgatacttttttttgtcttttaatttaaaaaatactggcacgacaacacagtgacttagatatattgtgacagtttcaccagtacgttactaaggggaggtctaaattattaagttttattttgttactcaggaaaatcctgcttttcagagaagataaatgcaataaaatctctctattaccccacattacctgggattcaacttcggaatttatgtttgtcattaaacaagctgaatgcattgttatcttatgataaataatataaaaatgactcaattgaggatgtttcctggtgttcgatttttatcaactgttttgatttaacctttgtacaatcaacattttaaataattttagttctatattttataaagtgtatgcaaagcactttatcacccttgacaactgcagaactagaagagtgaagtattcttgtagtgagtgaactcaattttgttaaaaaaaaaaaagtcagatagctaagttatattagaatgtcttataagttgtttttttttcattaaaaaaaaaaaaacagaattccagcaattgtttctgacaaaaatgatcagtcagtgggtgctgaaattagtgaacagaagtattattgaaaatggaatctgtacagagattcaaagaatctctcaaaaaatatgtattatttacaaaaagaaaaatagtgacttttcatttgaaatagctggtaaaccccatgtaaccaagagatcaaagttactatcacaattaataggacaagtcaacaggggtcccctgctataatgaactgaagacacaatgccaattctggacatttctgccaaaaaaatatgaatcacctgaatctaatcacaaagaaacagttaaataaacccaaatttagggacagcctgtaaaataattggcccttactctccaaaagtgtaaaggatatggaaggaaaaaattgccgtttcctatttagggaaacgaaagagacatggcagctaaatgcaacctgtgatgctgaattaggttctgagccagaaaacacaatggtggaatgttaggtaaaatttgaattaggtctgaaaattaggcaatgatattaaatcagagttaatatattgactttaatagttatactgtggttgtgaaagaacatgttcttgtttttgctctcaactatttcaagaaaaatatacagtgagaaagaataaagcaaatgtgataaaatattaatatttggggaatcttagtgaaggctacacagaatttttttactgtttatgcaacacttttgtaagtctgaaatggtttgaaaataaaaagttaagaaaactgtctctcaggctggtgtttttaaaaggtgtctccttcaaagagagagcaaagtagagaaatcaaacctgtcagtttgagccccggataattaacttttgcataatgccttattttttaaagaataatttttgtaccaaaataagatgtgttcctctctacgactgaatattgacaattaactgagtgggtgattcttcttcatattcaactgataaaataagcctttctagttttggttttttttccctgaaagttttgatgttgtcagatcactttaacctttagattaggcagagtttgagttttaattaccacacatatattcaaggaaatttaaattgtctacaactttaaaaatacttatcatgcaaattcccagatatgccaacatattcaccaacagagacttttcctttataactggtggattcatttttggggaatggtgggaaataaaaagatctatgttgaaaatgcctcaggacatttgtctcttgacaatatttcaaaataatgcacttttcaaaactatactctcaactcttttcttacaaatacccaaatgatctattctgtttttgcgtttcttcccccgccaatccaataattagagctagttctatgagttggccacagctctgacagttgattctgggttgtgttttctaattcatccccacaatcagtgtttctgaacgctgtctctcactttgttattcttcgacattacaaggatgacaaagatatctaataattatccatctaatgcggttcacccgcaagtcaaatgtgaaatgtcagatgtccaggacatccagagagagctctataatccctcattttataaatgtttaagacaatgtgaacaggctgaccccagataattataaaattaagcctttgtaagtgatacacaatttgaacaatgattgccaataatttgaccatgagaaagacaaaaaaaaaaaaaaaaaaacagaagctaactatttcttctggaaaattgtctttagacgtgaaaaattaatataagctgaacaatacattctccatcatgtaaattgaaataatcactagtttaataagaaattaacttatacttaaaattactatggacataatgatgtccacaaagctttcataaaggtaacaaacctgcacaatataaatgaacggcttaacttttttgggggggcatattacaaataacttcaatagtctaactgctaatcttttcaattgttttcttagttactcttcaactgtgaacttcccatatttccaaagtttattggtaatagtgaaaggcgttgattcatataacttttgagagacaagtttaaaaaaatctcttaaaagaactcacaattaatatcatcattaggcaaactaatgtactggttaactcacagtattaactaagcctgatgtattattttacttaggtgaaatgacgacagtccagatagctcatcgacatttaaagctcatttccttaccttaggttactaggggatagaaaaccaagaaatgggctggaactggagatatgaaagtagatgagaagcaatttcagacttcacacaccaacacacacatgaggtagtataaaaggtaaatattgattgtagtgaatcattattccagaaatgctgtagacataagaacgtactgactattcactcaagacgtggctccaactaagactatcatgattattattactaataacttaaatttattgaaaggttatgttccagaccgtatttaaagcactttacttaaattttgctcataacattctacgatgtaggcgctacttttacctttctttcaatactaacgtaaagtgtaatggtgatctgtggaggactttatcgcttgcaccttggaactgattccatgcacatgatctcacataatcccaatgcaccctttgaaataagattattacaaagaataaatctcagtggtttagcaactgttctaaatgacttgatcttccaagttgtatgcatcttgatattgtaatttccatattagagaacacagtaaactagtctcatctcctcagtggaagtgttatctcttctttacggaattacctcacattttcgtcaaaaaaatcattttatcacgtatgtgctggcctgtctctggattttctcgtctataccattgagcaatcccgcatcaccttggctactttagctcaatattgacatcttcaaatcgtattatgtaagtcctcccactttgttctttttaaatcatattgactattctaggcccttggcaatttcatatgaattttacaattagtgtgtcaattcctaaaaacaaacaaacaaacaaataaatgatacatccttttgggctcttgactggaattgtgttgatcctacagaccatctacagatgaataaacttacatcttgaaagccctgcatcttctcattcatggtctagtgtatctccccttttcatttttcatattttgttaggtctttagtaatttctctcagctatgttttacagtttcagcatgcagtcttgcatgtatcttcttaaatttattactaaatctgtcatattttaattctgtaaatgttataattttaaaaattttgttttgaaattgctcattgcttgtatcgatttatattgtgatctcaaaccatgcaacagtgccacctcacttgttatgtctagtaacttttgtatagatttaaaacaaaattcacagcaatcacatcatataaataaatacgttggatctcatatttctaatctctatgtctgtatttttcttgttcatggcacttgcttggtaacttcattacatgttgaatagttgtaaaagtggatattatttttgtttctgattttatgaggaattgattcagtctttcatcattaagtaagaaattagttataaaatttccatggatgccctttactgggttcaggaggtttctctcagttcctagtcagctgaaaagctgcatgataaacagatgctgaatttttatctaatgttctttccacatttattgacgtgattatgtatgcagcttttaatttccagtctgttaagattatgaattacaatgattttcaagaatgttaaaccaatctcgtattcctgaaagtgaccccagtggtcatgacgtgctatcctttttataaatcactggatcttatttcacaacatttttaaaaggttttttctgttttcgtttcatccagtttaattttttaatttttaggtaatatgtacttcatatttggaaattaaacaacactcttctacataacccacgggaaagctccttatatttggaaattaaataaaccatgggttatatagaagtgttttgtttagtttccaaatacgaggagctttcccacatattctgttatcaatttacagtttaattatgttgtgataagataatataacatagtatcaaacatttttaattgactaagcctttttttaacggcacagaatatagtttatcttagtgaatgttccatgtgcggttgaaaggactgtgtcttccgctgttcaaggggaagtgtttcatatggttcaagtaggtcacatttgttaacagggctaacaaaacctccacagccttttcaacttatgtctacctgttctattagttaaaagtcctgttaaaatctccaatggtaggctgggggtggcgtctcatgcctgtaatcccagcactttgggaggccaaggcaggtggatcacctgaagtcaggtgttcgagaccagcctggccaacatggtaaaaccccgtctctactaaaaatataaaaattatctgggcatggtggcaagtgcctttaatcccagctactccggaggatgaggcaggataactgctttaaccgagaggcttaggttgcagtcagctgagattgcaccactacactgcagcctggcaacagaccaagactccgtctaaataataacaataataataataataacaacaagtgtcgcagacatagtatgtgctatatatatttgttaaaaaataaaaacaaaaagtcatgttagtctgcatttgaagagtataaggggcttagaatttgggacagaggctttaataaatgactgaagagcactttggaagcactgatgcatacaggagagggagggagaacaagaaaaataggggaaagacgttaggttttgtgacacactttgaatgtgacccttctttggcagggaaattttctccagaagttgttttgaatagtttgtcttcttatattttctttattttatatatattatatttggttgctggacaaagatcttgactgtgaacttgctcatgataaacgatgaacgtgttttaacatcaattccacatacttactgctttccattatctaaaagtacaactttcctaaagaaataatggaaggaccaatgagttctattccaccaacttaataatgaataaaaccaacaatcaataatacagtgacttaatcagctagaaaagatgagcatttcttcaatatgactattacaatcaaaagcagttttactacccagttatcattttgaagagacatttttatttgcaaggggtatccaattttcaatgttctcattattcagaaactaacaaaaaaggagattttttttttcagaacactgactggtacaaaaagcattagtagaataactgaggatgggctactggaaaatatttatcaccagggtaagaagttgtgtatataacaattaaaatgtattaaatctgaactagaattttctaattcatgagtgtgatattactgtttttaaaagctatttttaattaataaatacaaattatacctatttatgatgtgcgatataatattttaaaatatggatgcattgtggaatggctaaattgagctaattaacatatgcattgctttacatccttatcatttctttatagtgacaacccttaaaatcttctgttagcaattttgaaaaaatacaatataatgttatcaactacagctatcatgttgtacaatggagctcttaaactttctcatcctgtctcactgaaatgttgtagcctctgaccaagatctccccaacacctcaatctcacagtccctggaaacaaccactttacttctcagactattctaactatcacatggatgaggtatatagaagctctaacaatttaaggaaaaggatacattttaagcaccaatactatataaattaaaaggttattattacactgtcaggagcaaagagagaagctagcaacattaagtgtgtctaatttggggttattttggggttcttttgtgtgggggaaactaattgaagaacatgagggtgggtggtttgtttgggagatgattttaggtacaagattgaaggggcaacgaggatgagagaaaggaggaggagaaggaggaatattataagggcacatttcctgattcatggtatgagcaatggggacttgatcccaccaggatctccaagaagcgcacaagacagccacaagcactgttgcctctaacacatggaaagctggggcaatgacctgcttccatctttcattgattgaggggatccctggggacatggcctcctcattcagccccaattcaagattgtgcctccatgggaagctccaggtgttgaggcaggacgtgaaaacacacatggagaggttcatgccagcagagcgacgtgtctccaggcttgcatgaaattacccactacatttgccagggtccacggcatttcctgtgcgtatttgctgtcacgctacagacaggactgagttgccagaaaataaaaagaaaatcttccttaaaggcaatgataataataattagacacgttacactgacctgcatttatacaccagctgacttacagaagaaaggtaaaccacaagaccctagaggccacgatccaatactgactgtgaagtttctcatcatgcagtggaagaattatgatgatgaattagtagtttgatacttaaacacaaattatcaaaataaaagaacctattctccagtttgatagtttccaagtagaaaagccatctgactctagctggtctgcataaagtttaagaacagggaaaactctccggtacagttccaatcggcctacgggtcaatgtaagtagcagaagagaggttcttctggatctccaacgcatgagtggttcagctgctaatgcacaaacataacacgcccctttacttctgcagactccgtccacttgctgccagttttctcagcatgacagagcctcaatacaagcgttccgcttgcccatagcaatattgcgtgaaatatgaaaccaccattaagtcgtggctcagcaggaacgtgtttgatctttttcttcatgatggttaaaaagttaatgtttctcctgccactttaataatgcattatggagcacaggataaaacttcttcctcaaaatgtaattggggttttcaatcttttttatctcttacctcatcgctaacaaacagtacatggtataaacatattcttcggtcataataggtttagtatattaaaatactgtgctaagtagaatattttctttaaaagattaaatttcattttatttctctttcaaagaatacttaataaaaaataaggaaaaccaatattcataataagccctgaacagacaagaagaaaaaacgattcttttcatcacataacagttacagtaaaagcataattcaactgagccccgtttctgatctacaaaagtcactttagtgagatttttaaagctgtttcaactatttgaaaataatacttgaattttatacattaatctgaaagaatatatctacatttataggcaggagatgtctcaaagttgtttgttttacaaagacagaagttttgaagcaaattcctgccatgtgagacaagacctgtataggtagtttgtggggactgcacaggcgggcacgggtctgacggtgactgaggccagagtggatttcctcctcagccctggcccacctttgtgtcttccatggcaccttctcctcgttttaagcaccagcccagtgtcctgaacggagcaggaattcaagaattcaataagtttgttaattaaatgaatgcaaaaggcatttggggcagaatgtaacttaaactctgttcattagtgggatgtagagtgctgtattttcctccgcttgtgggattccaactgcttgaataacaactggttgacctgagccccagaaattaaccatgtaaatatgatgatctatctaagtaaaatacatcgccaaagatatgaatcatcatagaaaacaacgagagaaatactactactctaggaaacagctgacaaaaatattggaagaaaggttaaaattttttaaaaattaaaaaataaacatttgcagatatttagttctaatttaaaatgagacttcatgggtattaacaacatggggggcattaaaacgtaatagatgagtagaaaatgagggtgacctgtgctgagaacaaattagtgagctggcaaagaagtgaaaaatagtaactcaaagttaacccaaaaagaaaaattaaatacataacttgcacattaaactacataagctatcctggaggaaaaaaaatcttaaataaccagtttcccagaaaaaaaaatagatatcgaatacataattatgaaagtaataataaaggaaattttccctgattacacttggaacaacttcaccatttatgtccaagatggatgaaaagatactgacctaggtaaataattgtaaaattcattagttgtttgaataaaaataaaaatctttaaatttccgacagaaagaacaaattatttaagtagtggttcacaaagtatggtcgcagaaaccttcaatgggacagagcagaaactgttcatggtgtctccgaggtgaaaagaattttcataataagaagattaagatggtatgggccttcctcactcttattctcctgagcacacagtaaatacttctagaggctacgcgaaaggtgtcgtggctataaattgcatgcagaagccaatagaataattcaaccatcttctgttgaaccaaacataaaatagatttaattctacttagtttcttcattaaaaatatgtatgttgatatgtaaagggtaattattttcataaattaattgattcacatacactttaactcagttttactttctagtactaacagatacaagccacataaacaaaacctccttcaggtttggaaaattttttaacagtataaattcacagaggcagaaaacagatcagcagtcaccaagagacagggagagaggagaatggaagaaattccttaatgggtagagctgttttcctggggtgattacagattctgaaatcaaagagatattattgttgcacagcattgtgaatacactagatgtcactgaattggacattttaaaatggcttattgtatgttatgtttatttcacttcaataaaaacaaaagaagtacttgattattaagcaatactctcattaatcaaagaaataaaagcagaaagttattttgaatgcagtgaaaataagagcaaaaaacaaatcatctctaacccaaggcaactcagcgaaagctgtattgagtgcaatttatgtcttcattaatgaaaaagaaaggaatacaaaacaaccttccagaatacactatttaaaaattagaaaaataacattatttaaaaaaatacatgagaaggtttactaaagacaaaattataatcaatgaaaagaacagaaaagaaacagtatttgtaaaggagaagaaaatcaaaagctttctctgaaaagatcaatgatcataaaccctaaaaaataccatttataaaaaaaaatcaaactggattagagattttactttgtgtagaagcactataaacattataggattaaaatcaagaaaatatataactgatataggagttaaggagaagtttttaccctggattaagagaattcaactcagaaattctctcataaaataaaagattatttagcatatattttacatagtatgtataaacattacatgccatataatgcaagttaggtgtttatatatacttagatattcatgtgtaatgagtatatagaatgtttctactcaaaaattattttgcacagagaagagaccataaacacacacagagagaggtgtatgggctgagtttgggggtttcactgggaaaagataatgacattgccctgagtggagttttacagcttcaggacttccctgggatagataattggagctattaaagtgggtcactgcgcccaagcatacgcatttcaaggtttctatgttaggtgcctcacctaagaacgctgggactgggagcctggggaagtgatggcggggaggggtgaggggtggataggcacggggactcaggagaagcttcccccacagagcccctgagctgctccacgtgacagctgagcttatccacaagccccgcaacacctcagagctatacagccatgagaggtctcattttccctgcagttcctagagagcctaatgttctgggtggtctcctgtgtgaggtgctgtgcaggccccaggactgtgctctgggccactgtctggaacggccctggcaagggtggctctgggtctcgccttaggctgggagcgcacaggagcccttccttcctctggtggtgatgcctccaggtctcagcgccacctgctcatggtgagcggggcacatgcttgggagctcctgtccccgggaccccgcctctaggaagctcgtgcaggggcctaggaacgtggccagtgggagagatcccagtttcccgaggggaatcacatatgggtctgtagaaacttcagcccttgcatcctcagaagaaggaatttgactgaggggcataaaggagaaaaagagacccaggcaagtccagagcaggagtggaagtttattttaaaagaccttagaacaggaaaggaaggtgcgcttgggagagaccagggcatgcacgcgaaggctgaagagagaaggtcaagagccatttaactgggatcctaggacttttttttcttttttgagacggagtctcgctctgctgcccaggctggagtgcagtggcggtggtgatctcagctcactgcaacctcctcctcccgggttcaggcgattctgctgcctcagcttcctgagtagctgggattacaggcacccaccaccactcccagataatttttttgtatttttagtagagacggggtttcaccgtgttgctcaggctggaacgcctgacctcgtgatccgcccaccttggcctcccaaagttttgggattacaggcgtgagccaccgcacctggccggatcccaggacttgtatagactcccctctttcccatgattcttcccttagggcaggctgcccgcatgcgcagagccctccttgcccctcagaactgagcatgcgtaatgtggcagggagttacatgcacgcagagcctccttgcccctcggaagcgagcatgcgcagtgtggcagggagttacatgcatgtgcattggagtctttcttccttattctggtggagggtacgtggaaactcatgctcctccatctttgtcctttaacacttatgcacagaaagttgtttctccctggggtctgcattcagttaacattttgatgttaataagtgtggaccatcaggaaatggcctctcctttgcactgctaatttatcattttcaaagaggcaatgcgataattatgaaccatcacctgacatttctagtgggtgcgggaaagccgtctcctgcccccctcatacctaactaccggtaacgggaagacagaagcactgactgtcctcctgtcctccaccacccgtgaccacgtgcagagcaccttgaatgcgcctctctctcctgtgagaggcccccacagatcccaccggcaatgccaaccaacatgcaaaagaggcatgcagtgtcaacaccaaacacacatccagtgtgttcttggtgaaactccatgttacgccacagaaacaaaaaccatacatccctcatcttactggttcagagattttccaaaaatgactctaagcttccatttaagacacaggtcaacaaataaaccagaatgaaaaaatgtagaaataaagtagaattttgtactgatatgtcattctctctactcatgtttgaagctgtcagccaacctctaataagtcagtagaggatttggcgtctgaaaaaatgtttacatattccataggagattggtgctacctgccctgctccattttgtagtattgaatatctcatcaataaatacctcactacttcctctttcaccgattctaaaagagtgtctcagaggatgaggaaagaggatgaatacgtggacacaaagattcttcgagaactgcctcaagtaagaaaaaaacagggtcaaatacatagaaacccagtgaattaatatcccttagaaatcaatcatatctctggttgattaactgaggggttcactttgccccctgccacactgagatctctgttcccccaggctgggtgcaatggcacgatctcggctcacttcaacctttgcctcccgggttaaagcagctgggattacaggcgcccaacaccacgcccaactaattgtttgtatttttagtagagtcagggtttcaccatattggccaggatggtctcgaactcctgacctcaggtgatctacctgcctcagcttcccaaagtggtgagattatttggcattagccaccgtgctcggccaggtttcctttctaacccttttaagttctgaccagatcctggaccaaaatctaataatcttagatgcaaaaaggttgtacaattttggggtattaaccataactaaatgtagatagcatataatgtgccaggtggtgttgttaactttttcacaaattaatacatttgacttttaaaacaatgaaaccatcacatcaaaactgttattatccccatctcaagatggggaaactgaatcagcaagatgttagtcagttgccttatagaacaattagaagtgagagagctagaatttgaagcccagaagtctaactggaggcatgtatgtttagccactatgctgttgccttgtgatagcttgagtttcataatcatccacgtacattcctaaagagattgtaggaaaaataaagaggacaggtggaaactcagtaaaaataatggctactttttatcaaatacttaatatgtatcaaatactgtgccccatgttttgcatacataatcattaaattctgataacaagactaaaatgttgttattttcatttttggataagacgactgaaaattatgagttactacccgatgtggcagaacctatatttgaaaccctactctaaggaagttcagttgggctgaacgttctttagcccaactccaaagcttagttttagcctctggaagaatcgatttaggagcttgaaggacacccagccgttacggaaggaagagagaatgttggtggctcttcctgactaggaactccttggaatgctgcaaatgtacaggtgattatctctgcattgttgcaaacactaaaggctattttcatatctaaaaagaatattactttttctatacggaaaggttggacctgtttttcttgtgggccctaaaaaatgaaacccacatggaagtagagagtgacaggcctatctcagaaggaagaaataacgtaggagacaaaaacgccgggggaggctctgtatatgtctttggaaactatttcctcacgttcctgctcctaatgccctgcctctttctccccctacttcacacccagctctgctagatccctgatgtaactgcagaactaaaacatttctcaaaatgagaagacagaaatataggagcaaagacagtctttgtgtgtaggtttcactatcgcagtggggatacatgtacttttgtgccctcagaaatatttttttagttgtttctttcattcaacaaatatttatgagtgtgttctacgtgctaggcaccaaggcaggtgttaagcataaaaatatatgtcagtctgggagcagtggctcccacctgtaaacccagcactttgggaggccaaagcaggagaagcccctgagcctaggagtattggaccatgtgggcaacatggccgcactcttctctataaaaaataaaattttaaaaaaactagctgggcatggcggggcatacttgtagtcccagctactcagaaggctgaggtggacagatggcttgatctcaggagttcggggttgcagtgaactatagtcatgccactgcactccagcctgggctattaacagagcaagaccatgtcggaaaaaaaagaagagaagaggaaaagagaaaagaaaaaggaaaagaaatgtagaaaagaaaaaagaaaagtatgaatatctattttccatgccaagaagaataatgttgttagtttcataaagctcagaggaaatgaagggataatcacaaattatgtagcccataagaggcacatttggagccgatgtggggctatcgctgtataataatctcctttgtttggctggtgatctacttctcagggcagcaaatcctgcagggtataaaatatttgaaaatatttttactttctttttgcttgcttaacgttctagattaaaccagagaagacaactaatagaatatcattctcttagttgtgcctgtatactgttcatgtgctatcttaacttttattactataatgctacttgaagaaaaagtcaacatgttaatgaagctgccaaagtcttaatgagcattctgtccttctggcaagcaaatgaaattattattttggagaaaacaaatatcttaacccagaaatccataaccaaacatgaagatagactacgtcttccatcgttttgtaatattacaatgtggttttttgtggggatgtggaaaaaaagtttcatttttttaaactctctcttttttttttttttttccaacttgctctttgaacattaacttttaagctgtttcactctctaggaaaccaaaaaggaggcagaaaaaatggtgagttcatggaagcatgtgcacgtttttgaaatatttgttttatttttaaaaatgaattataattgaaattgttcctgcttatcactaacattttagaaatgcattcttctgggtttagttctattattcatttactgaggtatcaatttactcatttatctgcttgttctttatccattcacatacccgcatttgaataatttaaatgaggtccaccacatattgtaaaatacaaattagcctataaaaacaaaatgtcaaagagggaaatggatcaggacataactgagggtcaaacatgaggcttttgtggtttaaatactatgggtgaggtcacacaaagcacccttctgtccagttcaaagaggaacgacattatggctttatctatgatacacatcaggaggatctgcagaggaaattgtgtagtaggtgaagtgtaagtagatgataatggaaaaagagaacagatattcagtgaacgtgacaattctaatatacaatcatttgtgcaactcacattttttgagccctgaccttggcttaggatctgtgagctcccggtctgggccttctcccatgcgtctccctcctccctactctgcggcggcttctccatgctcctccatacttcctactccccagcaccatgtttctcaagctcagctcttaacaacgcctctgtcacatgctttcacttttatatcgcacaccagtctttacatatttaaaagcataatttgagtataagaagttacagggcatctttttaaaaactgacttaaaaaattcttatagtttctagacagagcagggtgggacacgtgtgtaatcccagcactttaggatgccaaggcaggaggacttgaggccagaaatgtgggatcagcctgggcaacatggcaaaaaaccctgtctctactaaaaatacaaaaattagctgggtgtgatggcgccagcctgtagtaccagctactcaagaggctgaagtgggaagatcacttgaacctgggaggtggaggttgcagtgagccaagatcacgccattgcactccagactggatgactgagcgagactccgtcaagaaagaaataatcaaagaacaaaccaacgaacgaaagaaagaaaagagagacaaagagttcccatagtttttgtctcttttaatctaaaaataatttgaccaaatgctccaaatcacagcatctcacttgtaatttatgtttttgccatgctttctcttatttgacttatgtcctagtacagcaggtaagtttctttatatgatatacctgaacacagaatgttttgaaactgcagcgggaacacactcaaacttaggtatgtcttcagttttgtgattggaatagctgcaggtactctgacctgttagcaccttctggcattatacaccaagtgatgtagagaaaaactttctatattgtgaggtatataacgtgtgatctgccttcattccttttattatttagatgtatgggtattccctgaagccctgtactagccatttgatcatgtggtacttgaacatttacgaaataacaaagagtgtgttaatcacagtatgtgcgtgaagctatttcaagcctttgcaaggagccttctgggcatctcagggaatgtgtttcaggatgatcatcttattagacaacagtgctggagctaagtggaaacacaggttgttcaaaatgataatgatagaaacttacagacattttttacagcgtatcttcttgtatgttgcctttacttgtgaatttttctttcaatcatggaatctatttctaagaaaattttatttcctctcctcacattctggaaacagcaaatcctaagtgccatctaataaggaatttagcaaatgttactctgcaaacctttaaagtacattaaactttccaaatgtaattgacaccctttcctcatcacgctactacttaaaagcatggcgtgaatgtcttctatgcaccagacagaagactagatagtccctcaatgctagtgagaaatacaattttcaacacaggggcgaatattatttatgcctttaaagactgattcttataaatattgagaaaatttaaaaattagcatttaagtgtgccaattaggaaagcatttttagtcttgaggatttaattactgataaagcaaaaaagttattttaaatattgtatataacattaatggaaatattaatatgcactgattaattgattataaatcaagaagttatgataaaactttttataaagataaatttaataagatatatttctttttaaggataaatttaattcatttttataattaattgatttaaaatcaagaagtgataaaaacatatgtagaaactggaaaattacaatttattatttttactgaattaaaattaccttgcaatcgtaacattgtcataaaatgacacacttttatacctaatgtttatacaaagctcatatcacaaaagtcctctagacttagattattcctctggaataaatggataatactatcctcttaatattgtatgatttaaattcttttaaaaatatattaaattatctgaaaattataaattgtacaattcccattttaaaaaagaggaaaagataattcagaaatcaaacaaaattgaacatgaacaaactcaaaggctacaaagtctccaagaagctaataattaaaaattgcatctcttcttgcccataatagtctctgtatttcactaagttatcattttctctgcctataagcatgaaagtcattgtctcaattaaggagattttctttaccaagtaagctattgaagaaaaaaggattctgagttataagcataaaagttatataagcataaaagttatatgagcataaaagtcatcctttcaattaaggaaacatttttaaccgggtaagccactgaagaacaaggattctgattatctagactccactgtacacagtttcagtttattttccccaagtgccaaatattcccacaggtgatctttgacacagatttaaattaaaaatgacattttaaaagtctagccccatatgcgttcattattaagattttgttcttgctttgtgaagacaataggaaatctatcctaggcagaaatttccactaaaggtatctataaaaacgctttgagatcataatttactcaggcaccatttgtaacacaaaatctgttttatgtaacattcttgataataaacaaataataaataaagtgaaagcaaacttcaaaaaagaaaaagattgctgcgatactcatgggagcatttcctgcgtatgtagtaaagcccggtctttcatgatgaaggcatcagctttgataatggtgcactgggtttttaatatttcccgctagaaatgctattaaataaataaggcagcatcatgaggaagagatgtccctttagtcctaaaacagcgcatcctgccttacgacttcttgagtcattgctcaaaaacgaatgggcttgggcgctttcttcctcaaataccacatattgaaaggaaaagcaatgcagcaaaacatcacaaagttgcacaaagacatgcgtgcttgtgtcatcttatttcctcagagttcctggacatgtgagaaggtgcacggaccatcattctcagagataacttgagcttggactcagacccagccaggaccttcctcctctttctgtgtccagcccacacctgagcacctacttcatagacctgctctgctgaggtggtttgaatataccacattccagaatgggattgttttgcacctgtcaagattttcttctgttcactccagatttggtcatgatgaggttcttctgtcctggaactgccctacacattcaacttgggatttggttccagcagtgacagattatgcaggattaagatcccaagtacagtgcactagagcagagtcaggcagcacgggcgttgtcaccacgcagtcctgaattcaaggtctaccaccctcacctctcagctgggtgatgtgagagggagcatggatctccttggatgtcaccccctgtttatgacagccagcatgcaggaacccctatattaacgtaataggctaatcgcaggtaagcaaagtgtaggggtcatgatttcacacgaggagtaagcaatgaaatccatgctatgaagaggaaaggagaggatcattggctgaaaaggagagcatggacattcaattgcagttagatatggaaatcagagcagctgggtggggagtgtggtgcagaggtgcggccctttcttgcagactcttcgggttggactcaaggctggacactctcagaggctggcatctatgtttccacaatattcatatttttaaaaacattgagggcaataagtttcttttcacattttacatgttgtgataaaacagacatgatttctattattcaagctgtaaaacaactgaagcctgtttttatcattatgtctattttttccacaaaacttttcactcagtttttgtttcgttttgttttttagatggactcttgctccgtcacccaggctggagtgcggtggagcaatctcggctcactgcaacctctgcctccgaggttcaagcaattctcctgcctcaggagtagctgagattacaggtatgcacaaccacgtctggctaatttttgtgttttttagtagagacggggttttaccatgttggctaggcttgactcaaactcctgacctccagtaaccctccattctcggcctcccaaagtgctgggatcacaggcttgagccaccgcacccggcctcagtgttttgaatattgtaattgtaataattacgagtttgaggaatgcatgaaaaacaaaggttccaaatccatggctctcacccagataagccaattaaatatgttggaaagaacgtgtggtgtttacttagcaagattttcagtaatatatgacatcctatactccatggttcctaagtagcttgaaaatatctcgctggtctctttgtccaacttaaggtgaatgaatgcctcataactgaacattatgcaatagaagtacctggggtgtacattttaaaattcagaaaattttctattataaacataaaattcgtatttcaatttaaaaatattaaaatctactaagtaaacaaaaaataaagtttaaatttagtagcacatatggtatattgtttcatttttaaatactaaagctatgtgcgtatgattttgtatgtgtgtaagtgaatatacatagatttcatcgtagacaaactgcaataattttgatagcaaaacaaaagctatatgaatatcacaatagtatagtatatgtatagcaacctaagtcagacagaaacttaatattttgaaataaaatcaacatcaaatgtaaatataatcttaaaaccgcagtttaagaaatgaaggtatagatgttaactgacactcggaagaatttctaactcattgtatcccaaatttcctccctttcagaagaaaaagaagaaaaagttcgttggatttaaaggtattaagtcaaacagaatgagttgaagcatccccagaatgcacaaagaaacttcatgctttgcataaattactttcattgatagcacagcatgaggtgcttgcttgaataacttttttgtcaacagtaaaaagaacctgctttcagaaaaaaaagttttgcgtaaaattcacccaagagggtgaagaccaattttcatcttaacaagtaaacattaaaggcatttatttttttaaagactgtataaatgagagtgatttactaaattatactttttgtggctatccctcctttggggcttagagctcacaggctgctttagggagcgttccacagtcacgcggccataagtctcattgtgtcaccgtgacttatttgagcactggtacaacttaattcacatttgtttgtatcaattccaacgtataatttagcatagctcctgttttttgactgaggccttaatcagccagtggaaggagacacaggtgctggtatgcctcattttgccgcatttgtattctctttctagcctgccatactccaagctctcataggaagaaatgagcaccaccaggaaataaatacactggagaagtcttgcaggttaattctctgatccacttaaatcccaattgtaatgttttagctagttgcaaagaaatatttaaatttgctattcaagttgaggtgtctctatatttttacttttaaatggaccatagttattaaataaacgcttcaaaatccattgcaatgtacttgcgtgacacatacattgtcctgtatccttcataaaggactaatgtatccaacaattatttgctgacaatctgttaagctcacaaatgaaataatacacggttattcacttagtggggtttccacttttgaaaaagtgtgattgcatattatgcctacttttaaaaagttcaatacaattaagttcttaaatatttgtcttcattttgggggtttatcctcgtcatgtaattcttggagagtcacagcaaactctctaggccacggttttttctgtgtataaagtaggtgatagtttctacacaatgtgcttgtaaatattgagataaaatccataaagcactcgccgcagtagctgacttagtaaatggataacttcaggctattattattgtaattgtgttattaatattttaatagtttcttgctttttaacagtaagagttcataacaaaagaccaggagacaagggcggaaggaggggctgaacttgaacagagacggcaaatgctttccactcagcctttggtctcctcccttaaacagggaactcaggtctctaagcatgggtttctgaaatgctaccatgaagataatgttctttgatgcttaaataagacaatgttttgaagagtttgtgtgaacaagcgttctacaaatacattgccttagagacatggttttcgtgatggccttcggaaaaagggtagaatgtttatgcgtagaattctctgtttgagtagacgatatcacaaaaccaaagtaaagttgaaaaactatggttcggctgaaacaatagagcctgaacaactaggtcaggaaagagaggtctttcaattccaggccttagtgttaatggttatgattttttaaaatttctttttatttatttatttatttatttttgaaatggagtctcaccctgtcgcccaggctggagtgcaatggtgccatctcagctcactacaacctctgcctcccactttccggagattctcctgcctcagcctcccgagtagctgggactacaggcatgtgacaccacacctggctaatattttgtacctttagtagagatggggtttcaccatgttggccaggccggtcttgaactcttgacctcatactgtgccagccttggccttttgaagtgctaggactacaggtatgagccaccatgcccggccaatggttatgattttataagaaataagaactgtcaaggtcttttgagaaagcataatttagcgagaataaaatgttaatatgaagcatagattcaattttagaaagaagcagaagacactggtgagagaatgaatgactctagaataaaataacgaatgtccaggagtagggactacgaatgtacttcataatttagggaataggctcccatccatgctacttataatatctcagttaataggacggcaaaggagaaaatgtctaaggtaccacggtataaaatatgccagattgccagcttattggctaaatgatttccgcccatatttaatcaatattgcaaagatacttaaactgaatgcagaggggcttggacagtaactgatggagaagagggaaagaaatagcatcttgctcagtcatcattcactctcccaaatttataaacatccaagtcttgcgtcttgaaaacaattctgataaatatataatacatatatatcaggtattatatataattacctacatatattttttatagatatatgtttccatttctgttatttatttattgggagaaacaggagaatcagttcctgggagaaaattgtattcttttgtttcaggtttattttcttgccaatttcttttctgtaaacattggtttgcagtttttggcatgcactactcatattcattattttttcaattagcctgcaaggtctttgagggcaaagaccatgtgctgtgtttcatgctatctgccaccacagcgtatgccatgcctggcaggctgcaggcattcacacacacagacacacacacacacacacacacgcgcgcgcgcgcacacacactgatttataggtcttagattaaatcccaagaaataatgtattttctattttaatcaattctgtacagacactaagctctattatgctgcatacaacacactggatgtatcagattttcagtatgacttgaatgccgatgaattaaaaggctggtctttatgatcaagagataattcaaattctccattctgttttcaggagtggagggtacatcttccactgtagagtgtcaattggtgaaataatctccaaggccgttttagttgaggtaatccagatattgaaatcagacatgagcaagctattctaacaaggaaagaaagccatgattttcatagagaaacggactaattttgtctatttgcatctttctgctacttaaaatgtttatgtattccttttcactttctaacttgattctctctactgctttgctcttccccacttcagctattttcctattctgatctaattcttctgcttttttaattctctctctatactgttcttgttccctttgttccttcccttacacctgaatggaaatgatggtacggcttctccattccgaccctgaacttgtaaacatggaactgcaggctcattattctctagggaggttgtcattcaacctgtatcacctgatgctttcaaagtcctcattcaggatctttgctaaaaggaaaaaaaaaaaaacagatggaaagttgttgaaatacatgtgttgcggacttggatggagaattaaagagaactgaaataaatgaagcatgagtgagttcagcaaatatcaccagcttgacctctgtgtagagtcagacggttcacaactgatttatttttacgtgcattactcacatttcccctccattccctgcctacaattgtccttgtcaatacgtgctggggtgagcttcaaagggaaaataagggaagtgggcaagagatgagtccaacaaaggccaagaagaaagaacctaatttaatattacgtgtgaactaactaccttaatctacatatccaatttgcttgagaatatacgcttatagataaggaaagtaacttatgatgacagcatttcccttgctcgcttaagaatgtgccacaattggccgggcgcagtggctcacacgtgtaatcccagcactttgggaggccgaggtgtgcggatcacgaggtcaggagatcgagaccatcctggccaacacggtgaaaccccgtcactgcttaaaaaaaaaaaaaaaaaaaaaaattacaaaaaattagccgggagtggtggcgggcgcctgtagtcccagctcctcggcaggctgaggcaggagaatggcgtgaacccgggaggcagagcttgcagtgagccgagatcgacccactgcactccagcctgggtgacagagcgagactccgtctcaaataataataataataataataaataataaaaaacaatgtgccataatcatatttctcaatgtactttgttttccaggtataggtagtatgagtattgcctggacaatactcataggcagcatgagtattgcctggacagagggctataatctccctgatcctacaagaatccaacctgggcaccagctcagtgtggtcactgagcacggctcttcttccttcatgggttcacatggacacacactcagcaacccacacaatgcttttctctttaagaatctttttagttaagtacatcttccggattcaaaatacttaataaagcaacatactgcaaatgccattttttttcagattttcagaaggtttgaacaataaccaagagaacaggtgtatttcagatggaatattcgctaaggaagatgtctttctctacatagaacacagtctgaggctctactgtcctaaatcccgaaagctgatagtgttagtcattaagcttgctcttactacagggtctgtgtattatctaatgtgtaaatagcatttaagcagcctcaacaaccaaaatgctgaagatgggtggggatttgtaattacaatacaaaattaacagagaaaacactgatccagtataggacaagatttggctgctggttatattcgatcacacatcatcttttcttgcaagaaagattcatgtaattcagatgtaatgatttatctcaaagttttcaaggcattgaaaccgactactcttctttactaagacctaatgcagggcagggacagtggctcatacctgtactatcagcactttggaaggccgaggcaggtggatcacttgagttcaggagttcgagaccagcctggacaacatggtgcaagcacatctctactaaaaatacaaaaattagccaggcttggtggcatatgcctgtaatgttactactcgagaggctgagggaggagaattgcttgaacctgggaggcagtggttgcagtgagcctagatcgtgacactgcactccagcctgggtgacagagtgagactctgtctcgataaataaagataaaaagagtggctgtagctgcaaaagatgaggctgggtggagaaagggcttcccaggcccatgctctcgctacttgcttcctaatggaacatcacagaatgctcagaagctgaaaaacattgctccaatctctcacttatacctcctcttccatgcagcagcctggagatgggtggtcatggtcactagtgttgtttaagatcctggtctataagtttgtgttttttttcccctttcccttgtacaagttatttaacttggtgaaatctctgtaaaatgaaaataaaatccacatcagaaaataggtgacggcataattgaaatttcattccatcgtaacttgacataaaattaaataaagatttaagaaaatgctaccacatttaaaaagtgtaaaggttccttgctttgatgtcagtagtggacatggttcacacaccaaaggatgattttgacaataaaataaccatgtgtagatgccacagaggaatcatacatattaccattttaaatcactgaagaagaaatctaacctcctaccaagagaaagacggggagatttttaaatgaagtatccatctataagtgcatttctagaaagctgtcaaattagaaagcaaagctctggataatttgcaaaaacaaacaaaccaaaaaaatccctcattttatttaaacaacctctcccagcattttctgtcactcagggaagagttgtcagtcaacatttgattcagtaatttggcaataattctttctcacctttcccttcagcatactgagctaccaaactactaagtagtctatgttaggtgctgctctaaaattaaaaaccttcctttgtgagaaatcttaaaatgctcaatcatgctctaaaataatcattttatgtgacatttggcagttgaataggaacctcttgaacaagggactttcttttacaaactaaatgcatgcccagaagcacctcccaatttaatcaactaaacagaccagaacgctgtatgtccgaagcctttgaaacagtctttctaagagtagaggcacggtgatcaacacagagaatcctataccagcataagatcgcagcagctcattttgcaactccgaccaaacagtaaatctgaaacgagattgattaggagggaacaatatggattttattaccccaggacatggccatgagaaactcttgtctcttctgtaaaccagaagaaattatgagaatgttcacattcttggttttaaggactccaggaggacgattaaggaccctgaagccagatcttagtgatttgcaacggaaatgttgttaaagacccaacagaatgaatagcaaaggatctagggaaactcaagaggaatcttcatagatttgctagaaacatgaacatcaagtagcacgtggaacctctaataaaatgtatatttatatgtccatgaatgaggtgcacctctgcttaacaggtggcatggcatcttgttttttgtttttttgtttttgtttttgatggagtttcactcttgttacccaggctggagtccaggggcaccatctgtctcactgcaacctccgcctcccgggttcacgccattctcctgcctcagcctcctgagtagctgggattacaggtgactgccaccatgctccgctaattttgtatttttagtggagatgaggtttcaccatgttggccgggctggtctcgaagtcctgacctcaggtgatccccccgcctcagactcccaaagtactgggattttaggcatgagtcaccgcgcccggcctacatggaatcttaatacaaatgggggagccgatgtctgatgacatagaaccatgtgatccaacatggtgctgaaatcacacggtgttaaatattctatttacgctgcctcctggcatgatggagggaagcaacaccaaatgtcctcttcgtgttcagaggcgctgcttctgcctacagaccatgcgcacttctgcctgagtttttaatctctgcactgtgatttctattctcctcacctcctcatgggttctcctgagtttccagtggctgcagctgccggttcacatgtgttctctttctgtaatgttctgaaaatataaatgacgactgtccctattaagtttttataaaatgtttttcaatatattttttggccctctctataagctttgggattcgactaatgcaattgcaagttgacaactttaaaaaatctatgtgataaatcagaactcccgaatctatgattaaattttaaatatgaagcagtcaaagtcaatgaaaaattaaaaaattaataccataattttgtagaatatgttcagttttgacggtcacttctacttctatttcctcaagggagtctcaagacaatcctgatccgtgtggaacatgggggtactcagagggagaaaggatgcaaggatacgagcctcttccagtgagtttctcgtagaccaccaaggccgatgcattttcttaaattcagtaaaaggaattaccagtgtagagaacagaattaaatattaacttactttctctgtctgttgcatgaattatttgaaatatttagcttgcctgtgtatctactaggtttctgtttctttgttgatttttttgttgacttttttgttcttgtttgtctatttttttgagacagggtgtcattctgttgcccaggctggagtgcagtgggtgatcctggctcactgcagccttgacctcccaggctcaagtaatcctcctgcatcaacctcctaagtaatttgtaaatttttcatagagacaggggctctgtatgttgcccaggctgatcctgacttcctgggctcaagagatcctcctgcctgggacggcgaaagtgctgggatgacaggttgaacccctgtgcctggcccttctaagaccatagatgtgatttcctatcactttgttgaagaaagcagggagaaaaaaaaaagaacttcaattaaatagtattgaccttgtgttcatttttataagtactagatacataaggtaccaacacaatgttagaaatccagttttccaagattgtcactttttctcaaaatatcatttaatttttgctaaagctcttttttctttatacaaacacaagtatattagaaagtcaagtgattaacatttaatgtaactttaggtctttgtaaacagtgattccttggcttctttcattcctttctcattggaatgaatttttgcctctgtcattctttaggaatatggttctctgaataagcacgtgtgaccacatattgctcacagggcctcttatgctattcatctttataaaacggcctttatttttaatgtactactaagccatttgcttaagttagtttacatgtgatagtaagaatagtaacagattatgaccagtgttagcatggatattgcaaatagcttcttttcaacactacttgtgggagtaaacacacagcaccagctaaaagcattaaaaatgtatatattcaatgatctagcacattttaggaatctattttatgggaataattttggatattcacacatatctttgacatttacctcagaatcttataaaagagcaaacggaaaaaataaaaaccatcaaaatgtaaaaatggaaaacaacctaaatgggcaaagtaggaaatgaaggaaataaaatgaaataaaaattactcacaatacttatgtggaaaaacatttactgcttaaattttacatttatttttctcttctaacagtgtttaccaataagatcacagataagtgtgctttgataacaaatgtttgttttacagaatacctaatttttgcaagcctgctttcttgacagttggaaagttatgaaaataaaattctaacgaatccatgttttgtctgaaaacgtggaaaaactgttaccttaaatggtggtgctgcatgcagctgtgccctacatagagctgttccctggcaggtgggagtgagagctatggcttggtcatgagcctctttagggttctcccacctgccgagggatttgaatatcagttgaatgtctgcactctgcttggtgctagatagaagattttcaaaagaatatttaactttcatgtattcacctactgttgtcacctgtcacaccctactagtgaagtttatgcaaattataaaaattttttgaaaatatgttgcaatatttctgaagttgtttattttaaaaaatagcatacatcccaacaaatcattctggtataagaacaaacgtacttctacaaacaacaaaattctttcttgtcattctagaattttaaaaaagaaggaaaaaagggaaagagaaacaatttcatcattgtgatgcttcctgattgtcatctgtttactccctcaagtacctcacagtatccttggtactggcaacagaggtgtgaatgcaagacctttatcactttgcaagaacagtggctatttcattgatacactaatgcaaaccaaccagtgtttcattatttgagacacagtatctatttctcagaaaccagccctggccttttatgtgtttaatatgtagttgctgttttttaattttaagtgtttatgggtaactatggtagatgaatatattgatgggttacatgaaatgttttgatacaggaatgccatgtgaaacatgcacatcatgaaaaatgggatatccattccctcaagcatttatccattgagttgcaaacaatgcaattacactctttaagttactttaaaatgtagagtgaagttatcattgactatagtctcctcgttgtgctctgaaatggtaggtcttatttattatttctaattactttttgtacccacataataggtagttttgtgtgtgtgtgtctacatgtacagaggcactcgcacacacccccacagtttattagctgaaagatcaaagccaggaaacctttcataagagttatttttaaataatataattatcttaaataattatttttctttgatttttaaattataaatctagtattcttttttgattttttattccttttgccccttaagcactgtttgagtagttgaaagaaatggaatcaaatatacagcttttaaaagaaggaggaaattaaacatgtatttttattttcacttcgaccaggatattcataagggtatgtgcaaataatagtatatggctacttattaaaatgtattaaaacagaaaaaaagtatttatttttaaaaataaaatctttcatagtagttgtttagttgtctcaaaatatttaaatgtttgctttcagaactagtggcaatcctttttctaataacaacccttgtttttactaaacattcagtaattattagatgaaagaactgtttaaactgctttaaaaacagcgtgcagctctttttttttttacataacagaatgaaaattttatataagatgaagaacagaacaggcaaaactaaattttggtatacttacggaattctttacagttattggtaattcaatcattaattcacaattttttataaagcatctccaatgatgcaattaatgttttaccagagtaagatataaaatcaggtgttatcataatttaagaatttaaaaataacatatatttttatctactacaataaaattatcttgattacttcgaacaaatcaaaactaacacctgttaagaatccaggattttccctatgtggaatgcttgagttctttgcagtgaaaatggaatataaattttaaagtattttaaatcttatttgctaatatacatctgtacactgaagtttatttcttaacgttaaaaactagttttaataacttgaaaaccactatgcatgtttccatggaatgcaaacgagaggcatgcctcatcttacagtatgattttcattcagcatcctgttacgatgttattgttacataattgattacttggtttatgccattacttgcttcgttatttatcagtatgagagcttggggttgttgctattttattttataccttttttacacaaaatgcccttagaacagtttggatgtttgtggacatgaactgcaatataataatgttatgtttctttttatgatatgagctacagtgagcattatttttaatactagatgataaccatttacaacccttagaaaaattcaattagaaaatgcactaatacatcacagtggagtgacactgtctccatcaagtagcacagaaacttcatccacaggttgctgctgccatggcttctcccactgtcgggatgacgggcagcgctttatcagagagaagctgggcacctcgtgtggattagaaaaagggttcccatgactaaagtgcctgtaggtgcccagcagtgcttaatggtcccgattcaggaaatgtacaggagatgatggatttaaaagccatggttgacaacgacttcattacatgcaaactttaaaataaaacagaaaatgtcatgtccaagtcttcaaaagatttctctgataacttaaaaaacccatataggtttatttttattcaaatacattcttcatataaaatttttagttattgttgtccttcatttttccacaaatattatgttttcattagttgcaaatgagtgaatgtattagtttcataaaagttatttgcagtatgttttatctatcagtttttaacattaaaatcagtttttaatctatcagtttttaacatttaaaatattatgatcctgaaaagatcaatatattcaatatatactgattgaaatctgtatttgatatgttaaatttttttgggggggtcacgaacttgtaagaatctaatagagaaaatacattacctatatagtagaaattctacaccaagaatgcataacctaaggtttcaaatacgagataacttatgcttattttaaaatgacatatgtactggtttcaaaaatactttaaataccattttaaaaattatttaaaaatgtaacttcttaattatttttagctgtcaggttatacttatcatttttttctcatagagtcaatgcgtttttaattactaaaactgaaaggtaactatcatgacgttgatgaagattcctgaactttcttcaagttgctgcttcttctactagcatgagcttcatcaaggaaagcagtttccttttgtttattaattcagctgtctcccgggtctagaagtgtgactaacacataacgcttaataaatatttgttgaatagtcaaatataatatcacaagagcctgtgaaacagagtgtcttctcagcaattaagacaaagtaaaaccaggcaagatttgcataagcattaattatttcatcaatgcaaccctatgaccaccctgatcaatgtgactgacagctttcttgcgcattccctattctaagatattttacttatgaacccttttaatctccacaagaaccctatgaagtgggccccattactctcaacattttgtagagaatgaaattcttcaggctgaatgctgctcaaggtcgcatgcctgtagaatagcatctgtgacctcaaccactgcactgacctcaaccactgcactgaccagcactagcactgagatgtgtaccttgaatttgtttgcaaatgacttgttagccatttacatagtgtctagtacagatttgtcacagggcatagtacacatgtcacagaacacataggtattagtgtgcagtgggtgggggcgtgaaggtgcctgcagggaatgggtgagacgggattacaaccatcttttcttgaatttctttttccatttagatttttgcttctttcctttcatcttaatttctgcattataaaatcctcagatgaaactttcatgatgaacattttctcaatctcttgggctgaagcaatctttccatttccctgggatcacaatcagtgaacacgtgctctatttctgacactccttgctacattccacctatgataatttcccacactatgatccaaggagattgtgggttccctgaagacagatcccatttcattcctttcccaatgtcctgccatactcagcaaagcaatgtcaagtagaaggcactcaatacattttgctgaaaagagaaatttctaaaggttttgtttttgttgttgttcctgttttttccatgttctctgagttgttttggatggcattggtgcgacttaaagaaaaaaaaaattaaggaaaactcacaggtaatttgctttgacagttttggattctgctgttcagagcagcaaacatttttaatactttgtgactctggcacaaagccccatgttaaattttattttcaaagtgagtgctaagaagagcattgccactcttgagagaaatctggaaccttctcctttctgctcataagaatgtggtaaatcaccaactttctctttctgtcatagatgcctggaaatgaaatattaattttggtcttcacaattttgtgaatctgcatgtatgcttagttaatttgctcctccaggctttcattacctatttccttatatgattctgtaggttttcagcaagtcacaagaaataactaaggaaaataggctgagaataaatttaataaactcaagaatggtaactgacctccaatttcatgtcagccacatcgtgccatggagaggtcatgtgcacggctgccttttacgtgtccatctactagctcttaccatgagagcatctcatagctcttactcagatggacacttgcttgtccatctcatagcttcctcaaaaagcacgttgtactggagcaactgtgaaactcggtgtctgtgagaaagtctcatggggataacaaaacgaaaagcaagccctgccctcaagagaaacttcctctcgagtgaggaaacagcctgtctgcaggactcctgttattaccaatgaggtcactgctgtgtgctaggattcccagcgcctggcagcctccagcagaggtgacctgacatgggagcctcagtcacccctgtaaccacacaaaccccacaaaaacaactgttcccacatggctctcttttttcctttttggtaagcacatataatttttacatcttatttatcaaatattcataattcatagatttcttccactcatattttttttctattcatactcttggaacctacctaccaatacaggcattattgtaagaaatccatgaatatggggactttacttcaatacattctaccacgcagcctgaaacacacttatgtgagtttggcaaagggtttcaaaaatatagatcctcatagggtctaatgaatagattgaggcatgttgggggtaaataattggaaggaaacgtctcgtcgctgctgtctctccacctcctcgtggtgatgatgaaattactcctgcccaacccggctctacttatcactaattgagcactctgatattgatgtaaaaagacatatccccagcatacgacatcagtgcatgacggtgctcatgcttttaagggaaagcagctttcctttccggagacatcggtgatttactgaggtctcgtctcctcttgatcccttcccagcgctcccattaggtttaatgaaaggaacacaatatgggaacagtgagaagacaaggaattagcgtcctaatgtgcatttcattgccagccacaggttccactgtttttacactgcctcctagaagcttgcattttacaacaattggaaaatcagaaaaagaacaaagatgctgcacaacacctggaccacaagaagtttcctcctttccttcagatgtgcacagcgacctttgaacagtagccagtgcatttagagagctctacttcacagtgaaacatggggcctcaggccctgatcacattttacaacacctgtgagatcttagcacactaacagacagggacagccaaatctcaataatgtataggaagttttaggccaggaaatttagggcatctttttgttttgggagcggattgcaatgtgctctaatttgttctggatgtagtaacagaggtgtgaatcaggtatcacgctgttgtgatggctgttctaaggcatgagagaatgactaaggacagctggaggagacatcagcgcagctacagaggctacatggaaaagctgcaggagaaggcgttgataaatgtgcatgcaactcacaggatacagtgtgtctttggcttagaatgttgtgtcactccaaaattcatatacagaagctgtaactctccaagtcatgatattaagagctcaggcctttggaaaacacctacaggaagatgggatcatgaggatgcggccaacatgatgagattataaaaagaggaagagattccagagctctctccccgccttgtgaagacgctgaaagcaggtgccatctatgagccaggacgcaatgcgtacccagaactgaataagctggaaccttgatcctaaacttctagcctcagaactgtgagaaataagtgtgtgttatttaagccaccgtctgtggtatcttgttatgacaatacaaacccatgaagaaaatgtagagaagtgtctaaattttcagagctatttatactgtagacagtcacaaataaactttgtaaactgaaaggcatactccataaagaccctttgtcctcaataatatgaactatagcttcagccaacactgccaaagttaaatattaagaactgggttgaacaactcacagatacttcaaactgtgtattcacatggcaatggttcaattattttaaatgacagactcacacaagtaacatcttctattcctaattgattacttttgtctgttttttctagaaaataggttttatcattgtatagtgctgtacggtttatagagcattttataatatatgacacaatgttatcacttttcacaatcaaaattagctatgcctcatcttatcaaccattggcatagatgggaacttaactattaggggaaaagctgaactagcattgtatccgaccacagcccaatgctattcttgtcacactgtaatatgcgtccggaagcagttctgagataatcctgaatttcagctttaacgcggtattttaagtgttgacctattcctggcggcataaaatattcttcccacttctatggtcagggaaatcttcacatcttacacgtttgtgaagatttttttttgccaaacttcctcacaattcactctgctcgtctctgcttctatgttgtttatgccatttagatttgtcgtctctctttggttttccactcaaattcgtagtgaaaatagtttccccccttgttaatttgttttttatgccccaatgatgccttactttttgcttatggcttttctgtatcaaatgaaaatatacaagggtttctgcctattgagaatctggagaatttaaaagaacgatgtgacaagaagtaagaagcccccacccttctgaattcctgaattttcatttctgctgcaggcgacattctcacttagactggggatacataccccttggccaaccactaatgtccccactcccagcagttggctactttgaaaatcctttcaagttgggaatgaaggtggagactgtttttattttcaggctaaaattcacaattgttctaaaacatcccgccgttcccagtggttttcccataaagagtaggggccctgctcacctttccccacctttgtacccacacccagaggttcttcaaggttcaactatcctgtagtaaccatgaattttcccacagtcaaaaacgcccgtacttgtagttccttccaaggacttgctatttgcataatgcatgctgaaatgtcaggagtcctccagatggaaaacagtgatagttacgctgcatgtacaagagactccaagaatgggtatctccatagttttcttcagtaaagaacatgcaattattctaagtgaagtaactcaggcgttgaaaaccaaacatcgtatgtactcactgatatgtgggagctaagctatgaggacacaaaggcaaaagaatgataacagcggattttggggacttcaggggaagagtggaaggggggtgaaggataaaagacaacaaatatggtgcagtgtatactgcttaggtgatgggtgcaccaggatctcacaaatcaccgctaaagaacttactcatgtatccaaataccacctgtactccaataacttatagaaaaaagtaaaaaaaaaaaaaaaaaaaaaaaaagaacatacaattgtgtttacctaagtctttccacaccgtgttccatcacatcactcataatttttcctttaaattgtatcaattagagcagtattgttccctttgagttgtcttttaattatgtctcttgtcatagtttccttctttgacgttaattgtgccccaaagaaaggctcttttgtatttgatttcttcagtcctacatttaataaacgtgcttggagaccctgccgtccgacaggctgtgcgcttcacaaagtcaagagaagaggcagttagcagagcctcacttttcagtgagtcagcaggagggcgtgcacttgctgcagggagtaatgcagctttatctgtgaagtttcctgtcatacagaactagttacaattgcctgtaatcccggcactttgggaggccgaggcaggtggatcacaagttcaggagattgagaccatcctggctaacacggtgaaaccccgtctctactaaaaatacaaaaaattagcctggcgcggtgacggtcgcctgtaatcccagctacgcaggagaatggggtgaacctgggaggtggaggttgcagtgagtcgagattgcacaactgcactccagcctgggtgacacagcgaggctctatctcaaaaataataataataataataataataataatattaataaaaaaaataataataataaactagttagaattaactacaatctgagctaaaacttaagaatgctgggatttaaatcctggtctacattcctgagttgtgtgatacagcataaattacacaatccttctctgcctcaatattctcacctgcaaaatgaggataatccttgtacaaacctccatggttgttaggaaaattaaatgagctaatatatggaaagcacaataagacatggaattaatagaaagatcttaactcacatgattactattagtatatactccataaggaccagaaaaataacgcatcataaattatgtgcataccatttagaattatgtgcactaggattatgtgcactagaattatgcgcctagtcatttagaatttcactactattatgaagtactgctgagagagaaaaaaaaaaagccattaaattatgtggggcaaagatagggcagatctgagaccagggtggcggaccggaagcctcataagatcaggaggcagagggaagcacccggcatctgtaggaggcttaacgtggaaggagctgcccacagataatggacagggccagaacgagggcaagaatccgctggaggattctgaggggagcacgatggtcactttcatcattgcagctctacgcataccaaggacaaagctaaaccattagcgtttcctacccttgcctttacaataactttgaaaaatagatattgttatatgcactttgcagatgaaaaacaaaacaaacaaacaaacaaacgacaaatagggcccctagagctagttagtagcccaagacagcacagcgggataaatcatggggccgggatcccaatccaagttggctgactcttttccccaggagcctctaatgatgtaaaacgcctcagacatcgttatgcatcctcccacatctttctttctttttttttttttgagacggactctcgctctgtcacccaggctggagtgcagtggcgcgatctcagctcactgcaagctccacctcccgggttcacgccattctcctgcctcagcctcccgagtagctgggactacaggcgcccaccaccacgcccggctaattttttgtatttttagtagagatggggtttcaccgtgttggccaggatggtctccatctcctgacctcgtgatccctctttcttgccctcccaaattgctgggattacaggcgtgagccaccgcgcccggccgcagcctcccacatctaaaattacctataagtcaccagggtagatatcaagtcatgaggaaaatatacttacaggacttgggacaggaaactgcccttggatgccatttcagtgccgtggagaaggacagccccaattttgtttttgatgtttctattttattttttcataaaccccatttatcaaactgtatttttcaaaccatagcccacgtgtatcatgatagagatcatgtggagtgtattttcaggacaagttctaatcccatggattgggggccattgctaagtatggttagatgttcccctagtctggtagcatctgatggggctgtcaactgcacctctagagcacgtcgcagttctgatggggctgtcaaatgcagctccagagcacctggcagatctggccggctgtcaattgcaactctagagcacacagcagatctaatgggactgtcaattgcagttctagagcacaccgcacatctgacagggctgtcaattgcaactctagagcacattgcagatctgatggggctgtcaattgcagctctagagcacagggcagatctgatggggctgtcaattgcagctctagagcacacggcagatctgatggggctgtcaattgcagctctagagcacaccacagatctaacagggctgtcaatagcaactctagagcacacagcagatctgatggggctgtcaattgcagctctagagcacatcgcagaaaattcaggtcaggaacctctcagactgcgcttgcacccagccacctgcacagtgaagccatcctgcaaagcgagtggcaagcttaacttcaaatgtcacattgatgtccccaataaaatgtcacacatgcacagagtttactgagccaaatttcgatccactgccaaaagaaaatgctgacgacagatcatgagtctctgttttcctatttagacttttcaattctaaactggtgagtacttttggttctaagataacaaacctaaacagagaggcacattgatatatgtttctataaggtaaagcagcattaaataatgactagctcattttgaatccagcagtaataagtacactattttgatttttcgtctaggtatattaaaaaatatatatatagccaagtacaatatttggattcttcaagtaagaaaaaatacagctaggggtttcatttgaacaaaatgccaaggcttgttacttgtgttttatgaaaacagaatgatttatgggttcaggattcagtgtatatatcatatatatatatatatatatatatatatatatatatatatatatatatttgtatgtatttgtgcgtgtgtgtgtgtgtgtgggtgtaaagggagatcacacacacaaaaaactagagggaatggaagagaaaaaggagcaagaagaaagccagaaatgaagagaaagtttgaatctatgtccataaaacgaatactttatttcaagcttcattgtagttcattataagcctttaaaattaacactttagaatttggtgaagacttgggaaagatggattattccgatactgggaaaatcacggatctcataaggtggctctgaccacattttgattactgtgctcatgttcttagctttcaaaaacactgtggcttttatgttacttaggggggacttgtcatgaagaattacaccatagatcatgtacttcaggagagggtgtgatggatgccagctgagccttccttgtcccttctcacagtttgtggtaaactagaaggtatctgagaagcattgacgggttataaattgaagtcccatttcatgctttacaaatttcccacaccatgcacaaagcacatttgcagataataaattatttttaaagcaggcatatatgttttcgtttattagggttacagattgcattgttttgttttcctttcttccatagaaagtaaatgaatatacatctaccctcttgtctagtcttatgtgcacacacacacaaacacacctgggcgtgcacactcacacattttagaacataattgctgctcagaagtctccatcccaaatgtttcaagagccagatacaacgaacacatcattttactccatggattgctctactatggaataataacagtttcactttatttgaaggggcgccaccttctagtacaggaagatccttgcacggcagaaccgttgcactcacagaagcttgctaggttgatgctagaattctcattacaacctccaagaatcaagtaacaacttgattcaagaagttagattaaaaaggctgcctttaaaatgttaaagtgatttttttttttttttttgagatggagtctcaccctgtcgcccagattggacagggtgagacagcattcttcaatgctgagactgtaccctaggtctgtctgagcatcagataatttttcttcccaattcatcgtgcactcttactttgaacatttcaaaccattttgcataactcaatttttttttctaattctagcctaaaagtttccctggctgtcctctgactcccatttaagccaggccccacccactcccctgcttctctttgctatctcaaagccctgtcttttcctcttcattatatgaagaccccatccaaaaatcaaggatctcgttcgtatctgggagctacaagttcagatgaacaggatttctcaagtgacttgaaggcatcaccttaaagtctctccaaagagcccttttattttaagctgcccctcggtcctgagatggtgcaaagacaccagatggaggaagagctttataacttccctcgcctggctgagggcatcaacattctctctacaatccttccctatgtttctaaaagctcagtgaaaacccttctagggtgttcattgaaatgtagatccctgagcactgagacacccccagccaaccttcctaaccacaggccctggacatttcactgttgaatacgtttccacttcaaggtgaaatctgaaatatcagggtatagccatgtgcaaagccgagcaactgacttccctggctaccaaaagcaagatccttctcctttctttttctactcccatgatcagcagacccgtataaattataagtatcttaatctttcaactttctaattatttattttttcccaagccatgcaacatacctaaatcatgattttcctaaagtactgctttccttataccatgagatatgagggacagagtgaacattttacaagcattttaccatggaaaatttatcatgtttcagttttgctcaaaggcctgcttttacaatgtttaagtgatttttctttttttttagatggagtctcaccctgttgcccaggctggaatgcagtgatgcgatctcggctcactgcaatctctgctcccaggttcaagcaattctcctgcttcagcctcccaagtagctgggattgcaggtgcacgccaccatgcccagctaatttttgtatttttagtatacagggcgtttcaccatgcagttcaggctgttcttgaactactgacatcaaataatccacctgcctcagcctcccaaagtgctgggattacagacgtgaatcaccgcatccatccaaaatgttaaagtgatttctatcattttgtgaaaacgatgggttcctttctcccaacttactggaatgtatttacacacacagcgtctatccgagttctatgggagaaagcaatccagtatatacacttcttactttacacacaccgtgcccacaacagcagcacgcactcttcctgtgaacatgcttcccatgctcaaaggctacacacagcccagtgtttctgtaacatgttctgtgatgacctcactgagcagtgctttctttctcctccaagtaccgacagcatctttgcaactgcattgcttatttgttgtttatcacatatgccatgataacgactaatggatacaggggttgtctgtctccgttcctggtacagtggtaggtttctgacttttactttcatattcacccagctagatgagtatctttaatctcctttttaaagtcaggaaaccaaaaatctgggagtctgactctagcccaaatggtgcagctacgaaggggaggaacaccatttttaattcctcgttcttctcactctaaggccaattctgagaactgtgaaggatgagtagggctttgctgataaagcagaagagacagttcccagacagagaaaatggattgaaaacaggaaactgcaaggtggaacgaggtcactagcagcataaagtgcaaaatggaatgtaaatattgacaggactcaggccaaagcaggctctgcgccacgtcaagaagcatagccttatccaaacccatagttccagatgttaattgacagcctgccaaaaagaaatggttcagggtccaatctgtttggcacattgcaacatcttctacctgatctctgagagtcacaccgaatggtctcacatcaaaggactgagaaatccacaacaaaggaaactgctcaactttttaactcaattttcttgaaaagagctcaaaatgattttactttcaacacacagctattaatagatttggaaacactactgtgcctaaaaacatagggaagctgttgaaatattgtgatttttttatacccttttgatgtcacctcttattcatagtcatctgctgggcagttgggctggttcagaaaactaaatcagagtctctaagcagtaagaccctggtgagtctgtgaatcctaaatctgaaactcaatattgaacctcggctttctggatcatctccatcttgtcccagaaggccattataaacatcacacaggatttcaacagagacaaaagagcttgcatcaaattctgaaatagcataactactgcaatgtttttcagtttggaggaaaacctgaaattattatgaatgataattagttatggttttaggtctgtgtttgtcaaatatgtacgccactcacaaacaccctaacctctcacagctcaggctctggagcacggaacagcagcaccaaccagagctgaacgattgtcagaaacagagaatctctggactcactccagaactgctagatcacggtctgcattttgaaaagatctccagtgagtcctgtgcacatgacagctggagaggaacgtttaatagataaatatgtacttcggtcaaaattccactgttatcacatttcatttttactaagtgatatacaggatctaaaccaggatagcattttgattttcattcacaaagttgacggacatatacaaaaacagccctgaatgtgaaacaatgctgattatggtcaattatatttccaaacaacaaggaagggtcatcatttaggtcctattttttcctttaaagtgatattattactgttgttattgtcacacaattcataaccaaagtaagatcaatgttttaaaagttgagtggagaagttaacagcttttataactcaaaaaatttgaaggttatttgctgaacatagacttttagaactagatacaggtaaaaaccattgttcaaaacacattctatttcaaaaagtttttctttttcattgtagggcagaaatctgaactctctatggcactgtttcttacagcagtaaacgtgcagctagttatagaaattgctatgtggggcgggcattttgctaagggttttccaagcgtctgctcatttgctctagttagcagctctctcagggatgtggcaatcacttctattttacagacagtgatctgggacttccagagcaaacctgctctacgtcatcaagctcagaagtcataaaaccaagactacagcctaagtctcactcaaaccgaggtctgaatcagtcatcttggcttagcaactatgcttttatggcctgctgatagaaaggtaatgaaaaaacgacagaggacattgcccaacactctccaagctaggtaagagcggcttcttagcatgctggaacgagttgtggtaacacagacaaaaaacctggattctcttctagccaactaataatactccacagggtaggataaagcacatgatctatttatgatgcagttcctttttccccaaacaagaaagggattgcattaagagatttctcaggtgccatctattttaaatttataattcaaaaaaaattaaagtctttatgatgtatatgtttattaagaaacgatactgtgatactctaaagagattcgaatcagaagaacttagatacttgtatttactaaagtcataggtgggaaacgctaatgttctaggccactactcatttaaaggatgtattaagcttggatagcacgtgccaacaggaagtaacccaagcaacaaaatgtcacattttttggaggagtataggattgcacaaaattaccttattctcctaaccagtcctccatgaaattgtgcaaactttcataagaaagagaaaaattagatattcatggcttcaagagaaactctaaatgaagatatcaaaatgtacaattggaacacgaggatgtgccagttggctgatttgaggaataaatgagagttaagcagcattatttgagaatgactaaaatggagtgggcgcaatggcccctcagaaggcagagtgtttttaaatgagaaatttatttaacagcgttaatttagttttacttttttattgtttccaggattaagggccacatacaaaaagaaagaagtgtgattacaaacaacaggtatttcatagttgatgaaatacattttaatccataaaagacttcttttttcattgcctacagcttaaataatttataggaaaagtatttttcaataaaatgaggttaatttggagaaatctgacatgagagaaatattacaccagaactgtagagttcaactctgccctaagaatggtaaggatggagacggggacttctctcccgggataactatttttcctattggtcccatctttagagaccagggatgttttcttcttctctgttactcctcagtctggacaattttatggaatcttagggtaaaatactacattttatccatagctaccaccattcaataaattagaaaagtgtcccaaatttcaaatacgtattctttgaaatagttttttaactttattgaaactctggtatttacttaacccgaattaaaggattgctctagaatgctatttctagaatttgtgaagaaatctcaaattcaggcttaattctaggcaataagacagtcgatggcttctcagagttgcaggggcacctgctggtgagtccatccctttcatgaggaaggagaggggagggcaggaaataattcctagggtatacgctcctggtagtgaatcagagagtgcagctgccccttcacagagagccaccttctttgctcctggaggtccattctgacgtgaaagacccttccttcactgcctggtgaaagcatcatctctagatgatgcttttcagaaggacaggagagaaaatgtgtcttgcaaaaacacacctgacaaaaacctctaaaacacagcctgcctgcttcactccacttgtggggctgcagcatctttcccagaaattccttcgctgcccagcggcttcatccctggccacgagccgagagaaaaggtagagactggaaattggccccacagtagacattgtggagagggtgcctaatccacccaggtgaaaacaaaaatatccaggataaggcatgtgaaagaaagccaccaatcaagttagaaattatccgtacagtagaattagctggtattgaaagaagttcgcattatttgcctattgagtttcagggtggaggtacctaggttgtggcgtagtctgggatggccagttttctccacctacctaagacttcagtgcgtcacggttgcatatataaccctgtttagtcacatctttatgcgacagcttcatggtaacatcagcttgtcattcatgtgtcctcttagaagcctgataatatctatcattatgttatacccagaaatatgctcaacaagcaagtatgctaagatgattacattactgtctagtgaataatgctggaaagaaacacgtaagagtagctagtgatgactccaccacacagtaacagagatgactacaaattagaagtggagggcactttctttgtatgcactaaggcagaaggttgctgaagaaattctaggatgagagtggagtgccgacacactgcttccatcttcctgttttgaaattagcgatgaaatgtggtctcaacttttttaaaaggaggaggaaatataccttgggactgtctctcttcaagtctccacactgcctctttgctttttggatggttgaatatttaactactttgaagcctatttttctcatctataaaatgggaatagtagtatctccaagtagcagtagcaactattgtttatattttcttgttatataacaaacactcggtgattattaaatgtttttttacaaaaaaaatacactattgaaaaaacatagaaatggcattttaattaaagcaggggtttatgaatagagctacaatatcatgttaattatatccctacaccttcagctggtatgcagagtatcaagaaaaggagaaatgtgtatatatatgtgtgtgtgtgtgtatgtacatatattatatatatttttattgttagatatatataaatatatttacattcatatttatttcccatttatgctatactaaacacttctaaaaaacaacacttctaagctctatttttcatgaaccagcataacttgacccttttgcctacctggagtacgcaagtttacaaggggaactctggggtgacagttttgtaatcttattttgttcccgttaaaccagcacaagtttactattaaatcaatctaatcagtgattggctgaagttaaaacaaaaataagtgttgaggtgcatagcttacaacaggtttgtgaaataaaattactgaatccaaatttaagatagaaaatatgggactggctgttgtggctcatgcctgtaattccacactttgggaggctgagccagcagaattccttgagtccaggattttgagaccagcttgggcaacacagtacgtccgtgtgtctacaaaaaatgttttaaaaattagccagggttctgcacctgtagtcccagatacaaggaatgctaaggtggaaggatggcttcagtccaggagtttgaggctacagtgagctatgacagcaccactgtactccacactgggtgacagaaggagacccagtactaacattaaaaaattataaaggaaagcacaaaaaacaattcgcccattttaattggtggcactgcagcattgctgcgtggtctcctccatattcataaacgatgtcactgcttttccaaagccatttttctcacaaaagattgaattgttaacatgggataggtcaagttcatagaaacaaagaaagatggaaacggccacagttggacagggccaaggaggcaaaaccaaatgctctgtgggtccctggctggagccctggaccagaaaagacatcagtagaaaaggcagaggaaatcaaacagagtctgaaaatgagttagcagcactgatgctacatgaatttcttggtgccaataattacactatggttatgtaagatgttcacatgaaggaagctaggtttaggatatacagcaactctctgtgttagtgctgcaaattttctgtaaaatgaattcaaaataataacaacatgaggagggagaacatgatgcctccttcctttaattttggggcacgtgagagaaggattgatttcagggagtctgttactcagcatgttcctctataattctccctggttagaaattaaatagacaccaagtcaattatcaattaagtgacaagttgggtaaacactggaagcattaactgacccattcaagcgttctttgaaattcactcagctttccccatttctctgaagttttgttttaactttagccagtcaccaattagattgacttaatagtaaaattgtgctggtttaacaggaacaaaataaactaaggttacaaaactgtcaccccagagtttcccttgtaaacttccatacaccagataggcaaaagggtcaagttatgctggttcatgaaaaatagagcttacaccttaaaaaatcataaagtaacagatgtttcttttgaagtcataaggcagccctaatccaaagcggaagaaatgttcttgcatttattatggctgatgttttccagggagggagatcacacaacctgtttgtttcacttgcattatttatgtagtgttcttccaggtactctgcatgcccctctaagcattatgataatgggatcgacaaaagataggcagtgggcgatttccacgtggaaacgtgcagctgaacaaatgcaccagggatgaaaacgcccagtaacataaagacagggatgggttcacaggggcaaactgcaaggggatgggcgtgcctggcagggagggagccaggatggggccaaatcggtagctgtggacagcttgggaaggcacactgaggcttccaggctctgtctcagggagctgaagctcagtcatggaagttaagaatcgatgcatttatatttgttttgggacacattttcaatgcatttatttttattttctttttccttaccttctctatcctctacacattccctgtcacagaagggtatggaagcctgtttcttttgttatataagttcatattttaaagggagtaaatgctccctcagtgttcccagccaagactatacaaccttaatcccgttaaccatcatgtcttaatttagaaaccatagagggagaactcagaaatgaaatcaattttctttcttcttgatattattagaagtacaagttataggctacaccatcaaatctcttcagaaaaaaaaaaaaaaaaaaagaacacttggctagtctcaccactacacaaatccttcctaattgcaagaaaaataatgactagaccatgctataaagtgaactcaaaatggcaactctctgttaaagcaagggattgataggaagccaacctgcatgaaattagaatccgactagttaaaaaaaaaagtcagtttcaactaatgtacctatagcctatgaggcttaaattacgaacccaacgtatgtttaatataaagataattttggcacatgacatcatcccctatatttagactgcctccactgctgccatggcaaccctgacttaaaacatagctcagtgggtaatttcactccaaattaaatgaaaataaggctaatcctattattgttcctaacaattttccaagtagcttcttctgagagtgcccttgcttatatgcccttttttaaaaatagattattggaagatcatatgtgtatctgccctcactccactcacagtcactcgcaccaccctcctggctctgtggaatgaccctgtgcttgggaagaggtcgcagcacccacaatgctccccgtccctgtctatgcaattcgggaatggggaaaccttttaaatacaccaatttgattcatgaaatatttcagagactgtcactgtagaattactgtaaaataataggctttttaagataaatcatattatgcatttgtataggccttaaaagggtacttcaaattattctgttttatgttttaaatgtgctcctgtaggtttccatagttatttaggagaaccatcttttgcttttcagcctccactgaagagtcattgaaagctgagagttccacttaaacgtagtccttgtggctgtgttaagatacttcttttgactattatgataaacattaaatgttacacatacacacaaaacactctgttgacccacgacatatgctaaattgcttttccatctttaccccgacagttacctgttcaaggctttatgatccagcctgtagtcctgaaacagagaaactctacttctctgacagggcattgaagctcagacctggactacactgactgaggggctatacatagagagaagaaaatgccgtggagtcagagaccttgaacctgagctctgccaagggctccatcagctttgccatctcttgtcctctgcatatctcagttttatttttaaatctacaataataaagagacaatagtagacaatagtaagaataatgaccccacagggcttttgcgccaagcaaataggacaatataagtcatcccaagaatacaagtataaatacaactctatccccggctaatcatggctatttgaagagagcagctaagctaacaggcaacagagtttattagacatgaaggcacacaggatcatagttcccactgataactttcccaccagcttccctagcaaatacagagagagattccagtgatgtagaagatgtcttccagcctggatccaggcaccaagaagacagtggtagtctctctggctatctgtgctgatactctctatgacaaggatgatcaattgttgccataaagtgctacaatggtcccatcaacttttcagaacacgcttctcatcacactcatgatctgtattttctgacacaaactaagtttctttggcaaaagctgccactgatcataggttctagaatcactaacaaatcggcctcacttgcttctacctctctcccaacctgacatcttactagcaaggtgtgcagtcaatgcccaatacctctggactgtcctaaaaataagacctttaactttaagcatataacttctgagaatgagtccctatatattttatacttcaattattttctgaaaaccacaataattttaaaactaggaagaggtgagatcacttgaatatctttaaatgattagtagagcatatgtactaaagagatgcttaataaattcatttttaagattttttttttagcacagcctctctttttacaaatcgacttgtctgaagtcataaggatttgcttttggcagaacctgtggtataacttaggttatccacctctcggctcagcttttgcttccatgaactctaatgttagacatagcgagataggtaataatttaaacaaattcctgagtgtttaaagttaaagtcatacaacctacattaagcagattggtcctggctaatctaaaagtgttgttcagcatgaaaaaaattgaaaacaaagacaatctaggtagaatttgtttggtttcttcctccctcctatttgaaataacatttaaaacaagcacaataaaatcaaccaggaaaggacttctccatgaataggaatcatcagcattgagccttgtgatttggaaaacaaagtgcaactcaattcaattccaataatcggtttaaaacaggtgctcatatttacaatatgcttcatgtttgacatgtttgtctggtagccttcatactaaaatgcaaactgcaacctgccgacatgttcacaatcactcattccatattcccctcttcctactcataaatggccaacatttcctctgtgtctacctgagtttcaacatacccattcttgtttagtcatatttcaagatctaaaacagataactgaagcagttttaaagtgttcaggtttaaaataataaaaacaataacacaattttacatgcaacaaatgacttaattcaagatagaaattaaggccttaaacatctatgctatgtttttaagtctctcaaatggcacttatggacacaaacgatactattcttgcaatcacgaccatcactcctaaataggcggtacttcattagatcttgttttcctttgtctctactggggtacacaccagagaactgaccaccctgcggttaattttatacatatagtggactaagatgtgtgttaagttattttgcctttgaggatcttgtagccacgggcacttccccacaggtggctacagaatgtggtacacagtcttcacgaagaaaaaggaaagcacaatcatatatctgcagcagtctgtcaattctcgctaacgtgagataaaagaaaatacacaatctaaaaatctctgctcacagtgaaacagcttcagaccaaacccaaaactaactcaccttacttggttgctttaaaacagtccaaaaatgacagcactacaagttcaagcacacagatgacttcccgagctccaaacaccagcacaaagacatcttagaaactttgaaattactcacagtaaaggtaacttttccagagccaaaagagcaaggcgaaaaaaggaacacacatgcttgcccatgaacgtccagagacaagcaattcttgaagctcgttgggggaaaaaacggggaaaacacacctgtatcctttgtggcatctcttcccgggacttaccatatggatggagcttccgtgccactgatctctaagaaatcatatccttcttctagctgaaagtcagtgaagaccagcgcaatggtgtccccgggctcagccagaatggtccaggtgcagtccgcgttgttctcgtactctgaagggaagtgcgggctggagatggagctgctggtcccgcgtaaggttcctccgcaggctccctcagctgcaggggcaaaagcagaaagaaagcatcacatttcaggatggttttcatacacgagtgtgtccaccaagtgtcactcttgatcagcgacaaatattttctgaacccaaaattgagacactcaatctgaaaaagaatcttttggtatgttaatgagttctatgaaaaggcttacaagactctaacatttaaattatcttattaattgaatggccattgcgggaaagatggaaacggtggcttttctgaaacatggaaagtgtagttgccatgtacctgacattgataggcagcctaacaagattttcagagattttctccgaatcctggaagatgacactatgtaagcaacattttgagacttaaaaacatgtgggcgtttattcatggatacctggctttgagaatactgtgctcttaaaagaaatggttgtcttaaatttattttccataaatttgggattaatttgggttttgaatttcagatagctattgagtaacataaaagaggcacatcacctcataaaaaggttctgagtagaaaacagttacatgaaacttaaaatggaatatcttagaaaagtgataagtgaaaggccagtaaagataaaagtgcatttaaaatagaaactaacaattaaaaaattattggttagaaaggaaacagatcttggtaagtttgctatagagtaaaaaagcttctttgttacatttattttatctattacaaaatattatatgcattttaaactatatatagttgatatatataacatataatctatatggtagtttatatataaataacaaactatatagtagtttatatataaataacaaactatatggtagtttatatataaataacataaactatatgatagtttatatataaataacatataaactatatgatactttatatactatatatagctatgttatatatataaattacatatatgagagagaagtattttaaaataacatgttttaaagcatgttttttaaaatttcttccttccctcctttctttcttccttttctttcttctttttctttctttcctcaaatacttcctatccataatatatatttaacagtcattaattctgatactgcaatgtggatgatatgtaaaagtcagcctgttaccaagatggggggagtttgctgtaagcagaggttgtgtgaccggcctgagctcttacaaagtgcatatcttcgaccctacccaccctctctccaccaaaattataccgaagtgagaggaaatgacctccttttattaactcttcccaagttgcaagttccaatatttctttcatctttcagcgatgttcgttttattttggcaggatctaagcctcacaaaaacgtcaaaatagaaccaatcttgtcggcaacagtaagagggtgatataggtcccttcaaattagctgccttcagtttactcagaagaatgccaggggcataggggtagttgacagcacacggtttttgttcccggagtttggagtattgcatttcccatccttcctacgggatgccaggctggtctacacactaggcattctcatgctgtttatgtcaactaatgctaatggcagctttagaatggacgtctttgagaggtacacttggaggaaaattactaccttcaagtatgaacgaaatcaagactacatgagggatgggtgttctcatgttttaatagttagccagtctgtgactcccatccaaagcacgtgacgttgtggaaagggctgcccatgttttgtaggacatctcaggaaactcattttttagatcccaaatttattttaagattaataattattaagtgcacagattataaaaattatgctaccacggtagtgtttccttttaaaagtgtaaaaccaaacacgaataaaaataactgtgtgtatactacaatttgaaaactgcaaaagtacttcctgtgcccactaccaaatgtctgtcctgccccccgccctccgtgggcaccactgtgcaagcacacacacttccctggtcaactgagaacaagctgcacaactgcccagctcgccgcagtttttattacattcttgggaacagccgaatgtctctcctgccccccgccctccgtggacaccactgtgcaagcacacacacttccctggtcaactgagaaccagctgcacaactgcccagctcgccacagtttttattacattcttgggaagagctactgggaatgtgatcatacatatacagttccctgtcaaaattgtatttttgaacagagataaaaatcagtaccatataaaaataagaggaagaacatattccagccatgaggaaaaatacagtggctactactgagattcagatattgggcagaattcagctctaagccccttgtgttgggataatggtgaatcaggttaacaactaaaagtgactcatactctacgttgtttttctttaaacgcaaatataaatatctccttcataaagggatgaggtaaacaggatcactagagacagatatttacttttattattgattaaataactctatataaacatatcacacacattaatatttccagagtaataattgtttttcatgtataaatatataattttatttaatatttagattttattcttttctctgaattcattatatactacaaaagttatggcatctcaatgtaaacacagatgcagaagaaaagagttctaatacctttattacctaagaagataaaatatcatagatgtgtggaattaaaagaaaattatcaaagtccacgttaccaaaatgatgtagttgaaagattaatgacatattaattgaaatccaactgctgaaactacatacattcttcataattcaccttgttggcaagaaatcccccctttcaatgtttcagaggggaaaataaaaaaaggaaaaaaaaaactgacatcaaatgattatgaatttttgtcatggcagtcgatgagctgaatcactttctattatttaaaaagctttgaaatagtcgtatttatgtgcatggtatagaataaacatagaatacaagtgtatagaataagaagcttaaccgattcttctgggaaaacctctcagtaaccttgaccagaagtgaatttaaacctatctgacaggagtgtttacaggcagccaacataacagggacaccagccatagctccaggacagagtccagggcccccaccctgcagccattagccccctggtttctccactgctggaaggttcgatgacctgcagaaggtgtctagggagtttgtagggctccgggtagtggatatgagttaactggtaaaagagggttcttttttattttaacagctgacagaactgtgctggtgcccacccctgagtaccaaccctgatcaaatgagcatacctcactgccatgcagtttccttctatttaaaatgccagtggctgagctggataaactgcaatgttatgcccctgtctaatatttgagtcccctgagtctaagatcttagacacttactatctacattttcctagaatttccgttgatgaatgagtggatcatggagacccatagttcactgggccagcatgagtactaggctcactgaatccaggtaagaccagagcactgactgcaacagacaagtggtgaaatttaagggtaactttgttgggaaaggagtagatgacataaagaaggcaaaatagaaaagtcaaataaaatgaagaaaaaaacaattaaggtagcacagaggaaaaaaaaaattcccaaaccttatgactattgcatttcttcagtagatatgttaatgtccatagaatattccggaatgagttacagttagaatcaggccaaaataatatatgcaagatatattagaattgtttgtatagcactccacataaaatatagtagaagattattaagatagtctgattgattaattgaatattacacatataagacaaacaaaaaaacttcatggtactcatgggataaaatgcttaaatcacagaaaatctttagcacagaatgaggcaaaattagtgttggtgcctgtgagtgtgtgtgtgtgagtgtgtgtgcatgtgtgtgcgtgtgtttgtgtgtatgtgtgtgtttgtgtttgaaagcacctgctatagtgctgtaagtacttctctaacaaaactttttaactcttaatttctccgctatttttgtaagggattttactttctaaacagcaacattttaaacataatagcatttgaagaagagctacctaactaatatgtttgatgagcaaaacatttttaaaaataaatcagtttgtttcctcttagatctatgaagctctacaggatgatcaattttataaataatgccacagaggaaacagttttcaaagcccatttcgactgagaaaaattaattacttaatttttgatataatatttacttgtgaacttatcttccagtttagctgctaaagatattaaattgctcccacatatcgctaaaggataaaagctttgctgacagaaatgggaaccattatccctgcagtgtggagtgctacaaggacccaatatgattaaatgtacatcataaatgatgagtgaagagacattatttaacaaagtatattggaagaactgaatagaaagttttaaaatatcaacttaaaaattccctcatacaaaatacctgttacacaaattaaaatgtttgaatgtattaaataatgggtaacttgttacattaaaatataatatatggtctcaaattaagcattatctcaactaaacagaaactgtgaatgttacggaagcaaaaataactttataagtaaaccaatctacctgtttaattttttcaaaataaatgtataaaaataaaaacaacacaataaaaaaatatttgcaacaacacagcagggggatattatttatacttacttgctttgtattttaagaaacaagatacaggcttggcgcggtggctgatgcctgtagtcccaacactttgggagccctaggagggtggatcacgaggtcaggagatcgagaccatcctggctaacatggtgaaaccccctctctactaaaaacacataaaagtagctgggtgtggtgacgggcacttgtaatcccagctactcgcgaggctgaggcaggagaatggtgtgaacctgggaggtggagcttgcagtgagcagagattgccctactgcactccagcctgggcgacacagcaagacactgtctcaataaacaaacaaacaaaaaaacaaacaaataaataaataaataaatagataagtaaataacaagacacaaacagatacatgggaaaaaaagattttaaatggcaatttaaataagagtgaattctagaacaaaccaaaattaaaaacaaacacaggtgaagtttcaatctttcttattatgataggcattcaaattaaaacaacactgaaatgccttctaatatacattaaaaagataaattctgaaaatacataaatacgaagagtaaaactgatctagttgtatgttcctaatatcaacatgcattaacacagtgcttcaggcgatttaccaacacaggcgagtgacactgagagggctcatatacgccggcaaattactcaacttagggtctgatgtctactgagtatattgtacgtgtctgatattctaccaaggtcattatgtgaactatttaatcacatccaaaacgtgtgataaaatgtttgtttttgttcctctttcacagctaccaaaagagaaatgtttttcatttttttagaaaacagaacaaaacaaaaaaaccatcaactggaaaacattcagagactcagaaaatatatgatcaactaaataaaattaaaattaatcaccataaatactctatagtaaaacagaaaaaagggtataatgtctgatctgtgaaaaagcagaacaaatttatctacgttaagctgtatacatatgtatatttcaagttaactataaagactaagaaatataaacattttaatataattgtggtattatagtaatataattgttatgagggatttaaaaactccttcaatcttttgtcaagaaatagtttaacatctaaaaaacatcccagtaacattcatgaataatgaatgaaacttgggaattcttaatcatagtacgtgtagaactttatgtgtttctgagagagtatatccacaaacaatatatttaaaacatattagagatgctgttgtttttgttttaaaataaattctgccatgaatcttttttttttttttaaaggaaaggctattttatagtaaaataaaatggcctaatttatctattatatatctggatttttgtgttatattcagcaacaatgaaaacataaaaatgaagtagtatttttagcaacctaatttggtattataaacaaaacatatttatttgggattttccttctttccttcattttactattctacaatatattttagatttcaataaatttgtgtatgaaatagtcactttcttaaaaagattcagctggttaggttacaaagttgacctggatgagattggtgactattattctttattctttttttgttttgttttgtttttgagatggcgtctcactctgttgcccaggctggagtgcagtggcgcgatcttggctcactgtaagctccgcctcccgggttcacgccattctcctgcctcagcctcccgagtagctgggactacaggcgcccgccaccatgcccagctaattttttgtatttttagtagagacagggtttcaccgtgttagccaggatggtctcaatctcctgacctcgtgatctgccagcctcagcctccctagtgactcttattctaagtgaagtactgaggaatggaaaaccaaacatcctatgttctcactgatgtgtgggagccaagctatgaggatgcaaaggaataggaatgatataatggactttggagatttggggggaagagtgggagtggggaaaggggataaaagacaacatatatgatgcagtgcatactgcacaggtggtgggtgcaccatctcagaaatcaccactgaagaacttacttatgtaaccaaacaccatctacaccccaataacttatagaaaataaaataaaataataaaaaaagtttcaagcctacagacattcattgtacttgcagaaaacgtaatgcaggggcgggtccggctccttgaacagacacacgtggccgggtggtcactccctctgcaaccaattagacacagacaagtgctttgcagggccactgtctcaacatggtggccgacatgaacactgaattatctccagtttcaaatcatgtggcgatacacttgcctttctcaacgaattggctcattctttattttctgaattgtcttttattgtgtaaggacgttccacatggtattataaggtttgcagtcataaattcactctcaattgagagaacatagggtgtctcccatggatactatatttggtgctttcttcccacttcaaacaacagaagaactttcaagactccctcatttgatttgtttcagctaaatatgtggaagtgagttattgtatacaagcaaacattaacatcagaataattagtgtcagaatctcatttgcacttggcattaacagaccccggattgctagcataagcactgtcttttaattccctggtccccatgaacaggagctggctgccaaaatcactgggaattggcttagaagttgactttgcagaaccatgcatttatgttaattaatttattcattcaatacatacgaaaactaattctctactagaatgagcagagaagggttttctgaaaacacaatatttaggacagatttgaaaaaaaggaactattcaaggaatgagctggaggaagagcattcccaacagatgcaacagaaagcaccatgtccgaggagacttgatattcacatatcaaccacagatgatttatgtactgcaaattccccatgacatttttgggtgcattctcatgcagttgctgagaattccgggacagaaatatattgactttgtgcgcaggagtaaggatcattcacccacaggatcatgactctggaataaacaaaaaatgaaaagcatttgggaggctgagatggatggatcacctgaggtcagcagtttgaggccagcctggccaacatggtgaaaccctgtctctactaaaaatacaaaaaatagctgggtgtggtggtccatgcctgtaattccagcttcttgggaggctgaggccgaagaatcgcttgaacttgggaggcagaggttgcagtgagccaagatcaccccactgcacttggcctgagcgacagagtgaggccttgcctcagaataaataaataaataaataatggcaatattcttgggatgttagttttatttataattgatccttccccttgtcaaatccataggtaagcaagagagggaacagcacttgtttatgtccttttccttttaatctgcacatgcagatggcaatgtcagaatatctgatttctataaaatgaagtccagactggaaccagaaggaactcaccactatttattacggcttatatcaccattcatatttcttttgtcgctgagagaatccaggacttttcctattttttttttttttttttttttgagatggagactcactctgttgcccaggctggagtgcagtggcgtgatctcggctcactgcaagctccgcctcctgggttcaagcgattctcctgcttcagactcacgagtagctgggactacaggcacacaccaccacacccggctaatttttgtgtgtatgtgtgtatttttagtagagacggggtttcaccgtgttagccaggatggtctcgatctcctcacttcgtgatccagccacctcggcctcccaaagttttggtattacaggtgtcagccaccgagcctggccacgacttttactatttctcagtgaaatcaagcactgatgcccactttcatagaacatgccttctatatattttctattcaaagctgtgaactactcaaatcaccactcataataaaaccaaagcttaccaggccctgaaaggcattatgtgagctggaatgttggcttcttctgttcctcatcctccacctcctttggctcccatttcctcttttcctcactgggtctagccacactgcttcctggggccagggcacctatgttcctgccctaaggcctttgcaatgaccacctgcctgagaagcacatctccctgtctgacttcagagcccctcacaaggcactttcctgcccgccctctctggccaccatatttaaactagcactcacctagattgcttcccacctctccatcctgtatgcttacctctcggtgcgtgctgagtgcaaagcaatggaatgcaagctttatgagcctgttcttgcacttgcgtgcacctgttcctaggaggcggcctgatagaagtattctttcttcctctttttttttttcatgcaatgaatgaaaattgaatgactctggctttcctacagttatatcagttgcaaacaagcctctattcatttgtctttaacaagtgttgggactatgacaaaatatatttagggggctatgcacggaatcaaaccatatcctctctaagaatagaagaagaaaagtttatttagttatagagatctgtggctttcttaagaatgagtgttaaaaaaaagtagtctataaaaactgcctcaagaactcttaatagagcgaaatttcagataaaaattaattaccaaaaagaacgattcataattgtagcaatccataagaggtttatttgtgtgtttttgctttgcttgttttcagcaagcaggaaaaccacaagtccaggaggttttttctttgtttttaaactcaccagagctgcatgaaataaagtcaaggcaggtagagaaaacaaaatagtcacagcaaaacattttaaaaggacaaatatgagcaagctacagggcagctggaaaaattagttcaagttccatcaagttcaagtttaacttaaaaaccacatataaaatatgaaatgtattaaaatatgtaattattaaaacaaatatagttattctgttcaatttttaggtgatctattaatataatggaagctccttttattccatggatactaataagcatgaaaatatatcaaagttttcagacactaatatgtattatataatttttttttatttggaatctgaaatttggtgacagaattaaataaatgctatttaaaatttcagctctcccttgtttacacatgatgcagaacaaaacttgaagttattgttgaaagttacagataaatacttgattgttaaagttagcacacaacacatgattcagtattttctttctttttttcttttttttttttttttttttttttttttgagacagggtctcgctctgtcgcccaggctggagtgcagtggtgcgatctcaggtaactgcaagctccccatcccgggttcacatcattctcctgcctcagcctcctgagtagctgggaatacaggcatccggcaccacgcctggctaattttttgtgtttttggtagagacgggatttcaatgtgttagccaggatggtctcgatctcctgacctcctgatccgtccgcctcggcctcccaaagtgctgggattacaggcgtgagccaccgcgcccagtctgattcagtattttctaaattgtgctcctatgatttccatgccaaagagttaatgtttacaaacagcaaaatcgtcagtgggtaggttttgtgcccataccgaatttccatcagagtaattatttttaaaaatatttttcctttattgagttatcataaaattctgcatttgaagaaaatgttgtgcagttaaaaaatggttgaacaccactgacttaatccaagaagaacataaggcatttaaggaaagatgcatttgaatctatttatttctgtaggttgggaaaataattctaaatgtaagtgcaaatcagaatgaactgatttctatttcctcccaagtaatttcagactttttaaaaaagtgtatttctcaactctagaatttttgtgccccttttgtgggtataaaacttgctggaaatctatcttacggacataatttaaaatacagaatagaacattacttagaagcaaactgccatgtttatcataaagaaaaattgaaataatctaaatattcaacagcggatacatcattaaataagctatgatacattcaaaccatagggtcatcaaatgtgtttaccaagcatttataatattccttcagtgaatttctaagtcatgatgttaaatttaaaaatgcaggttatacagttggatgtgtaattccaactcaatttttacaattgcatggggaaatatccaggaaagaaataagaaatacacccacatatgtaatataatagcttgtaatactgggagatattattgaggaaggaagggccacaaagagttggtggtcaggatgtacctacctccacaggcgctcactcctccaggagccagaatgaaaggaacccagagacatggaccattcctgctccatccccctccctcctgttctcagagagtcaaccccacttacttcatgcctgaggccattaagagggtactctcgtacatcctttgtcttcctttacaacagtccctgcaaaaagccctggtctcctctgtcgccctttatccctccaactctcatcctctaaaagatctacacatcttattttctgaccccctaatcttaattcttcctatgctcctgaatgtctcctactacttcctcgaaaactgaaagtcaattataaacagaatttcctacattccaactacttctgacatattttccttcccttcttcctctgatggaaacctgaatgtcttctctgaagtcatctcagtagccaatgttttacatctgtagtccacgtacactggtcctgctggcagactgtgcccacccacatgcatctcatggctacttccaggtgactcatggtcttccctccctcatgtgcccagctttgagtctcttgccataataatctggcaccctctgccttgtagtcatctacaaacccctacttgaaatccactattccaagaagatttaaacttcgggccctctgtcagcctcttcacctctacctctgcacaaattctcggtcatttcaatgtcaacacaggtaatcctgggaaaaacataacctctttgattaattctcccctctcttccaacagcccaactctacctcagccatgccatcaccattcccatcatcaccctctatcttctcactaccagtaaggcatcagtttctacagctgcagtctgactacattctgagcccaactctccataccaggtcacttacccaaacacctaaactcataattttttgactcatgggacctagagttccctgactctgcctccccttcactttcttttccttgtccctatcatgtcctcatctcttgtcttaccatccttagggctcatggcctaatgcacttccttgcatttaccataactctgccatcatcacagtaaaacacctttggttccagtctaggccaagtccacttttatatccttgcaggtaaaacagctggaggaattccaaaaccaaaaacatactgaaaggtctaactttacatatatggccataatcctacattggcccataatgatgcccagcaatcccgcttcactttctgtatctgttcactgctccctttctgggggatgactgtttcatgccttcttccttctaaagctgccagcatctcttgccaaatcctcactgccacctgatgactttggtttccatttcacaaagaaaatagaagcaatgaaagataaattatgtaatctataaccttcaattttgatgcctacttataaaatatctttcctgcaaatatttctacctagtgggtacacctgtttgtgttctacctttcctctctgatcaagtttttaagccacgactttaccagttttcttctctttcaaaacgactatttgtgtttttagtggagaattgctctctgcatataaccgtgctccaattgcccccattcaaaaacaatgttatagacttttcttttgattccatgtctgcttccagactccacattcccctctagccttactttctgaaattcctttcactgcaacacgtctcaaagatgtccacatttgcggtctttaaccttgttacatcctctcttgaacccacttgagtcagagtttcaccctcctgggtttcctgcagaaggcccacatgtcagccacagccagaaatccaagagtcagttcctaggattcatctcactcaagatctcagtgacatttaacattcatccatttcctcatccttgaattcttttcattcctacacttcctaaatttttaaactacgaaataattagaaagtcacaagaacttgcaaaatagtacggagttatcagcatacttttttctcattttctcccagtggttacatcttatacaagtgtagtataatattaaaaccaaataaaaattacactggaataatatgtgcacagtcatctttggtatccattgggaattggttccaggatccacaatgctcaagtcccttatataaaatggaattttatttgcatataacttatacacatcttcccatatactttaaatcatctctccattatttataataccaaatataaatgtcacagaaatggctgttatactgtattgtttaggtaataatgacaaggaaaaaaaaagtcagtacatggtcggtacagatgcagccatcatatgcctagctatattgtagacatagccacaatgaaacattttctagatttaaaatatatatatatttttcatccacatttcattgaaactggatgcagaacccaccagtaaacagggctgactgtatatgattctatgccgttttactcactcgtctctttagatactactcttcaggctttctctaatcttattggccagttcttctgagtcatcatgccagtttcatttcatcttccaatccttggtagggtgtccaagattcattctcttcacctcttctcttcctaaatacattcattcattgccttgttgatctcatccagtttgcgtcgcgtggatttatttttatgttttattcttaacttttatttttgtttcaggggtacacatgcaggtttgttacttgcataaatcttgtgtttcgaggtgtggtgtatgcatgatccctacacccaggtagtgatcacagcacctggcaggtagttattcaaccgtcaccacctccttcctcccctcagtaggcctcagtgactatgtcatctgtatgtctacagttttcagagtgtccatcagttccatgaatgtctcctgaattccagctttatgtatccaactccctatttcaactccatagaatgtctaaatagcaatccagactaactagccctaaaatggttcttttgctctttccattttcaaatctgcaatctcacagtcttctccatctcaataaacggtaactccattcttccagtgttgcacgagaagacacacggtgccatccatgactcttctatgtctctcatgtgtcacaaccactgtgtagggaaattccatcagcaccttctttaaacagcattctgagtccaaatgtgtctggccatctcctctgctcctgtcatctctcaagtaacaacacctctcattttcattttgcaatgattttctaataggttttttattttttcccttctcagcttatgttcttttctcataagtagccagagtaatcctctcaaatgctgtgtcacacgatgtcgtttttcttctcgtatccccccattgtgctcccacactgctcagtatagaggttaaagtccaaaggctgatctacagggcccactcctatcctctgggatcctccgggacctttcccctctcctatcctctgactgtctctcctacaaccctccaattatcccatctgctcaggccacactgccgttgctctattcttcgttcactcaccgtacgctgttgtctcaaggccaaacacctggttgatccctctgtcagaaccacatttctgatattctcgcagggctcactctgtcccgttcattagaggtccaaatattccggttttctactatcaggggggtttccaggacatgggatcttaggtgataagaccaggagagtcctgtccaggcagtgaccaggcagatggtcaccatagctcttaattacatgtcagcttctcagtgagaacacttacaaacacttatttcaacaggacagcaaagtttatctgttgcttctcatttgcttatttatgttatctatctccacccattaaaatgatatttctgcaaagattggaattctttcttgttttgttcatattgtagccccagcagctacaacaaatgttggcgaactatagcttgtgggttacattcagtccagtatctggttttatacattaggctttactgaaacacagccagtctatctgtttaggtggtgtctatggggtcttttgatctacagtgacagacaagggtagctaaaacagagatcatatgacatgaaaacaaaatatttgctatctggcctttgacaaaaaatgtttaccagccctgattgataagtgtatgtaatactttgcaggtcctcaataaacgttccttggaagaaagaattaacacacgtaaatactgaaaggacatacggagaaatattgatgtgtattggaaatcaaaggcaataaaaacaacttttgagcatcatttcaatgccctcaaactcagcaaattaaaaagaaatgcaagtatcaaaagttatattaattgtggtgaactgtcataacattagaaatgcattcattaagtttgcaaagcataaacaacattcctagaaatctttccttaggaaaaaaatctaacagaagcaacaaacacagtgctatatgtacagagacactaattatggcattgcgtgtcgaagtgaacatgggaaacattcatcacattcaattatagagagaaaataatctgtaaaatattgagaatcaaattatgtcaatgcacatagaagtgtgtatgatttaacactaatcttctccaggagaatataaatgttctctgttctgtgacttcagcctctaagaagctttttagacattgagttggcttcttttgatgtctgttcccccttactcttcaaggactactatgcgatcctaatagccgttattggtattaagcacctggatcatctcatctaatctttatcactcctgtgagattaaaagtaatattagcccaacttaacaaattcagagcctgggtcttagcaagaaaagagctcgtctgagctgtgccaacttgtgatgaggctggagctagaatgacaaagtccttgctggtaaacacttcgcatgactgcccatcacaaagaagggcatttacctgggcatggattcattctggcactagacacattcatctttacagctctataacctaacatggtatctgcatggaataaaataattttagaaatactacaaagtaacccacaaagctgaaaataatgggcagagccacttctgattattttttaagcctgttacaagattgtatgggatgagataacgtgaatgacgtgcttggcagaaaatgtagcacagcaaatatgcaaaccacgtagaccaggtttactagaatctaagactgatttttttgaacagttttaattttgatacgatttacactggaattgtttattgcaaagtatgcaagaaaggtgcttaaaaccaaattgtctaaaactactcaaaaaattgaaagctaggtttcttatataaaaactgtcccattcagtcttactttgtatttcttgtcctgacgtgacagatcatttaagattcattttacaatgttaccgctgaaacataattgataaaaacacagctgtgttttaaatatcgcagaatttataggcacccataaaaagcatgacttctcttccttctcccctctggctatgtcgttcctagttttcctgccttttcatctctagtagcagaatgcctatgattaaaaaacctcgactgacagttcatatagaattggcaagtgacatattgccatttccagtcacattacgtaaggcttaacaattaaagaaaaccacagcttcagataggtctaaaagcaacaatgggcctacactatttagcatgttttattaaaggtatcagtgctactgctatgttatttagtggcatcttggcccaatgactatcattcagtctccaagaaatacaacagtctcaaaatagataaaaatcagtttgaatcttaaaaaaaaaaaaaaaaaaaaaactcaagacagctgctacatcccattttatctaaaactgttgaaaaatactgacaatgtgttttgacatgtttaggtgaatacttatcttaaatgtatgtgttcagacaaaaacaagggtgaaacttcattcactaagcaagcggcgtaacttcccaataatggttcgtatgctgccgttttctatggtttacatctcatgcttccaagcaaaacagaaacaaacaaatggcaacaaacaacaaaatgtctcttcaactgcccccaagaaggttgccgttggagggaaatgtagaaaagcaccaagtcagagctggccttatcagccactgtctttcagccttggacatgacatctaagctctcagagaatgtgattccatatctggaaaatctacccattaatatttaccaggaaattttgggatgggatcatataaaagttcatataaaacattttagataggattgcataaaagcattgaacgttcataacgtaacacttgccagagaggtttagtctaagtaaaatatttagtcatgtgatctctccattccctttgctttcctgcttgagtaattcataggtacctaaaaagattccagtagatggaaatagaaaataaatggggaataattaactactgaccaactgactctcagacattttgcaatctcctcttgcctgaattggcttcccgagatgatcgagccagtggcagagaagatgcatgaccctgcagctgcactgagcctgtctcttagacgtctccaggtctcaggcctctgcccaagaatgcaagcttcctggaggacaaggaggtccaaggttttagtgaaggatctggggctatgagaaggaaagaggagaaaagatgaagattcacttagtcctcaatcctaaaaagcctttccccagatgaggaaaattatttgggtgaagagatgactctttgctttgtcttctacaggtttgtcttactctgtaaagcaagagcttcagcaaaatagatttagcctttaagtaacatgttaggaagaccctatagccaaaccaccctcttgggttaagggctctgttgacctaagtttatgtgtatagttgggtttttttggtcgttgttttatttgacatccatgaggttgttggaagtcatgtctatcaaagaccaagaacagcagttttagttgggtatggttcacaatcctgaaaaacacaatcccaaatgccataatcccaattgttgaaatctcaaaagatgaaactccttaaagtcaaaatccctaatgtctaaaaccctgaaatcacaataacagaaatcatagaagactttcagaaggaagagccacatcataaaggaacaaaagcagatattcatccggaggcaagacttcagaatgtactcagtgaccgcggtgttcagccagccttgctggacgctctccatgcaattgtacatatctacccctgcaatacacttttgtgtatgttgaagcttccttctagatatctttttttaaagttttttctactattttaaattgtcagcactatttttttcacaattcaaggctatgcaattcatcttctcatcatttctaatatcaaatgccacataatttctttctttttaggggagggaggacaaagtttcgctcttgttgcccaggctggagtgcaatggtgcgatcttggctcactacaacctccgcctcccgggttcaatcgattctcctgcctcactcttcctgagtagctaggattacaggcatgcaccagcattcccagctaattttgtttttttagtagagacggggtttctccatgttggtcaggctggtctcgaactcccgatctcagatgatccacccaccttggtctcccaaagtgctggaattacaggcgtgagccaccgtgcccagctgccacctcgtttataactctaaattgtgtagaaaatattagagagttctaattaagaattttttttttcaaattcgacttcaaaaactgcatggtcacaggattgactttgtgcctcggcattgtgtgtgcatggtacaaatgctgaaacttcctaaataaatgaagagatgtcctctttgtaatctgcatttggaaaagataacatttctggagatctcagctgtttgggtgactgtatatctggtggtgatccatcatggttttcaactgaccaaaggacttaggctaatcatcacggtatttctgatgactccaatcataaagctggttgcacacaatgggcaactatagcggcatgcatttatacatgttgcattttgattaattgcttcatgagtatggtttgtccactcgtaactgtcatacccatgaaactgtcactagtgtgggtatgtatgcttgcaaaaataagctggttattatagcctattgtatggcataaagtatcctacaaagtgttttgtgtgtttttatgtcttttttcaaagaaaccctttataaaaaataaatacacatcttttacataatttaaaaatattttccagaattatattttcaggattctgactttttatgatttaaacatttggtattatggtgtttgagagtctatcttttgggattacagtctgtggccatttttatcaaggcctggcttaaatgtgtattcattttcatccacaaataatgccgaggagctgccatcatctttctctcttggcaacttcctgcctcgattcctgttctctcccagtttgcaatctctgagtagctgcaggtctgtcaacacagctgtacctactttgcacaaggagcaggtggaggaaggggaggcagccaaagcccagcagcttccctctctctgggaccagccagttacctgctttgatgagaaaagcagagcctctccaggcaaccagcaccccctgccccactcagactattcaggattcaagcacatgtttctcaaggagaaaacacttgtttaattcaagttgtaatatttgtttctcaattttaagttaggttcttttagaaatatttatttttctcttgagttagaagagaacggacagcatgtgacaagggccgtggcacagactctgtagccaaagtgtccagggtcaaattctgccttccccacatacagcgtgggaccttggtgaagtcactgaattcctctgtgatggagtctcatctaaaccagagggatgatgataatatataacttctagacttgtcatgaaagttaataacaagaacatacgtaaggcatgtaaacattgtctgacattttgtgattgctttgtgtttaactctgattaccacactttcttaaaatctacaattacagtgactaagatgaaatctttatcgctttgagacagatgctactccatttgctagaaattgtctatatctggactactgctagatacatatttttgtactaggccatggtatcgtaagacttaaagaaaaaggaaagaaacacaaaaagcagctcaacagtccaagacaggtttattatggacaataaacctgagagaggctcctggctgagttaggtcagaggcactctctcttacagactaagagtttttaaagattcagggcgagagagcttatcacaggcttggaatgtttctgtgtctctctcttgcttatctgggagggagagttttgtgtctgttcccatacatctccgtgaagctgcaagcatactaccaagtctgcttttagcttccctatcttcatgtacctaaaaggaagggaacattcccttattagggcccttattagggcccactgttttactggggcccattgcatgaatgtgaagtttggtggttacccaagagacattccccattccctctgtgcctgagctgtcgtatctgtgttttacggtctgctcttgctggctgcttgttgtcagaagacaagtgatttccttgaaatgcatgaggttagaaagggagctggaacttaaagtggcagttgtctgagataatgctgctcctgctttgtcagttatttacatgcacgtgggtatgaatgtgcctgttgtagaagtagttttcccaatatttctgtccaagtggtggtgtgtaaaataaagtgacccactgccacacaggcctttctttcactaggcactcttgtcctttttcctgagccccaaaccatttctctcctcaagtcagtctgctagtttcttattctaaagaatagcagtaattcattaaaaaaaaaaaaaaaaacccttttttttaagagctaccaatattgagatcctgtagcttacatgaatttcttttcaaactgtttgccattccgctctgggcacttagttctgaaatctaaaatcgtgcttaagagtggaagggagaggagatagagacagtaattatagcagctgatatttttagagtttctctatgtgtcaggctctttgctaaccattttacctgggttatgccatttaatctttacaacagatttctcaagtaggcacttttatacacataaaaatcttgaggccagacagattaaataaattgaccaaagacacacagtgtccaattgacagcactgggatttgccccaggtgaccagtgcagagctgctgaacaagctgtttcaccacgacaagcactttaatccccttctttctgtgctcaagactgcaagatgttgtatttcatttaatccttaaactgacactgagcatgacatctgttcaaaatatttactttttctatgctctattgatattataggatagggcttggttatgtgaccgctagggtcaggctgcctgggtccagatctcacctctactgctttctggatgggtgaacatctcagataagaagaatacataaccaagatggagaagtctgagaaaggcctccaattctcttatggtaagagatcaaaactgctaggtccctagaatcactcttctttattttttcttacttattccaggacagataacaaagctgttttcattttactccctcagcgaatccgcgtgttcctcaaagtcttctgtaatcttcattcattagacccaacgtcattacttccaaccttgagataaggtctgaaatgagatttcttttgagaaaactttttagattaatcaagagttagctcactcttatcttttgcctaaactaattttaaaagggaccctatttttggtcctactcagctcaaatatgcttcagcaattgctgaaacttaaagggaagaatttccaacacattgtgacgtggactttgatatctcagacccattgccttatcagtctttatgattaaactgcatctatttattaaaccctacaacgtaagtgagaataaaacccagtgacagcatcagagctctacaagcattagcaataatgaggatagaggatacaacaagtttaaagttgaggctcaatacagtagcctgaagtgtatgcagctcatgagcacgtgaaatgtggctagtcagcattgcaaaatggcataactgaaatacacatcagattttgaaactagcatcttttgaaaatcaaaatacttcacttacagtttacattaattctgcattaaaattataatcctttggaagtatgaggttgacaaaatccattattaaagtttatttcacttgtttcatgtcacattttccgtgtcgcatctggggatttttaacttcatctgtggctcacattatggattgtgttatatgttgagtggacagcactgctctaattactaaggacctggcttttgttggttaagcgtgtggcagttgaatccgctacatccccagcatcgtcctcagtagagtgtggatgctccagcaaggatcagctccttctgagcaggtgcacctgggatcatcctcatgctaagtcttatcctgatgccctcaaatgacttatcacatgtagctgctctttttaaactctctctccccatcccttttctcttttggcgcatacctgcgaaacttgttcggagtgactatttttttctctatgtattgttgcaatatccctttacctatccccgtcccctccccaataatctttatcttgagtgacaaatgaagaagccatttagtgataaaactaaattaaagaaactaaagacccggggctctagttggctcagagataacaatgaaatagtgccatccccctctctagcttgtaaggaaaacaaactaccccagatcatcaacaaagctgactagctcttttgatctttatttttttcaactagcttcagtcaagtgctgcctaggaaaggatagttaggtctgtctaattctggagtccaacactggaaagtccaggtgcctatatttttcattctttaatatacagatgaatacatatgggagcatgtatccacacacacacatatatatatgaatggatatagaatatatatatatacataaatatgtatatatttgtatatatattaatatatatgtatatttatgtgtatatatatatatataacaatagcattgttattggtaataaaggtgctgactattttggtctatgcctcactattcatttgcttatctcttatgtatttcagatttcagacaaggaagagaagtattatttagtgaacacccctccaattcagcagaagtgaatagcatacttaaaatcatgaagcaacactgtaaaaattatgggaggacatattttctatgtacagtttgtacttagccaatacatccatgggcgtggatgcagataaggacatttgcagccttgctcaggtttaaagacttccctccgaagcaacatttggtagaaagcatttgaggtgaaactgaggcacaagaaggtgtcatgaaacagggtgtgcattgagggcacgagtaaagagaagcctccaagttactgctttgcgacagtcctagaaaccattctggaaccctctgggtgagcgctcagggagagaaatgtggtagatttgggggaaatgaaggcaagtgggatattgaaaagctgtggtgaagtgacaactcactggatgaacagacaactagaaactttgggaatcagagaaaacaattgtattccacatattaagcaatcgtgtaagttagagaaacaattcagtggtcttcagaaagaagaagagagttcattcggagcaagaattcacatagttaagaagcagaaaatacatggattattgtgatgaaagcaagtgtgcaactaagtaatgagagaaaaataaggataattcaaaatttgagggcaaataaatagcagtatggcaaagatgggacagtcttttaccaaatccgtgtttttcttcttcctgagctcacagatgcttccatttcctggctctctttgcagtgaaatatggcctcatggttgagcttcagctaatgcagtggatgtacaggagatgcactctaatgtgtggaggaactgcccatcacaactcaagttcttccttttcacccagtgcaatgttgcaggctacagaccttcagggaagccagatgtgaaaggtggccatctccaaatcaccgctgcgcataaaaacatctgaaccaactacccatcattgagactcattttgaatttaacttgagcaaagagtatttctgtttgagcccattaatactgtattaatgaaacaagcagaacaacaatgccctggtccaaatgtgaaacaaaagtaattccaatttcattatgaataattgaggcaaagccagcactcatctagactctgggttgagtagcattagggattgcaatgttggaatcacagaagaggaagtctaattacaggcatacgcttggctctgtgctgagcaatattcacgcacttaccaaaatatgaatgcttactgcttttcaacttttttttttttttttttcctgacacggagtctcgctctgtcgcccaggctagagtgcagtggcgcgatctcggctcactgcaagctccgcctccagggttcacgccattctcctgcctcagcctcccgagtagctgggactacaagcgcccaccgctacgctcggctaatttttttttttttttttttttttttttttttgtgtgtgtatttttagtagagacggggtttcagcatgttagccaggatggcctcgatctcctgacctcgggatctgcccgccttggcctcccaaagtgctgggattacaggcgtgagccacagcacccgaccactgcttttcaacttttacaagcagactttagatacattaagagcgacttcattattattatttaattaaatataaaggctgacatatttgacactgcaaaggttctattgcaattgagagaacatagaggccaaaacaggagagaaaatatactagaaagagtagaagcaagaatattcacatcttactaaatggaaagacaagagatgttaccaaaaattaaagaaatacagcataaagaatcagttgtattattccagttcataaatataacagatagtaagaagacatgggaaacagaagtgatgtaacatattaatactcatatcaaggtgtcaattgagaaagttcacaacggataaagcatgaagaataatgtaaacaaattacataaaagacaataatgacagaaaaccagaaatggttaaatcttatggattctgtggcataagagtatggatacgctgatggaagttttactttcatgggaaaactttattattaaactcttcaaccatgttcatatgttactgatcttcaatgttagtaaagttgggatgagaccacccaaactatagctgacttgttacaatgtccaagtcagaaatttaaatcagaggtcaagtcaatttgagactttagtttttcacccttattacagaaataatcatattttccctgcccatttcttaaggttctttgaggtacaagcaggatcttgcatttatgggcctcagcatattgccaaggagacactgcataaatgtgacttgtggataccttcctatggtggttcattggagttgcacataggagctactgcaggccgctctgtgaagtacggcatacataaacatacgtagtttatgacagcttgtgactgggaacttcctgagtatgacttcagggatctaagctctgcaatgctgctgagaattgttttcttaagtaaggtttgctaaaacaaagtgttccatcatagaataaatgaaagcatgtaaaaaggtggtgttcaggtgagggagcatgaatctttgtctgaagtacgattggcctgggctaggcctgggtgggtttaaacggcctgatgccttggtgattacataggtagaattaggcagccgggacaacatcagactaatactcacaaaaataagattcagaattggagcaatggaataaaaggggacaccgaaggggctgcaagagatgttgagactgtaattttccatggatgtgagctcctgtgaagaaatgcaccccctcctgggggagtgttctggatcagatgttagctttctcatggaggaggattttctaaatacaaatatttacctgcttcctttctaccttcttgtatgcccctatccaaaatccacacagtggaccatctttcatgttttccagtcaggaagaataccttgttttgcatttgatcctctatttccctgtaggaccctagatctcaaagtaatttataatctatcctaggctgtaccattattatttaataatttatgaatcaataataaagtatgggaaacataaagcaaattaagaaggcatttaaatcaagaggcaaaagcatttttcattgaaactatctagctgcttcttctcttttttcatatttctcccctagacagacatcatgcctgtaagaagtgaaacagtaaatcctttttaagactggcagaacatgccaataatatacaatgaataaggtgaattaagaaagacacagatcttaagttgaaagactcaagaataacgaatagttgaaagattacctctcaagaaaaatgaattttgaggtctcatttttaatgtcaatgtgatgtttgttccctgtttaagggacacagttttaagcaaaggtgactggcctctgatttagttctgttaattattttctattaattaaatatacagttatacctttttctttaaagaacatcacggctacatatataatacatttaggtgtcattattcagggaaaatattgctagtttgaataaattataaacttttataaccctggcaaaagatcattgtagaaggagacagtcatgctactgttaggaactctataaaaaaaaaaaaaactcttcaaccagttcctgcaaataaataagtattaatagaactttggggaagcagaatatatactcatttcattcgtgtgaattatctcagtccatatggttgaaatttacatctctcataaatatgtcacatttacacatttacaagaattagatcattttttctttataatctagttatccaaatccatgagaaactgtgctgcatcattcaaatatgttttataaaataacatgtaatggaacgcaatttgaagtcatactacaccagacactgagaaaagcaaaatttaaatgtaaatgtaataatctataatacagaagaacaaagtttcctgtgataaaagcacactgatctcattgggatttaccacatgggtggcagcataggaaagacacttagctgactgttatgtcaactttgactacagatacgattatggaaattttaaagatcctccaattaagaagaaaaccactggaggatatgtaagcaaaaaagcaataaacaatgaaggaaaatactcttggcttaggccaagttttaatgtcacaaggaactaaggacactgccactcacagttttaatggtggtatcttatctcctgggaagctacaagctaacaccattaagatattatgtcaaaatataaaatagcaatcagacaaatgctatctgagagatcaagggacttcttttttccttaaagaaactgtaataaggggttgtaatgataactaaaatttagatttaagtttgaagttgacaaatgattaagatttatggctgtagggagatgacagggagactctgtggcagtgtaaaaacctgagcaaaagtttggaatttggcaaggtgtagtatgctgctgagcgaattctttaaaaaccaaccaaacaacaaacaaacaaacaaacaaactgaaaacctactttgcagtgtttgccaattcttatgctgtagtcccactatgacagataataagctaaccacatgatgtcaaggaacacagaacttggaaaagaagcagatagttctcaggccagccaggataggtcggccacagaaaaacacagctttgtggagcaaaaagctttacactcatgttgggtacactaccaggtggaattgcaccatttagttacgacgaggtaagaagcatataggaagccctgttgaaggtttgtactttattctcattgagtcaccaaagtagtttggctgataaaagaaatgttaggatgaagatggatgttaggagagagtgagtcaggagtagaaagtaggatgatggtatgctttggctgtgtcctcaccgaaaatttcaccttgaattgtaacctaaattctaatcccctaatccccatgagttggggaggcacattgtgggaggtgattagatcatgggggtgggtcctccatgctgttcttgtgacagtgggtgagttctcatgagatatgatggctttataagggtctttcacccttcactctgtacttctcgctcctgctgtcctgtgaaaacgtgccttccatcataactgcatggttcctgaggcctccgcagccatgcagaactgtgagtgaattaacctcttttctttataaattacccagtctcaggtatttcttcatagtagcatgataacggactaatacagatgacaactgacattttagacatgggggcccattgaacaaacttgaagccagtctgtttgagaagggaaataaataactaaaataacatagtaaaggcagaaatggaagtaaggccaagacacttgaaatgaagagtatgacttgagatctacatgatctattaaaaattaaataaataaagagaacaaagacacagtaactttgattttttttctgagagtgagaatgtaatggaaataatggtagaaataaggaagaagaaagaatatatttaggatgcccaatggcactctcttaagtgagatcaattaattgagaacagtctgtggaaagcagatgggatacaggtttaggttttgaggccaccactgttttgacaacataaagatgaaaagtaattaataagaaaaaaatgaaaatggacataataaacttcaggaacatgaagagaaaatgagcattttagaaaaaataatgggcatctagagtaggaactagtcatcatatgaatttctctaggacagaggaataattcaaatacgattaatcccaaatctaacatctattagcacaaataccttgagcaagtcacttttcctacctgaagtccagattccccacctataatatgaatctttaataaaatgcctacttatgaagattaaatttgctaaagtagtgcctggcttacagtaagtggacaatacatactagcttgtggggtggtggtagtagtagcagtcatcgccgtcatatgccattatgaatacaataaacaccaagcagatctcataagactctaacattttacaaaaaaaggaaaaaaaaataggcaaatatgcaataactagcgaaggataaaataaaagcatactgaaggaaataatataatgttacatgatgacttgcagtggagcctgtaaattggcatgcttacaatcctagattaaaagccagacttgtgtttgggtcataacatttactatctctggaaccttttgcaaattaaaactctatttctttaccttttaaatgagtgttaataattattacattagtgcttgttgtgagagttaaatggtataatccaagtgaagtttttagcaaattttctggcatctcattaagacctcaataaatgttaggtatgcttttaattttgtactcaaaagataaatttttcttaggaaagtcaaaacctaagagttgaagtatgctcttttctaaagtcattggaacagtaaaatagtatttttggaaaatgtaaaaatagcagtgttgcaggtaaaggaattctcatcttgctctgaaatatgacaacggcacttgggagagggcactaacttacaatcaccttatctgagaagactgacagtgttgaaagagttcttaaaatatacacattaaatggtcaaggagtgtttgtaatttttaataaaaaagataaaaaggaggcaacagggctagaaggacataaacattggcatcaaatctttgaatcctacaacgagaggtgatgaaaataggcagaaatccatgaagactgaaaaacaggatgaaaacaattttggatatttgggggatataataacaagttgcattagtctgttttcacgctggtgataatgcatacccaagaatgggcaatttacaaaagagaggtttgatggacatacagttctatatggctggggaagcctcacaatcatggtggaaggcaaggaggacctagccacgtcttatatggatagcagcaggcaaagtcagcctgtgcagagaaacacccatttttaaaaccatcagatcttgagagacttattcactatcacaagaacagcgcaggaaagaactgcctccatggttcaattacctcccactggcttcctcccacatgtgagaattgtgggagctgcaattcaagatgaggttttggtagggacacagccaaaccatatcatttcgctcctggacccacccaaatctcatgtcctcacatttcaaaaccaaccatgccttcccaacagtcccccaaagtcttaacttatttcagcattaactcgaaattccaccttccgaactcttatctgagacaaaacaagtatcttcctcttatgaacctgtataataaaatacaagctagttacttcctagacaaatgcaggcacaagaattgggtaaatacagccattcaaaaatgggagaaattggtcaaaacaaagggtctactggccctatgtaagtatagaatccagtggggcagtcaaatcttaaagctccaaaatcatttcctttgactttgtgtctcacatccaggtcatgctgatgcaagaggtgagctccaacagtcttgggcaggtgtacccctgtgactttgaagaatacagcttccctcctggatgctttcatgggctgctgttaactgtctgcagcttttccaggtgcatgatgcaaggtgtcagtggatctaccattctggagtctgaaggatggtagccttcttctcacagctcaactagggcggtgccccagtagggactctgtgggggagctctgaccccacatttccctcctgcactgccctagcaaaggttctccatgaggaccgccacccatagcaaacttctatctggacatctaggaatttctatacttcctctgaaatctaggcaaaggttcccaaacccaaattattgacttctacacattcgcaggctcaacaccacatggaagctgccaaggcttgaggcttacatcctctgatgacacagcctgagctttatgttgcccctttcagccacagttggagcagctgggatgcagggcaccaagtctctaggctgtacacagcatggggacccttggcccggccctcaaaactacttttattctcctagacctccaggcctgtgatgggaggggttgctgtgaagacctctgacatgccctggaggcattttccccatggtcttggggattaacttttggcttcttgttacttatacaaatttctgcagttggcttgattttctccttggaaaatgggattttcttttctatcacattgtcagactgcaaagttcatgaacttttatgctttgcttgccttataaaactgaaagctttacagcacccaagacacctcttgaatgctttgctgcttagaaatttattcctccagataccccaaatcatctctctcaagttcaaagttccacaactctctagggcaggggcaaaatgccatcagtctttttgctaaaacgtaacaagaatcacctttggtccagttatgaacaagtttctcatctccatccgagaccacctcagccaggatttcattgtccatatcatcagcactttggtcaaagctattcaacaagtctctagagaattccaaaacttcccacattttcctgtctccttctgagtcctccaaactgttctaaactctgcctgttatccagttccaaagtcgcttccacatcttttggtatcttttcaggagtaccccactcctggtaccaatctattgtattagttcattttcacactgctgataaagacatacctgagcctgggcaatttacaaaagaaagaagtttaatagacttaccgtcccaagtggctggggaagcctcacaatcatagcagaaggcaaggaggagcacatcacgtcttacatgcatggcagcaggcaaagagagagcttgtgcaggggaactcctctttttaaaaccatcagatctcataagacttatgtgctatgatgagaacggcacaggaaacacttacccccatgattcaattaccttctaccaggttcctcccacaacatgtgggaattgtgggaactaccgttcaacatgaggtttgggtgaggacagagctaaatcatatcagaagtcataaacttgctattgactttatgtggtccaagcatgacttttctcgtataacatgtaatattatatattattacttatcacatgttattacttacatactaacatgcaatattaaatgttattacacattacatgttatttcttacatagtaataacatgtaatattgctttcaggagcagaatgagctgacattgtaagagtcagctcaacatgtattattttcatttaagtggaaactttcataaaagcatctccaaaaccattgccctgccctggagtctgctcaccagcccccttgtagcactgtacctctgcaaaagggagctgggaagtcccacgatgcaccatttcctgggctgacgatgcaggtcaggatggcgtggccttccaagatgtagccagggaggcagctgtaccggattttgtctcctatgttgaatctcgttccatgcagaactcctttcaggatttctccaggatttccacaagtgtggctaggtaaaactattggaaaaagaaaagaaaggagaaaaaacaagttaaattttccatggagagccacttataagataaaacagacaccatttttgaattattaaaatgagaaaacctctagcatcagaaaaatattaattgttgctaaaaaataaactgagaaaatgtcttcaggttttagaatatctgcagtataacacttttataaacatcataaagtgtaaataaatgcattttgttaagagagaaaaatatagtcctgcttttattcagtgttccagataatgtctggattatatttttctagtcacaaaattctacttactcctatagtgagcaaccagatgtcagtgtcagcaaccagacacagtagactatagaaatctaaaacagtggcataagaaatactgcaagagtgaatactcataccctatttatttttatgcttccacgactggtacagtgtctgttacacatcattacccaacgctcaatcaacatttgatggataagcaattgaattaaataataaattagaaatctcatgcattgatccatcaatgtataaaaaaatgttccactactgtattccaggccagcagccaggctctgtccatttatagtgtctgattcaaaagcaagtttcagtgctaagttttgacaacagaaatactgaattcactttcattttgtaaaaaaataataaaattcaaaggccgtcaaccatctgaatggacacatcctctcagccagggtgattccaaagttaatctgaaaaactaggtcaggccgtggtgggatggggcagtcagacatgcctcattatactctcttccctgttggaattactgatagaacaggctcctcaattccgatacgaaacactgacaatctgtttgcggaagcctgctacctggaggctttgtatgcatgataaaaacattggtctcttcaatactttcttctaacccagacattcctctctattgattccatgtctttagacaataacttaactcttgcaattaatttccaatatgaaaaaaaaaaaaaaaaaaaaaaaaacctggccaggcacggtagctcacgcctgtagtcccagcactttgggaggccgaggcaggaggatcgtgaggtcaagagatcgagaccatcctggctaacacggtgaaaccctgtctctactaaaaatacaaaaaaaattagccgggcgtggtggcgggcacctgtagtcccagctacttgggaggctgaggcaggagaatggcgtgaacccgggaggcggagcttgcggtgagccgagatcgcaccactgcactccagcgtgggtgacagagcgagactccgcctcaaaaaaacaaaacaacaacaataaaaaaacctttgattctacctatgacctggaagctcccacttccagttgtcccgcctttccagaccaaaccaatgtatatctgaagtgtattgattgatgtcttatgtctccctacaatgtgtaaaactaagttgtggctcaatcctcttgggcacttgttctcaggacctcctgagggctgcgtcatgggccactgatgactcgtatttggctcagaataaatctcttcaaatattttacacagtttgactcttttcattgacaatttcaataatggggtattgattctgttctttttggtcctctcactttttccttgatatgattctctatctaaatcaattgacttgaaactccattccacacttatagaacatgattttgaactgaaacggtacatcattcagttgaatggatgaaattcatcattgttggctattgtatccatatctaaggtttaaatttagtatgtcatcagtaaattagctgctatttagtattcaagtaagctatgaaacttactagtagagaaatacaaacacttccaaataaaaatgtatttccaattgaacagaaactatttcatgtctgtatccattgtctttgcatcggcatgggggtgtattttaatgtattgatataatgtagaataatattttctgttttattagtttttaaactgagtaacatagagaacatttttagaatacggaataggaatcatctatttctaaaagtatttttatttatcatgatattacttaagtacaaacagaactatatagaaatatttaggaaataaatactagtgtttagatattgaatattattgacatgtttatgagatctctatttacatagtcaaagtgtattcagttctagtttttaagaagtaatttctgagagcagtctacagaaatctgtttgaaaacacaacagaaaatagttcactattgtctgcaatcatttttgtcttttttaataagaaaattctgtatttaattccacattcactatccttaaagcaaacatgtgtgctgtttatagtacattaaaagtgacatttataaggaagaaaaactttccattttatcagggcagcccttcaacttttgactcagaatgccttgtccatcagctgagccgagagctcttacagtcaaagacacacgttgtatagccaccgtaaatgtgaagagtgagaaagggagtgattaaaaaaagtaaacatgtggacaaaagctttttgatgtttttctttaatgtccaggaatatttaaaataaatcaacatgtcttcttagggtcattattattaactgctactgctaattcttcttagaaggcacacattttccaacagaaggtgtccagataattgttccccaaagacacggttatcaatggaaatctatcaaataaatctgctaaagataaccacaatgaccagtcattgtcacacacggaaaatgcaaatgaaacactctggaaatggaacttagtctgcgcgactcttctatacgttttttctgttaaaagggcctgaaattatttttttcaattaactttggtatgaataatgcaaatgattatcgtgcagaaagatcaacgaaacattctacagtaatatatagttgtgagctgcctaacaacagctcaatgatacgactcatatacaacatcggtcccaggagatgatggcgtactgatgttgtagccgtcatgaggtcgtagtgccagctatgatgcacgtgtctgtggtgacgccggtgtgaacaaaccacctgtgcagccagtcatacaaatcttcagcacatacaattaggttcactgcatatgcttgatgataatagtgaacaactgtcactggtttttctacttactatactatactttttatcattatttcagagtgtgcttcttctactaaaaaaaaattacgattttactgtaaaacaaccttagtcaggtccttcaggaaggattccaaaaggaggcattattatcctaggagatgaaagctccatacctgtccttgccccgaagaccttctggtgggacaagacgtcaaggtggaagagatgaccccgtgcaggcctaggctagggtgtgtgtttgagtcttaatttttaatgaatacagtttaaaaagtaagaacatataaagaaattttaaatagacaaactcttatgaataacaatataaatgttttgcacaactgtgcaaggtttatgttttcagttaaatattattacggaagagtcaaatgcttaaaaatgaaaaagaagtttatgaagtaacgttatactaagcttaatttatgattaaaaaagaaaaatgtgtttttatacatttagtgtactctaagtgtacagtgtttatgaagtctacagtcgtacatagtcccgtccgaagccttcacagtcacccctcactcacacacagactcacccagagcaacttccagccccacaaactctattcacggtaagtgtcctatgagagtgtaacacttttttttatttttaatgctgttttattactgtaccttttctatgtttagagacacatatactgaccattatgttatagttgcctacagtattcagttcagccacatgctgtacaggtttgcactctaggagtactaggctacaccacacatcctaggtgcgtagtaggccgcaaaacttgggtttgtgtaagtgtgctctgtgatgtttgcacagggacaaaatcacctaaggatgcatttctcagaatgcatcccagttgttaagtcatgcatgactgcatgtaacatatctcaagatgctgttgttatggtcaagcctcccactttatcatctacagtatatttagtaaatttaaagagggacccctccaaaattgttaccatggtactgcgcaatggtattttccagcagtgtagaaatgtattgacttacatatttctgaaggaaaaatatcattaatgaatatgagtctccccaagaaggtgtctgaaaagaaatatttgtaaacacccatctcttcaaacttccaagagacagctactaccataaaattgaatatgaaaaatatttattctgttcaatttcatcaatttaggaaaggtatttttaatagggaaaaattaaggcagatgttagaagcagcggatgtcaaagaaaaaactagacatcaatggagagcatgcctgttcttttcatgaaattgcatttctcattgtatctgacgtaaaggatccttttgcagatgcagttgcaggcttttattttacaccaggtcctcaaatagcactgttggcagcaccactatttcattataacatggatgagaaaaataaatagattcctgaccagggccaccacctgttcttaccatctctgcatgaggtatgtccagtttcctccatatcccaaagatgaccatgtttgcatgttaggctcattggcatgtgccctggatcctagtatgggtgagtgtggggtgtgtgtgtgtgtgtgtgtgtgtgtgtgtgtgtgtgtgtgatcctgccatggtagtgtgtcctgtccagggctggtgaccacctggcacccggagctgctgagacagctctggccacccacaacccaaaactggaataattggataaattattttacttgtttttattaatctttcttaagtgaatgtagagctcacatgtgtgtcagtgttcaatattagaagtgttttgatctttaatatttagaattttgtagatgttttctatgacaagtaatatgacataggaactttacttttgtttatatcaattaacctgtgggaaaattggtcttgtcttacattgttttgcttagagccacattttcccagaacctaccaagcacttgaagtgagcacttgctgtaacagcaatggccatcagctccacgcaacagcccagtggcattatagagaataaagaggatgtctatttctggggcatcttagaccatttcaatggtttgcttttttgtcttctctacagatttttttctttaccttaacatcttgacacttaattttagaagaatttgaaaaacacaaatcagacatagcctttgcaaggtgccgtttttcaactgacagggattgcaatggaaaggagaatggactttaggtctcttatatttatcaggtgtgcttatctactgaaaatgttttcccatcagtattgattttaaaggggaaggtgtgaagattgaatgagataacaggtctccaaatatctgttctttatgactctatcagattttactgcaaacagccgttaatagttctgagggccttgaaccattccaggttggaattgaatctttttatgtttgtatataaatattaatatattataaagtagatcatatattctcgtatacatacgtacaataactgaaattcacgtagctcataagcttagtgggaataggaaaaaaagtttttcaaaattcagttggacaaaatgttattttagaaacaatgaatcaaaaaataatgtataattttagtcactttattcccacacttggtaaaaagtgtaaataagtatcagaggcttaaaattaattcaaaaagtttggaagtaaaataactcagcaaatgggaaaaaatgattagatctaccatttaaggtttaaagtcactgattggtgacacaaagttataaatttatgatttagggattggggatttttatcttcaacaaattttctttttaaaaagtttttgtaaaaattttaatgggaacaatgtgaataaatagaaataattaagaataaattagaatattttcttctagtttcaaacaccaaaaaacgcaaaacagacatagtattataaatccattagcaattttactaaaaaatcaaaaaaacttgtaaattgtaaaatattgatggaattgttgctaggtctatgcaaagattcaagacacacacagacacaaatattaccaaaatatggtaatttagtgttcgagaaaaactaatttgaaagcaaattatttcaacccaatgtcatttctgccaatttcattttaactgaattttaaccagtttgcctgaagattatgcatgtctctttgtgactcccagaagtaatgaatacacatgaagaatttagtaaatacctactgagttgacataaactctacttttaattctctttatttatttcctgagccatttacactccttcccatagatgcttcaagaaagcaatacttatttaggtgatgggaattctgcgcccaatgcagacatttggtaacgtgaaaggatttcttgaaagagctctgggcacagttgttttctctcatggcaggtttccactggaccccatgaagccaaatttgtacatcagggcttgaaacttgaaacataggctgccattctaaatatgcacacgaaaattccctccgtaacacttaatttggcaagtacatatggtcacaattcagtgacttaattgggctatcacatcaaacctttaacccagctgtttcaatggttaagtggatgtcatattaagtatctttccaaaagaaaagtgaaagcatgatactacaatacaatattaatattcattactacatgggacaaggctatcgaaaggaagtttaaaattcatcaaagcaacggcagcattttcaacagcatgtgtacaatcagtggaatttcatgaggtggattcatctggaatctaggtcccttagggtttctctccatttctctacactttgcctctgtagtagtctcctggtagcttaagaaaatataactccaaattccttcatgatgtgtactttctatgtaaaccaacgatatcaaatgtgtttgttttggactatttgctgctgaaagctcttcaccccactctctctcctggctttgggaaggattagaaaaatctggttatataattttcaggatcacattaaaaaatcggatttcctagtcttgaaaccttacatttcttctctttactggctctctgaatgcgagccaatctgtaaaaggagaaggtgctgacaaagcatttatgacaaaagcaatgaggacctcccaggaggtggcagtcattgaatgccttctactttcaaaaagtctcattctccaggatgaggaatgacagtgaaagagaaggacctcatgggacgtaatcagaactggctgagaataactcaatgaggaagtgagctgtaaatatacttgaaggtggaaaagggcaagatttggccaaataagaaagataaattgatgtgggggaagtcgttgtggcaagcatttatagaaaagtatatggcacagggagttacagtcatcagatctggcatcaaatagatttgggtttctgctccagaaagtgattttgtaatgttggacaaattacttagatcttagtttctacatcttagaaaggggaatgaaaagtaaagcttactcttgggtttattatagagaattgtaaaaagatatcacaaatcagggcactcggtacaggttaagtgccccatacatgtcaggactgttaaaattattttcccaattctaaagcaccatgcaaatgttagggaaataatacaattttcaaagtatacagagattttaacatatcgcaatttcagaaacaatatttttaaagggtatgagagtcaaggctattaatgaaatgctagcatagttgtaatggaagtgaaggagaaggacatcgtagtttttcatttagcaatagtaattccacttcattatttctgccttatcataataaccggaaatacttgcacaacacacactatgtgctagacactgttccaagtcgtttatatatattgagtatgtatcagtaagtactattattatgcccattttaaacaaacaaacacacaaacaaaaacatgctgcagggagatcaagtaatttccaggacaggtaactgttaagaactggtagtagagcttgcatatgatgatggattcagaatctctacttgcaagcatgacaaaaactctttcatatgaaaatgtggctaacatcagaagaggtgatgataaagtgtgattagatctacggtgttcacaatggaggttagttataataacatgcatatatggattggggagacttacgatgttttcttaggtagaatggagggcacaaccataacatagttttaaaaaacatgtttcaagctctcgaggcaaattcatataatagcaaaaacactgcaggagagactgcagcaaagtcaaaaacaaggtaagcgaccagttggcaaatggatttgaaacctagagactagattttcaaaagatttttaatagcacgtgaaagactttagcagctccggacaatcgaaaaaataaaaatgctgttgcaagataatgttcactatgtaaatggctcttgagaagcatcatgaatatttgctagtgtgaattattaaataatcttatggtcttacattttgacttcactagtgaatcctcacgtggtcctatattttcttttctttctttttttttttcctttttttttttttttttgagacggagtctcgctctgtcgcccaggctggagtgcagtggcgcgatctcggctcactgcaagctccgcctcccgggttcccgccattctcctgcctcagcctcccgagtagctgggactacaggcgcccgccaccacgcccggctaatttttttgtatttttggtagagacggggtttcaccgtgttagccaggatggtcacgatctcctgacctcgtgatccgcccgcctcggcctcccaaagtacggggattacatgcgtgagccaccgcgcctggccgggcctttgccattttaaacactagaagaattaatccatatataaattttcgcaaaactatgacaagaattgttaaatgcaaatcaagcttactactacgaaaaaagcaacttctttcgtgcctcaacctacatccagccttaaaaagtagtgtaaggatcaaactgttccacaaatagtcaaccaaaccccagtgaaagaatgttcaagaatatttatgggaatacaaaaatattcagcacctgtcaaagtgagattcacagtctctggcatccaatcaaaaagtaataagcacgcaaaaaagtaagaagatatccataagaagaagaaaactcaatcaatgaaaagtgagccagaaataaaacagaattttcaatcagtgaacaccaacattaaaactgttattagaactgtatgccctgttctcagtcaggtgatgatggaacatgttgtcttgagacatgggaaatattaaaaaacaaacaaacatacccacaaaaaaacaaaacaaacccagattgaacatctagagttaaaaccatctgagattcaaaaatcaatggatgttataaggtagaatagatatagcagaaggtaacattaatgaacatgtagagatagcaagataaagtatttaaaatgaaacataaaagaaaaaagaaagatttccaagcaaaaacaaagcaaaactaagagcacagagaatcaatgaactttgggacatctccaagcagacacaagtatgtaattaaactcactgaaggcagggaacacaaagagggacagaaaaaaagaagaaaaggaaacaaattacctaaaaacttcaaaatttactaaaacagtgaactcataaatacaaaaagttcagtaagtgtaaaatgcaaagaacatgaagagcaccatatcacacatgtcaaaatcaaggtgcctaaatacagcaatgaagaaaaaatctttaaagcatccctactagtgggggtaggagtaatgttctgtgtagagagacaaagataaaggggccaggtgatgcctcttcagaaagaatgaaaccaaggagagattcagcaacttataggaagtactgaaataacgaataagcaaaacaaccatcaatctaaataaatttatatgacaaaaatattttgcaatatcacagggtagagaaacaagttcagacatgtgaaaactgaaagcccgtcactagcaggcccataccacaaggaatattaaaatgagtcattccagcggaaggtaatagcatagtaaggaattccaagcaccaggaatgatacccgtatggggaattataaaatatattttattttaaaaatctgtttaaaacactattagctgtttaaagccaaataatatatattttaggtttctaacatatgtagaagtgacagaaatgacagcaataccacagaggctgggtaagaagaaaggagagcacattgctgtatcttcgctatacaataggtgaagtggtacaacatattaaaaaaaaaaaaaaaaaaaaaaaaaaagcaggctgggcacggtggctcatgcctataatcccagtactttgggaggctgaggtgggaagattatgagttcaggagttcaagaccagtctggccaagagagcaaaaacccacctctactaaatatgggaaaaaaaaaattagctgggtgtggtgacttgcacctgtagtcccagctacttgggaggttgaagcaggagaatcacttgaaccttggaggcacagggtgcagtgagcggaaattgcaccactgcacttccagcctgggtgagacagtgagactctgtctacaaaacaaaacaaaacaataaaaaaagcagcagtataacatcacagtagattatggtagactgctataaagtctaaagtcaccactaaaatagcaaagacaaatgttacagctattaggctagcataggagataaaacgaatcacagaaagtacccaatccaacaaaaggaaaacataaaaagaagaggaaaaaagaaaatgaatgagaaatacaaagcaaactgcaaggtggtaaaattaaatacagccacaccaataaacataggaagcgtaaatgacatgaacctcacacctgcaaggtgcacatcatgataatggatgaaaaatacacccagtgttatgttgtcttcaaaaaaaagtattttaaatacaaacagacaaatagataacagtaaaataatgagaaaagacaaatagctttatgtgtgctgctgtctggccgccttgagggggaaatcaatgtagaatagccaaactggaatttcaaaagacgaaatgcattttttaattctaggagtggtggttcctgggtgaaaccatacatttatttcagtgttctgaattacacattcaattaccttaaaataagatttattactaatagatactattgatatcttgctgagctctttcaaatgctggaacgctttatatatggtatttcaaaccttacacgtctccaaatgaggcatcattattccaatttcacatacaaaaatgatgagacacagagaggctaaggaactcagttaagataacacagataaacctgaatctgtatagacctatgatatttccaccacaccatattgtcccaattgtgttgatataattgaaatgcttttaaatgcaactgtaatgtcagaaagaaataattttggcaaagcttaattaaaaaaaaacgctgaataattaggagactggggttcctgtcttttcttgcccattgcttgtctctgtgatattatttgatatgatattttctggctcacatgttctcatcttaacagtaagaaagaagatgagagttggggtggactcattcattctaaaagttgagggatctgcacaataactgctgtttcaaatacaaataacttattttctcatacttccttattgcaaattaaaaaatataaaaatggcaaaggaaaaacagagaaatcatctctgaaaattgatgcaacacttaaaaataacacaatgcaattctgtttagtatttactgataagaaccttgtcttaataagctaaaggcaatctcagtctactttgtgtcattccaagctctaaaattctttaccataaaagctgcttaactcgatttaactggagggtcacatctcaggggaccagcgacccctccagagggaggaaggacagtcaggaggagcaggacacttcattccatctgtgattctaccacggcagagctcggtcaccggaaggataattaaatccgggtctcattttcttctctcgtgcaataagaagagacatagcgcaccctgtacgtgtaccaccctgggcgtgtaccaccctggccacctacaatcctggctgcgtacaaccctggatgcatagcaccctggacacgtaccaccctgggcatgtaccaccctggccacatagcaccctagccgtgtagcaccctgagggtgtaccaccctggatgtgaaccatcctcgatgagtagcaccccaggcttgtaccatgctggggactgcaccatcctgaactttgcagccctcaggcccagactgacttctcccacaaaaagttaaatttaaaaaaatgtccccatggcatctgagagtaattatattcaacatcttgttcacggaggagtttctacttcctgttttataattacaatgttatgcctgaatcttccagttttacaaagctgatttacaggaaagccttgtgcctgaggtatggtgtggaggccacagacggggcacagggagacactgaacatggcagtcaccacctgtgccctcccacctgcagcggccacgcagtcgtgggctggggtaccgggtgctgaggtactcatctctgaggaacccacaatgtgggcgacagttgtcccattaatgagcttaggagcagaagtgagacaaagcctctcatttctccccacatatactacaggaattctgtccttatagggttaggcaggtaaaaggaccatcaattgtgtatgatatgagcagacgaacggtttcaaggacactgtcatttaaaacagtgctacattaccgatcatcaatgacaagtggccacagcagtagaaatgactgctgagaacgtcggaagggccactggtgctggggtcagaacactgtccccagttgggggaagaccagatccagggacatcatggggccctgtgggcagcagatgctgttacagctcagaaagaggatgtgcaatgctttagaatgaaagaaactcaagaatgttcctgctattagctgcaacatagaaaaggggaaattagcttgacaagatggattgtagtagaaataattttaagtagagaacctaagagtcaaagcagtaaccataagattcaaagactaaaataaaacgtgtgaacaccagtgaactgtgaaacacaaagactaaattacacactttaaagctatttccagacattgtgagacatggcttctcagcatcttcatcatcccctttttctttcagactctggcactgcattattttttttttaattagagtttttatgtctatgctggtgaacacacacaggtattacatattttctggaaaaatacatctaagtcattcaaatcaaagtatattagattcctgtgaagtggatataattcaaaataatggttctacaattgtattcaaatataaaatttaggactcatgcagattagattttaaaatcagttctcccaatttatatacacacattatataacatataataatgtattctatagctcatatatatctgatatatatgtattatgtatcataaatttatatacacacacaatttatatgtgtatgtgtgcgtgtgtgtgtagaaaataataaaagcattttaacaatataaaggtcatgtggcattatcttttatttctaattattgaattcttggctgtttctcagtctaacttcagttatttctcttctttgtcctggaagttagcttctaaaaatagactcaatgttatcattataaacactttaatttacttggcattagtatattacaaatccatgattttcatattcattcaaacctaaatgtgctttctgttactgaattcacataaacagctcaagcttcatgaaaagagtctttcggaaaggataaagcatgttttgtggttgctgttgccttacacgtcatgtattcaactctgtacatagtataactgtgggcttccaggtatttttctttaatttctgaagacctactgttgattgttgagtcttgataattccatcataacaaacaacaagtgtgcagataggatatacactgggaatgtttatttccatttgattttaaaaggatgtagatattatttaaatgacctaatgatttaaactttttttctgtttcccccataacacacacacatattgtaattaatgcacagcctggggagcaagtgaactaacaattattgaactctaagcgccaggcacttcatgtattatttccctgaattcttccaggagccccacagagaatgtgacaatgaggccatctaaaaatgggcagagagaggcttatggccaagagggaacttgagtcctaactccacctttgtctcagatctcatgctcttttctttccagaaccctccctgatgcatgacttagccctatagggttgtgacatagagggaacacctggagtccaaatgaatacagaattaaatgtggtctttaaaaatggtctctatggcattgaagctgtggcttcaatggaagctgtggaagaagcagagcagcctgcaacggttccgtgagcctgacctatctgacctgtgctgggccagatgctctgtagtaactcatgtgtatttcagtctgactctagtgttcatcaaagtcatctaagtggtaggcacatgtattctggagtgggaggaagggaggaaggagagagacataaagtggaatattctgaaaacaaaatgatcttctacccaaagcccttgggaacggtcctgctcatggaataggaacaatcttggaaactcaggaaatattgcggaaaaaataaattgaaattaaaatggcatttttcccagggaattcttaagaatcattatagctaactcagattagtggtagcgtaaatgcagggaaggcaacattgtgatatgtcattcattcattcattcattcattccacaaatatttatagaatgcaaattatgttgaatatttactgaatgcgtattatgtgtggaatatttttccaggcactaggaatgcaatatcgccctcagtgagtatatttggggcatgcagagagaagaaacaccattaaaaaaataaaatttgtaatagctcagtggattttaaatgctatggagaaaaataaatcaagagaaaatggtatttttttgataggaataggtagagaatgcaattttacattaggtagtcaggaaacacctcaataagaaagtggcattgaaaaaaaatatgaagtagaggatcagatctaataataatatttacatcactgagcctttagtttgattttatgtagtattataaaaattaggattgttttcccaaaaatataatgtcatgttgagtccttaggccttgtttcttttcatcctgagagctttaagtctttgtatgagagatcaaaccgttttgcccactaaaatgacatgtagaattcattcttttccaaatattttgtgcattcctaattgataagtatctcagggtagaccccgactgatttctaaacatacttgcctaaggtgaaaagaatgaatgtacgcagtcagactttgttttggttgttggtgctgtatggatgttttcatattgaataacataccgttctttgttattagtcactgagattagaatgaaaagtgatacctacacatttttacactaattatgagcataagattgagctggttacacaaagaggggagtctttcatttattcaataacttattttaaccatattcttaataacaacagctaacacagacaatgcttcctagacaaaccactgtgtacatatttcaatttatgaacatgaactctcctattttcccaacaagattctgcagtagctactattatccccattttaaagatgaacaaactgaggcagaaaagttaaggaacatccctcaggtttataaaccaagtaaaagggagagccaggatttgacctgaggtggtgtggctccagagtttgtatacaaacagcacacaccaaacaggtaattcttaaataatttttgggtgtcaatctgacttccaaccacagaggaaagtgtgattggatcaatgtgcttcctgacacatttgggtgcatttattaatacatacatgtatatctatagaactatataaaatgcaaagctgtgtatatctgtgttacatgaatgttattatacagtatatgtagtcacaagctttattcactcaatagtacaccttagaagcctgtgttcaatacagatagatcaagctcatttttacagctgctacatacaaaaatagtctatttgctaatttttccaatttcaaatgctgcaaatatttctactataaatctatcgtataaatgtgtgtgaatttctctaaggttgatacaaagaggtgatgttaatgatcaccttttcaagactcaccacccatctcaacaactctcaaaacagtcctttcatggttaggaattgcctccatttttttctatcctgctctctccacattcttttatttttacagctattctttcttattcttctgttgaactttaattgtaacatcaaagagtctatcttaggtgttgcgtctttctctatctattctgataccatatgtagacttctcaaccttgacatcactggcattttgtatgaaataattatttgctgtggagattgtctggctgtaggacattttgcaacatctctggcctctatctactagatgccatagcactccaagctcctagagttctaacaatcaaaaatctctgcagacattgccaaacgtcatctgcggagaaaaattacccccagctcaaaaaactactgcctacgagatgtcacccagtccctggcattcaaataccatgcatatttgaatcccctttttgaataagattggaatctacactttggtctctagggccaacctcttacctgacttctagatttttatacccaactactacctgctctgtcttttttatttagggtttaatatttcattgctctgtaagttgcataaaataacattatatttactaatcgacaagcataggtatagatatttttatgaattcttaataaattttcaaatttagactactttaaaaatttgttttaaagtttaaaaatagtagagaatctccataaatggccacagcccgttttccttactgttagcatcttagctttgtatggacatttcttacaatcagtgaccaatattggcatattcttcttcactaaagtcttattgaattatcttagcttttaagtaacgttcgctttctgtttcaggaatccattcggataccacactgcgtttacgtgccgttcctctttaggtgtctcctggctggggcagcttctcggacctcccttgttttaagggccttgatggttttcagaagttgcggccagatattctgtggaatgtccctcctgtggaacttgtctggtgttttctcacagtgcaccaggttgtgggttgttgggaagatcacagaggtaaagaacacttctcgtcgcagcatgccagggacacgcatcatcagtgggacttccactctggatgttgacttgatcacttggctagggtcgtgtttgtcagtttctccactataaacttctgtatttttacttccttgcagcctatactctttggaagggaggaactatgagcagcagaacttaaggaatacgaaaggaggctagttatacacagagcacccactaaagtaattaatcaagagcagagaatctacaaacttttttaatttttaatttttaaaattttatttaatttttgttttttgcatatatacatacttatggggtacatattttgatacaggcatacgatgaattttaattgcatcagggtaaatgggggtatgtatcatcctggaggggtaaatctttaagcatttattcttcatgttacaaacaatctaatcatactactttatttcaaaatatacaattaaattattgcttacaagagtcatcctgcggtgctatcaaatactagatcttattcgttctctttttttggacccattacacatccccacttccatccaagccccaacctcaaaaactatttagtgagtaaatgaattaagtcactaaactataaatgccctaattgaccaagtgtataaaattcagagtccctgaaacggtgaatttaccatctttatctcaagtgccaatttttaaaattttagagaagattctggatctgaaagggcacttctaatactcccagattaaaaataagcctacctttacgtgagtcttgaagtgacctatattcccatccatgataaggtctcacttggttggagaaaggctgcagatggaggaggagtgacatgccctacttttaaggaggaaggagccagaaaacccaccccaacatgatgcctgaaatcctctctggctttgttttgaagcgcactgccctgagttacagcatctttattgaaagggagaaccaggaaaaagaaaagaaaagaaaagaaaaaagaccaggagtagaaagcagaaatggcagcacaatccctgctgagaatctctgctgagagcacagcctcccagggaccaggcctgtgggaacaatgccaagcttcctggatttcttcaacagttttacaaagcctgcacaaaagctcatctaagttttgaagactcaaaaaaaaaaaaaagatatgtacaagtaaagccagactcggcagcttctttcactgttggcatgatcccggagggctgatccaacccagtagcataatgtagttaaatcagaccgcaaggttgaaaacgctttggcagaattcaaagcgccctacacgtataaattgaatgcaccattgttgttattctgtatttccatgacctagcacaaaatgcaacttcgaatcagcagagaaaagcaactccaacaatcaagcaaacctctgtcaacgtcctcagaagtgctaagtgcacagcggggcttgtaggtttctgtggggccctagaaaactatgataaaatggtgagcaggataaattttctgtactgatcaaggccaatttattttccaaaaatcaacagagaaggcaagcagggattaaagaaaggcaaagaaacaccactgctggttttggtagggctcccagtgtcccaggtgtgatggacaccatacaatactgacagttttcttctctttcttctctttcttttctttcttttcttttctctttctttctttccttcctcctttcttccttccttccttccttccttccttccttcctttctttctttttctttctttctttctttcttgacagagtttcactcttgttgcccaggctggagtgcaacagtgttatctcggctcactgcaacctctgtctccctgtcatatacaggttcaagggattatcctgcctcagcctcccaagtagccgggactaaatacccagctaatttctgtatttttaaaaatagagacagggtttcaccatgttggtcagggtggtctcgaactcctgacctgaagtgatccacccaccttggcctccgaaagtgctggggttacaggcatgagccaccgtgcccacccagtactgcaggatttctgagagggtgggagtccagacagggcacagcctgccatttggcaaaagattagagaagaacgctgacatttaatgcgtaattatcatatgcacaaggagtataatgataacactcacgtgtatgctattttcatataatataattggcaaagacctatttctccaagttccatattggagatcccaaatatcttgtagtgaggggtgattttgcccactgcaagatggataatctttacccagggtcagagtgcagtgggagatcagcatctccaaatttagtttgctagaacgtcaatgcaccaaatttgaggaagcaagctgagaaaatcacgaaattcttgcctttccctccatataatttaagtatttagaccagtatttcaacctaggcatctcctttggaaaagaattctgatagaaggaatcatcccataataagtaaggtgtatatatttgctattaatgttataaatatttagctcatcaccacatgataaaagaacaagttttaaaaaaaaatgggatatctgaggacacatcctggaacccacttccagatactctaactgtgcagatttggggcagggcctaggtaaacccctctccatctctcataccacaatgattccaatgcagtagtccatagaccacaatgccagacgtactgaactaggcgcagagagaagtggctaatgagggtctgagaggtataaatggacccagaacctgagggcccccttactctcagctaaagaagtggccttatactttagcaaagggtaacaattggtacctctaaccagaggagtccttgggaggctgtgtgctgaaaggatgattggaataagaaggggctgatacgaggaccccttgcccaggaagcttctccatgggtgcagtgtacagttagtgaaatctgaactacaggtgcaaatttgaagcctgaaaatataacacgttattaaaaagtcactaacaacagcaccgtgtgtttagaacttagactaccaagatttattcaaagaaaagtattttatcactgacagtgcttagcattgcgaatgcatgagaataataaaaatcagactgacctttagttagttttactattattctaaattctctacagacagtgtgtgcgctgactgcctctaccttggtgtgaatagctcccaccacctgctttttatcatggtctcggtggggaaccctactgaagttcaaggttttggccaacgcaatatattcttaaaacaccatcgcaatcaaaatatgaaacacttttgttatctcaagtggttttctctgaccttgcaagctggtcctcaatttccactcctgctcttagcaacctctgatctcctttctattactacagatttcatttgtcttgcatagagtgtcatatacatagaaacataccccaaaaatagcaggttaaaatcaaacagctcatcatggcagtaggaggaaaatgctccagaactggcttcttgaatttcctctggatatgatggcatttgggggcttagattagagaataaaccagtatgtttaaatgcctaaagctttacaaaaatgttcagtagcttttactagtaggttggtttatatattgactatacatgaaattagttgctataattatcataaataataattaagggaaaataaaaatgtatttacttaacacatatctgtgcattctttattaccgtgcattcaaaagtatataaggaagttaagaacctgagatgtaattgttttccccaacatggccacagctttgcttaggaagttcactgagagccaaatgctactcctatctctctctgtcgcagttcactacaccagctgctaatggtctctaagcagccattctccacttttttctatgtaagtacagaactcctcattaccaccatcaagatttcacagaacgcacggccatgagaagaaatgatttggcgccacctctcttgtagctgaacatggacaaatgacgactttgagagttaagaggtgacggggaagtgaagatgtggcttccacttcacattctctcctctcctctggggagctggggtaggaatgtgtggtttgatctatctctgttgccttcatcccatataggggatggccgcccgagccatctaccctagctaggcacccatcatacccctaaactcttgtatgggagagaagcaaacttcttcttagcaagaacgactgcattttggaagcttttgtcatgtcggtttcgtctacaccctacctcatccaattatcaaacatgcctgagatgtccctcttgcggagttcaaccctcttggtggtgtagtctaattgtggaggtgtatttagcttatttccccatcggactgtaaaacacataggtaatgaacaggtccttgcacagtgtctcataggacattagctgaatacatgtgaattcctgagggtgcccagaggaaaataaacatttggacattttgtgatgtgtcattctctgggggttgatgatgacatctaccttcaagtggacgaacaacaatggaaacagaagctccttccccatctatctagccacagcagcccactgtttggagagaatgtattgaaatgttctgtgacatacaaaggctacgtctgcctgtgccctgagctctggggtttctcttttaaatcaataaagtacaaagagacatcaaaagttttcacttacactgcttttaacagcatacaaagaatgtcatataaatgtgtgtgaagaaggcgcctatttcacaaacttacatgaatatactatattcaaacaatcagagagaatactcatgagattattagtaacacattttctttgagctttgtgtagtagatgatagaaatatggcctacttcagaaactgtttgaaatatgaatttctcatacgcagtcaagttaaaacttcaattttcttattcaatttttaaaaaccattttgagacaataggattacttgcctcaaatgaattcaggttaaacaatttttgtattattgtttttctctagaaagattccaatgtctccttctctaataaatttttatagattacaaaaatatcctttttataattattgtaaatttcacaaacttactaagtgattaatccaatacatattttaaactcactaaacattccaaaatcagatcagcattttgaagagaaaaatttaataaattatatgaaatacatatgtaaagcatttcatataaataagagtcaaaatcagctcaaatttaataatgtcaagaattttaatgaatatcatataaagaagaagagtcaaaatcagctaagatttaataacgttaagaattttaatgaatataaaatattaatggaaaatattaaaacagaaactgtttaatgtaattataaatgccaccaaagtaacaatatactttgaaaaatcaccatgtattaattacaaataaaaacttgctgtcatccacaacagaatgacttgactagatactgtataaacaaacaagactcttcagcacttcaaatgactaacactgaagcagaagtgttgattttacagttgattttcttttttactatgccagcttatttaaacataccaaaatagcacttacatacaaatgatgagtcattagtatttaagcttttaaacaaaaatatgtaaattacacttaaaatgaaacacaccctacctgagttttcccctactagaaggctctgttatggaaaattgtagtctacacagatttcctcctgggaaaattgaactcaaccctgaatctctgtttggatattggtggcttcctttttttttttttttttttttgagacagagtctcactttgtcacccaagctgcaatacagtggcaccatcttggcttactccaacctctgcctcttgggttcgagcaattctcttgcctcagcctcccgagtagctgggattacaggtgtgtactcccactcctggctaatttttgtattttttagtagagatggagtttcaccatgttggcctggctcgtctcaaactcctgaccttaggtgatccacccgcgtcagcctcccaaagtgctgggattataggcatgagccaccatgcccagccatattggtgaatttcttttttttttcttttttttttgtttgtgccaaactaacattaaaatttatttatgatattaaaatacacaaatagtttccggggctgagagtcctgaaaaatattgggctactaaggaaagcatttaatttcaattttattattattattattatagtttaagttttagggtacatgtgcacaatgtgcaggtaagttacctatgtatacatgtgccatgctggggtcctgcacccattaactcatcatttagcattaggtatatctcctcatgctatccctccccactccccccaccccacaacaggccctggtgtgtgatgtaccccttcctgtgtccatgcgttctcattgttcaattcccacctatgagtgagaacatgcggtgtttcgttttttgtccttgtgatagtttactgagaatgatgatttccaatttcatccatgtccctacaaaggacatgaagtcatcattttttatggctgcatagtattccatagagtatatgtgccacactttcttaatccagtttatcactgttggacatttgggttggttccaagtctttgctattgtgaatactgctgcaataaacatacgtgtgcatgtgtctttatagcagcatgatttatagtcctttgggtatgtacccagtaatgggatgcctgggtcaaatggtatttgtagttctagatccctgaggaatcgccacactgacttccacaagggttgaactagtttacagtcccaccaacagtgtagtgttcctatttctccacatcctctccagcacctgttgtttcctgactttttaatgattgccattctaactggtgtgagatggtatctcattgtggttttgatttgcatttctctgatggccagtgatggtgagcattttttcatgtgctttttggctgcataaatgtcttcttttgagaagtgtctgttcatgtccttcgcctactttttgatggggttatttgtttttttcttgtaaatttgtttgagttcattgtagattctggatgttagccctttgtcagatgagtaggttgtgaaaattttcacccattttgtaggttgcctgttcattctgacggtagtttgttttgctgtgcagaagctctttagtttaattagatcccatttgtcaattttggcttttgttgccattgcttttggtgttatagacatgaagtccttgcccatgcctatgtcctgaatggtaatgcctaggttttcttctagggtttttatagttttaggtgtaacgtttaagtctttaatctatcttgaattgatttctgtacaaggtgtaaggaagggatccagtttcagctttctacatatggctagccagttttcccagcaccatttaataaatagggactcctttccccattgcttgtttttgtcaggtttgtcaaagatcagatagttgtagatatgcagcattatttctgcaggctgtgttctgttccattgatctatatctctgttttggtaccagtaccatgctgttttggttcctgtagccttgtagcatagtttgaagtcaggtagggtgatgcctccagctttgttcttttgccttaggattgacttggcaatgtgggctcttttttggttccatatgaattttaaagtagttttttccaattctgtgaaggaactcattggtagcttgatggggatggcattgaatctataaattaccttgggcagcatggccattttcacgatattgactcttcctacccatgagcatggaatgttcttccatttctttgtatcctcttttatttcattgagcagtggtttgtagttctccttgaagaggtccttcacatcccttgtaagttggattcctaggtattttattctctttgaagcaactgtgaatgggagttcactcacgatttggctctctgtttgcctgttattggtatataagaatgcttgtgatttttgtccattgattttgtatcctcagactttgctgaagatgcttatcagcttaaggagattttcggctgggacaatggggttttccagatacacaatcacgtcatctgcaaacagggacaatttgccttcctcttttcctaactgaataccctttatttccttctcctgcctaattgccctggccagaacttccaacatataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatagtaaagggatcaattcaacaagaagagctaactatcctaaatatatatgcacccaatacaggagcacccagattcataaagcaagtcctgagtgacctacaaagagacttagactcccacacaataataatgggagactttaacacaccactgtcaacattagacagatcaacgagagagaaagttaacaaggatacccaggaattgaactcagctctgcaccaagcgggcctaacagacatctacagaactctccaccccaaatcaacacaacacaaattcttttcagaaccacaccacacctattccaaaattgaccatacagttggaagtaaagctctcctcagcaaatgtaaaagaacagaaattataacaaactgtctctcagaccacagtgcaatcaaactagaactcaggattaagaaactcactcagaaccgcttaactacacagaaactgaacaacctgctgctgaatgactactgggtacataacgaaatgaaggcagaaataaagatgttctttgaaaccaaagagaagaaagacacaacataccagaatctctgggacacattcaaaacactgtgtagagtgaaatttatagcactaaatgtccacaagagaaagtaggaaagatccaaaatggacaccctaacatcacaattaaaagaactagaaaagcaagagcaaacacattcaaaagctagcagaaggcaagaaataactaaaatcagagcagaactgaaggaaatagagatgcaaataacccttcaaaaaattaatgaatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactgccatcagagaatactacaaacacctctacgcaaataaactagaaaatctagaagaaatggataatttcctcgacacctacactctcccaagactaaaccaggaagaagttgaatctctgaatagaccaataacaggagctgcaattgtggcaataatcaatagcttaccaaccaaaaagagtccaggaccagatggattcacagccgaatattaccagaggtacaaggaggaactggtaccattccttctgaaactattccaatcaatagaaaaagagggaatcctccctaactcatttcatgaggccagcatcatcctgataccaaagccgggcagagacacagccaaaaaagagaattttagaccaatatccttgatgaagtttgatgcaaaaatcctcaataaaatactggcaaaccgaatccagcagcacaccaaaaagcctatccaccatgatcaagtgggcttcatccctgggatgcaaggctggttcaacatatacaaatcaataaatgtaatccagcatataaacagaaccaaagacaaaaaccacatgattatttcaatagatgcagaaaaggcctttgacaaaattcaacaacccttcatgctaaaaactctcaataaattaggtattgatgggacgtatctcagaataataagagttatctatgacaaacccacagccgatatcatactgaatgggccaaaactggaagcattccctttgcaaactggcacaagacagggatgccctctctcaccactcctattcaacatagtgttggaagttctggccatattggtgaatttctaatgatgcttgttattatttgagaaggaaggagctgaggttttagaatagaaaaacaaaggggatgtcggagaaggagtgtggcctctgcaatggttaacagtgcgaatgagttccaggggaaggtcattctgggtttcggaactgtcccagccaccttagcgatggggctactggaggaggatctgcaaaggagaagcggcacctggcatgaacatagataaggcctgagaaatgcctgctcctccacatgggaattttaataagatgtgctcaaagcatcacagctattcatgttattctacctatgtgggaccacacaggaccctgagattaaaaaaaggtaggaatggggcaaggactaaaatcagaaatgcattaatcatgtaaggttagatgaccagacaggaagaaaacaaaggcaaaaaataaaactcccactaagcctgtttcccatttgcagtagaagaaaccaacatagaagcttctcattgaaagtgtggaggaaagagataagacaagctgcttgtgagcaagcaaagcaaaaaagagaattaatttcacaatacccattgtgattaatttatgatgtacaaaatgccatctacatttaatttgtttgttgtattatttttgttgatatcttatggagaatataaagatgggctccagcaggctcatctcatccccatccttgccccttacgatggaaaatccctcagctgcagttctaacatgagcccttttaggaacccagccctgctgattagagaggaaagaggagctgttctaagttagacacaggcatggaatattgacttcacagagaggtacatcttatcatacaagaatttctttaacaaggaaccactaaaaattcagagacaaagaaaagtagaagtaaaaattaaaaaatgaaatgaagtaagtgcacaacagattaaatcagcttcctagcactcttccaacctgtgaaacttttatagctccctgaaaatggataagaaaccaaagaggtggcaaaaggagtttaaataaaaactgtaaagtaagtagggaatgtgggagaagctgcagtgaagaaagcctacagaataataaccctcatgctcttgactatggtaaggaagttgtctggttccagacactaggacctgtttaccagacagattctgcaagggaggatggactgtgtggaaagactgtttcgtgatggtgtgaaatatcttttatgatttttcaagtatcttacatttattccttaccaaattaattattctaatgagtgagtcacctctctgcatgttcagtacctaaaaaggagttctccatttgcagttgattatttattttaaatgatgcttcactttagaagaaatatacactgtatagatgtaggtcagtctttccatgacttgacaacttctgagcatactggtaaagtgaataaataaatcaattatgcattactgactaacgaaagattcttcatcagcattatcttagtcaggggatgccaaaccccctgctgccctgtctgagaggtcaaggtgtagtggggaggagagcacgcaggtggtgaaaatgcagagtgccagctgccgtggtggagccaggtgccaggagaatggcaaagcatcacagagaatgcatggagggtcagcagagggtcagtggaggctcatgatatgcactgataccagaaacacgcaagacttgccaagtgacgggagtgaggaaaggcattccaagctacgggccaggttcacacaagtctaatttcctcagagtcatcatgtcataaatgctgcaataaaaccaaagttggcagaatagagcatgtcaactggggacttctaaataatatggtccagggtggagagtggcagaagaattttcatttgacaatggctttttctcaagcaataagagggcaatgagaccaatcggttgtacatacgtattctagaaattttctaagaatctcagatatctgacacaatgtcagaatcaaatgcactacaaataaataaacaataaccattctaagtggggaaatgtattttaaatcacctgtggcattgacatgaacaacatttcgtgaaacatatcctataaaagttttcagtgatacgtcccagatctgatcttaaagctggaaaaacagcacttattagatttcaattcagtagtcacgtgcagaaacacagattccttgtgcaagacccatgatggcaaagccacactgtcattattcctgatcagcattatcaaattcaaaaaaaaaaaaaggcaggttctgcatgctcagtaaaatctgattgttcaaacccagtatctgtcagcatcacggatgtctgactttaggtctttgtgtgtcaaaaccctaccagccaagagaaatgaaagcctgtacgtaatactgaagagtaaactgcagcaatattactgatcattgcaaaaaaaaaaaattcttctatataaaaagctgttaacaacatcatccagataaaggaataaggaaataggtaatccagacacttattaagagatactgttagttacataatttaggaagaaacgttggctaatagggataaatatatgagagagaagaaaaacgttctaatgtttgatagcactgtaagttgactatagctaataatttattgtgtatttcaaaatgcctagaagatttggaaatgataaatgttgacagtaatggatatcataattatcctgatttgatcatgagactttgtgtgcatatttcaaaatatcacatgtatcccataaatatgtacagttattacatagaacaaaaaaaccaaaaaagaaaaattagttacaatgtaaaaaataatttaaagataaaataaaaattatgtttaaagaaaatgtgtatgaaaaatttaaatatcagacaagtaaactatatagattatagtatatatttaaattatgattattaaatgaatacaatgtccttagaacaatgcctggcatataccatgtcttatatgcgtctattaaataaaacaaaacagaactattctgtgtgccacagttttaataccaagaaaaatactccttaagaaccagccattaatttaagcaatattccttggcactgacaaggtgccacgtacgtttccagttcagcggcttccagcagtggacacatcaggtgctgcctccctgaggggcattctaccaggaaggataagcatggaccaggcatgctacctaagtaaggagtccactgccttagaaatgggaagtgccttttattttgaatctaaatttcatatctacttcttcattcagttccacttaaacctgcatctatctgagagcactttgaatgtggtaagaaggaaccaggagtagactatgactttgtcacatcagcattttacacgtagctgaaatatcaaatcgtgcacaatgatgtaggtgataaatcatctttcatccagatttcattaaatcataaaatattaaacaaaaagagagtgtgtgttgggaaaatggggaaatgagtgtacctaaagaagcctcagatgctcaactgacaccagctgagagtgagggctcctgagaagtgcgcagtgtgaagcccatgtgaaatgcgaatctactctcctgcagcaaagggtcctagaaaattgtttctgcctctgatgtaaagttcaaaagtttgactatgaaaagtgcaaactaaagacattaggagctttcaccatggctcagatttgtttctgcatcccagtggtcattcgctgatggaaatacttgacgtcagtcttcccttttttatcgtaccatattttatatcctgcaatgttcctgggctccatatggtgtttcatagtcacctgctctctttcacaaattgtatctctgtttagggttttctgcagttgttttctccctcaatgttgagaaggtagagaataagtaagcttctgcgggctttgcccaagttttaaattttcatatatcaaaactgtagctgtctagagctgcatgtgcctgcaaatgtgaggcagggataacatccaagtgaagccacccatgaggggtgcatcgatgtcaacacacagctcctacttccaccctgtcatacaactgccgtttccgaacgtggcaaggctcccaacacctgtgccttcacatacatggtttctatggcaggtacactctgtattctcccctccaacactgctgctgccctggcgtgttggtcacccccagtatccgtactcaaccttcacaaccgagatctctcagtactgctgtggaaacaatccagtccatttagaaacagccttcctgtactcccggtgatcttgttatttatatctatatcatgtcaataatgtgatgtaagtgtactgtgtttgtaatgtgtgtatctacatgggtttcctcacaaagtggtcaattccattgagaataggacctaggcttaaaaaaaaaaaccttacctctagatttaacgctgtgcattcactaacttttgtgtcagttttcatcaaatccacttaagttgttcatttttaaaaaaaatctgaaatgattaaaatgtgctaaaaattactgattataattttaccgaatataaaaattgtgaagatttaaaaatgtcattttctagtttatgtttttagagttttttaaaaattacattttactgacactatttacacaaaacacttctgatacaaaccattcataacttcttatgaaagaaaatagtcctaaacacataaacaattacagtgcagttaacatttcaagaaccactgactctgttgggcagtgcttccccatccccctcagtagcacactgaacttttacatttaaccagaataaggctggtgttcaccaaagtcatggatagttagtaaaagtttatggtcctacagtcttaaaaatttttcattttgtaaaacttctagagaataattgaatcaatataataggaaatttggcttttcttttactgaatgtacattagctaatacaaaggtcatgacactgattcaaagtgaagttacggtatcaagaaactgtatgtttcttgatagtagctaatcttttttcactgctaaaagatgtattcttgctcaaatgctatgtaaaggagactcatgaatgaagctcatgcaccaaggccaggcaatgccttttagccatgacactaccaacttctggaagatcaaaagtaggaacaccacatgtatctgtgctaggttatgtaaacataggctctatcaccaaacacataaatgctaaatatttggggaactacagcaaataagaattccagaaaataactgtactgcttgaggagttttctttttttggaatatattttaaaacacacacacccaaagttttccttcactgtcttccataagaaagactgctcaaagaagaacaaagtggcccagggaaaaatgagagttagagaaaactgacaaatcattgatgttcgtccaatttgggtgaaaaataaaataggggaaggagacccttctccacgaatatccttggaggaagtcagaaggagccctaagaaaggaatgggaaagcctggaataggtggctcatttacaaaacaatgaaaacagttctgagcttcccctcctgagcctttgttcaagctcttttctctgtttggaagactcacccattatttctaaagattcacattcacctctccttagggactgtttcaactgccagtcatgggcaacgcctccttccttctttgtctcctgttcccactgcacctctgaggtatcccttctttctctgtacgaccttaaccgtttatgtctggctcttaaaggtgttctgctgcctagcccgttctgtcattgtatgtgtgtatttctaagtcccactcagcgcagggatgtttggcatgtcctcttaattttacagaacaccacagagtgccttgcacatgctagctacccgataatattttccaaataaatgatgtaagcattaattaatctattgacttgatagaaaacaatttgtattatttctaaatgtatctacctgaaattttaccattaaagacttgttacatgatgtggtaattgtagttcacgtgattatacccagaagggaaatgtaccacattactaaccactaacagctctttgtggatgtttttgctcatcaaaccaagaacatttctattctatccaacctgaaattagatgatagtatattttgtttgggacgagagtgaagactgagatgcaatccaaaccacaagcaaatacggaaaggggcgagaaacgaatgcaagctctgcctgtgctccaaaagcgaaagcgacaacacccactcacaaacacacacagtagccttgatcactgctgatttaacacagcctcacagaacaaacgtaactataacattatgctttaagtaaagtgacaaatgctatttgtattgtgtaaataccctcagggtggaacctaatgagtatattctaaagcaactccacaactgagaaacaagacaacatgagctcttagttttgtgtatgatgaaaatcaagtgttgccacatggcgaagactgaaattcagacacagagaagggtacaaggctctttttcctcaaatgtgtttccacagagtcacttcatgcaaaaccaaagggaaagcaaggatgaaagatactgggtgaaaggctatcctccgtctttgcatctattttatcatcttttttctacatgaagtcagatgttcaagacagataattatgaaaactaagaatcatagccgagatagaattttttcaaatctccgccatactaaattttcgttaagtaacgttttcaagtaaggtataattcagggaattttaaagtgattcgggagttaaactggattttggtagaaaaacagtatttcctagactaatgaatatttcccagagaatttattattgttatacagtggtatatcagttcttttcacatgaaataaattacttttttttttaatttcaaaatttttaaatgcatttaacttaattttgttgtatagctttacatgtacctaaagccagaataagtttcaacaacagcatttttgtttattaattatcaattcttttattcatccaaaatgaccctacataaactgatttcattcaaaaagaataaaatgcagtctcaccacctaacttgtcctgtggaatattaaactttccatgttagatagtgtaatttgataaaggaacgtgttattctttggacaactaattgtatgaacgttttcctgtaaacagaattactaaaatggggccagatacagtggctcatgtctgtgatcccaacactttgggaggccgaggtgggcggatcatgaggtcaagagatggagaccatcctggccaacatgatgaaaccccaactctactaaaaatgcaaaaattaactgggcatggtggtgcgctcctgtaatcccagctacttgggaggctgagaaaggagaatcacctgaaccctgagtgggggcgaaggttgcagtgagccgagatcatgccactgcactccagcctggcgacagagggagacaacgtctcaaaaaagaaaaaaagaaaaaaagggacacaacagtgagtgtcttcttgcagagccacacagaagggtctatagagagtcatttagggttttcttaggaaaggggtggcagaagggcagaaaaatcttccgtgcagtgttaaaagcagaagaaaatgaggagaacccctcaaaggttgccctcctcggagagttgagaagtctactttgtagctggaggacagtgtattgcgggagagctgtgaggccagcatgagagtggggctcaaagcagagaggggatcttatttgtcagccatgggagtgtgacttttatttcacactggggagagacatgaaaagcacggttacagaaaattaaatgtatatttttagaaagaagtctttcatgacaccataacacatagcatcattacagaaacaaaacaggtttagtttttacgacacaaaatgcagaaacataaaatgtatcctctggaggccactggaccttctcaaatgaggtgtttgtaatgattgcagaaaacatatctagttcatataatgttaccatatcagtggaactgtgagtttaagataaaaaaaatggaaaagataaaactattattctcatttcaagatatctagtggggaaaaaagaaataactatgcctgcgctgtgtatttctgtaccataaaataatgattttctgaacagattagaatattacataataaaactactgacatgaattcatggtatcagtgacattcatgtactgtatcaaaatgcagctccaccatctagttaggcactgcattatgtatgtaaaaatatggttataataaccaaataataattataattttgtggagaaattcttagcaaaatttacaatttaagttttctcctttgttcaaacgttgaatggcttggaaagataacccagtagttgatttttactttgcttatgttttattctttccttctatagactatttactccttcttaaaacaattttattagactttgtcatggactccattttgatttcctgaagggaaatactacaatattgttcataggagactggttgcaaatatatactatgatgggtaggcataaaaccacatactctgattgaggcgtgaatgtaaaattgtcatacagatgagaaaatcaaaaattttggtaaagattactgtgaattctttgtctagtaggaggtcattattttttgaccatttttaaaaactgaaagtcaacaaaattccaactcttatctacaggtagttgaaccactggtgatttttactttatgctttcgtctgttttctgagttttccgagttttccatgagcatctatgatattcaccgtaaaggaaatacagttttgtctttcgcaggatattatctctaggtaagtaaatgtgcagacagcctgacatttgctaatgatcgatgatttgttcttaccaccctccctctccgcctcccattcacaggcatccatgcagatgtatcttgggccagtggccacagcgtaataccatctggcctgtattcccctcaagcctctgcagcttcctgggccatggctcctgtttctccgactggattgcattctcatgttatacttccctttctttctcccactaaactctaggcaccttgagtttaggaatgctgtctacttcacctttatcttccaaactcctgttttggtgttaaacacgtaattactcgacaactcactactgaaagaatatcgaaatgaagacttctacaaaagtcttctatccggtactgcaacagtaaggtgttttgttttgttttgttttgtttttgttttttaccactttgtataaaattgcagtattattttttctgtttgtcttctctacttttgtttttctgttctttcctgccttcctttagaatgttcaatgttcttaagaattttttttaattaacttattggtgttttaactatacttttcgcagtgttttagtgtttgctcttggaattaaagaaacacccaagatttttcagtcttcttgtaaatattacaccaattttattttttttaaaatgtataaagaatgcaattttagaggtgcatttaccaaacctctttttttctgtgtttcttgtcttttctttttggtatgcttatcatatatattacaaacatgcaattcaaactctaaaacataatgttgttatttttacttaaaaagtctcatgcactttaaagaaactcagagaaaatgtcttcttatattaaccaaaatatttaccacctataatgttttgagacagagtctcgctgtgtcgcccaggctggagtgcagtggtgggatctcggctcactgcaagctccgcctcccgggttcacaccattctcccacctcagcctcccgagtagctgggactacaggcgcccgccaccacggccggctatttttttgtatttttagtagagacggggtttcaccgtgttagccaggatggtctcgttctcctgacctcgtgatccacccacctcggcctcccaaagtgctgggattacaggcgtgagccaccgtgcccggccaccacctataacactctctattcgtcactgaagatccaagttttcaccacaggttgtttccatgaagcccgagcaaccatctcagcatttcctccaccacgagcctgtcactgacaccctctcataagctgtcatagcttcctctgattttctgactcaccctcattcttgaaggttgttttcacgtgatataaatgtctaggttgacagttcctttttgctttgtttactttctttttgcttttagcactttaatgatgttgttttctatggatggcctccatggtgtttgatgtaaaatcagcaataatttaaattgttgtttcctgtatgtaatgcgtccattttctgtggctgctttcaagctttttctctgtctcttttgaagcagtttggctgtggtgtacatggttatggtttctttgcagttatctttcagtttacagagactcttgagtctttttttttcttttttttccaaatttggagaatgtcatccattagtacattaaagatagtttctcccttattctccctctctttctccttccggagtttcagctaaacgtctgttaggcctgatattgtcccaaagaagcctgacgccctgcttgttatattttttcagtcttattttctctatattctactgattagataatttccattggactaacatcatcaagctccctaactcttatgtcattttgtatctgttaagcctttccaagtaaacctactttaaaaaaaattgtagtttagatatttaattattcatttgattttcattttataacgcctatttttttcctgatatttctaactttttttcaccaagagcattgcttcctttacttatttaagcataattgtaataacagctgcattaaaatccttctccgctaattccaacatctgtgtcctatcaagcttggtctcagttttgggggccttttagtttttaattctttattttaaactagctgaaatatgtggagtgattagttgttgtttctggaattgtgaatttggtttatttttggagattttagactctgttatgctcctccaaaaagttgatgaatatatttatttcgtctttggggttttattttttattccttggcaggaaattaagttagttgcattcaaatgaaaacttcctgttgtgggggggtggtgtgcacatccactctcatggaactcctctgtcctcagctaccccatttggaatctgctccacttaggcatagctcaagagtcaaagtctgggcagaacctgcagccacagtgtggggctctccagtctagagctctcctttctgggattcctccctcattttctggtggatgtggttttgctggttcagaaagaaagtggatgttaggatagagttttggttttgccaccagcactgacatgcttgacctgaaaatcaaaaaatggatgattcgctataggctgttcaactccttcggaatctgcctgtttcttttcaactttctagtgctactagtttccaggtgtttttctgttttacgtatttatttttatatttcatccacagttgcaagtgaagaagggttgaatcccataggagtttatttggccatcctgaattgcacttttacaaaaaaataccttcctttgccttcaaaatgtatttacttctacttgacacaaacgtacaaatactagttttcaataatagctacctgcctttagtttactgcattctatgtaccaagcattttacaccattatattatttcaattcttatttctctgggagatagactttattatttcgcacttgtagtgaagggaattgtgactataatccatgcaattgctgaaagctctaaacaggaatcacatagttttaagtattgtgcatattttcatatatataagaaatatgaggttctgtggttgtatgtgtttgtgttttctgtgtttatgttttgaaaattaaacatccacatgattaaggaaggcttcccctttatttctgtggatctcctagaatgatttcaactctgtgaattgggaatacagaaatgaacaaagtgtttacaacttttgccttactctctgcaattccttcacatggagcctcacagtcatggaaattgagtatgaagctcataggtttcaaggcagcccaaaagccgtcttttccactacaacaatttagaagcttgaaaataaacccaacctctatgtacagtggaaaaagtcaaatcaacacaaccttggatattaccacttagaacattctttcaaaagtttttaaaattttgctcgtgacatcagattttgccttgaattacacaatatactctatatgtaaggaccaacccaattatcacctataagtgtagcgtagatgatagtcaatattcattctggttttctctttatgatccactatgtcttatttcctgttaccatcatgattctagaaattggcagaacatgaaaacttttgtgatttcacttttagaaaaaatcgagatgaagcacttcaaagaacgctcacaacaataacttgtttttaaaaataaaaagcaataggtgcattaaatgatgagaaggtaaaaataggccaaaattagagttgaaagaagagagtaaagaaatttagctgaagtactacaaaatgaagaattgtgaaagctgacagttcttagtcacataagagcaaggtcgtacttaatgaagctaaaaaaagtaaatttagaagaagctgagggaaattttgggagctatttgttattctgtgcgactgtcttacttagattctattttctcctcattttctggctgtcctcatccaatattctttcagaggacctgggatgtgtcttagtgccagatggcataaaaataaccatgctattaatcctacagtatgagggatatattcacttttcagtattgagataaataaagcaaaatgaattgaattttaatgaatttattctggggaataattctctgaagtatagttatatttagattatttctaagtaactcaccaacatgcaaatattgacttgtatagacaccagctgttttccatttcagcaatttatacacttgaaaatgaacccaaatacaaaattttgctaaattatttacctcattattaattggttgaaaattgctttgttaatagttgggtttaaaacagtttaaattcagtaatatagtcaataactagtctacagctatacaaatatttcaagtagtcttaatctatacagacggtttttgacggttgcttcttttgataaatcactataataaaatctttgtcattggctttgggaagctttaatgacttcaaagaaaaatgcatttattgcttctgcttttagacatttagttttgttataatattgatatggaatagacaaattttgtaatataatttattaagtgagcttaaatgggttttaagttgatcatgctctccacgtaaacatatacatataatgcataacttgtatggtccaaattagttaatgtcactatgctaaattgtacacaaattatacagctttttgtaaccccagagaaagcaaaaacaaattgtttcataaagaaagtcatgaaacggtgtcagctaaacaatgaaagaaaataaaaactatagattaacagtatttggcatctgaatgtaaaatgtagtatttagtccataaatgatagcagtattttcaatgtctatctcatcaagatagaatatatttaagttttttgtacatgattatttactttcagagaagcatttgtccataaacctgtttatagtcaattatgaaaatctaaagtttgatactttacaaaacatgatatttgagaacatgagctaccataaatattcccagtggaagttaaaggatccgacataaattattctaccacaaatcatttcaaactactgtcctacatttgggcagaactcacttttaatgtgaaatatccatccttttataattgacaatggtacgttaaaattttgtataaagatgacattgagattccagaccatttaatttcattgatttaggaaaaagaaacaaacaaaaaaaaaacattgcttgcaaagtagttctctttagttatgactgtggtacataatcatttccatgatgcctttttcttggtagaattttctgagttttttttctctcctccagaatgcacactcctcttaaacttccacgtggcagaagtagtttctctggataaggcaccacactttgaatttatttatatttttgtgtgacagtttgagtctgccttccctaatgggatatgaactctacaaatggggacatgcctgtctttactcactgtaataaccccagtatgaatgatgagtaaataatgctcatacagtgaataatatttcttcagtattattagacaaagaacaaagttgaatacagtaaatatcaaaatgatacgaaaaactaagcaggattaaattttgctaagctgaaaatccttccttgtagcacatttaaaatgtaaataatatttcattctagtatgtgcagcttaaggacttaggataatctaaaaaacaaagtattataaaataaagatgaattgttgatatatgtttatgtaaataaaaacataaataccttcacctaagagaatatagagctctctaagatgaagtgctgaatttttttttgatgctaaagaacagaaaaaactcaaatgttatttttaatatcaaaataaattttatatctgctaatactaatgtaaatgttttctgtccaaatctcttgttacaggtaaaataaagtggcaaatgaatttcgtgggaattgataactaaaaatgtcagatatccccttagagaatatatgtaactggtaaaatattaaacgatgattaatttattccttgttctgcatagcggagttaatctattattgtagtataactcacactgtgttggggaaattgtcttgatttgtgagacgttttggagcactggattcattttatagatataaaattgtcaatgtagaaacggtttgcatgttctcaggttgtgtgtccctttcagaatttttccaccctagccaggtttctcaagaggttgtgatgacagagcagtccttcatggttgtcagagtgaaaaaggaagcaggctattgtcctcagggagccagttcatatctgttctagcccagaaattataattggaatctttcccaatccactggtactttatatatactaagaaaataaatcagtactctttccctctaagttttaaaacatagaattgtttctttctctgggagggtggaggggggatattttaattcctataaatattatggaaagataagtgatatggtttggctgtgtccccacccaaatctcatcttgaattgcagttcccataatccccacgtgtcatgggagggaccctgtaggaggtaactgaatcatgcgtgtggttgctccatggtgttctcacgacagtgagtgagttctcacaagatctaatggttttagaaggggcttttcccccgtttcttggcacttctctctcctgccactatgtgaagaagaatatgtttgcttctccctctgccatgattttaagtttcctgaggcctcccagccttgcagaactgtgtgtcaatcaaacctctttcctttaaaagttaccctgtctgaggtagttctttatagcagcgtaagaatggactaatacaataagcatagactttctctggtttatggaatattttaactgtaatagtgacagcaggtgatgtttttgaattcattactagaaatgtaagtatatatgaacaaatagagccaaaaacgaatacctaaaacacaaatagctaaaagaaaatgaaataatatattaaggattcatgtcctaaacttaaaaacatttgatagttgcctgttacctttattataaggattattctctaacaaggccttatgcatcgtgctccaaacaaaacatttagccatatcttgtctttcactgctactcatctctggctctccaagccctgacccaccctggggaatgacctcacatttcaggctctgaacaacaaccatatcagagtatacaccatcacgcaaggccagccatgcctttgctttaactgctaacttaagataggctactcttttctcattttttccattatctttccagtctgaagaactactgaaattttgaactataacatggatatcagtaaaaaaatcttacacaaggataacactttcctctgaattatatcatcagaatgaagaataaattccagctaatagtaagaaaaattgcaactctaggtaattctgtactatgtggtatctaacccttattctcaatataattggtcataaatgatatatattttaagcccctacttcattttagtgatgagtatgatgaagtcaagaaagttaaatgacgcatccaactgcacccaatgggtaaaaactggtgtagagagaagtctctaaatccagatgagagctctgtgaatttcagctactccatttctctactgacacctcccactgtaaaagcccatttgtcacctatatatatatatatgtgtatatatatatatatatatatatatggtagacatatagattatatataatttatattttttatcagaggtatcttttaatggttcctcagtcttttattataataagctcttaataatttttatatgcaataattaatttgagtatcctatacatatcattactcttaaatgtctagttgaggcttcacctcagtttacttgcattgtttaacttttttaccatcacactgaagtcactctggtcaaaacaacacattccctgtaaaccactgctatgcctatcaaattcctcctgctgtcacttgaactgctggtcattcaaggtcagtagatccacccgggtgacaaaagggaggtatatttgatctttttcatgtatttgtttcctaagacagagtttaattcttgtttcttaccattctcaaatttgctctttattctcttgtcccaatgctattgccctatgataagcatttttcagctcattccaaaagttgttctcactctgttccatgggaattttcagatacataaaccaaattgagcctaaatatgcctccttcctttctctgacttgtaattgatgcccaatatagcaatgtccttcccgaagaccttgccatcatcacaaaatcctttacatacccatactcgccctgcatgtgtgtccccaggctctccgattcctctttcatctctcagttggaaaaaaatagcgctatttcaagaaatgcaatccaccagtagggagtaggaaaaaatatgtttgtaagaaatgcctacatgccaaagagagaaatcttcaaataatttacatggaaagtgctataatgaactttaaaatcagcttacaaatttccaatggcaattcagtttgctattttcaactctttgctgcatttctacatcatttttttcttttaattttcttacacatataaacgtattacgtaattgcactatgcattgataatgcagacctaactgtgccataatgatgagtttgatatccaactttttttttttttttttttgagagggagtcttgctctgtgtcgcaggctggagtgcagtggcgtgatctcgactcactgcaagctccacctcccgggttcacgccattctcctgcctcagcctcttgaatagctgggactacaggtgccaccatgttagccaggatggtctcgatctcctgaccttgtgatctgcccacctcggcctcccaaagtgctgggattacaggggtgagccactgcgcccggctgatatccaactttttaaacataaaatcttcgttatgaaatataattttttttttttttagtttttctgtatttcacatgtatttctaactatccttttgagaaaaaacttgctgtattcttgctaataaatgtttaaaattatttgttctccatagattgctttaaggcaacccttgtatttaaatttcaggcctggcacactggcttacacctgtaatcctagcactttgggaggccaaggcaggtagattacttgaggtcaggagttcaagattatgttggccaacgtagtgaaaacctgtctctactaaaattaataataataataataaatatatatatatatatatatatatatatatatatatatatatatatgtatgttgaaaagctatcttctcttcactttttcccacaatgttgcattaacagtatcatatgtcacccatctgatttgttgtgtccaggtatggacccgaccacaagagtggtcccgaatggaacttatacagctcattaccagggtcggttcaaatagggtggtgtttgagacaatttttattcaactactggatcatataaaagagaaaaagacacagtataaattgaatataagctaatgttttagtctatagagacatgcccactgtttggtgggaaacaactgaatgagtagatatagcccatggagaataaagtataggagtttatcaagtactgtaccatgagcagataaacaaattgtgactaggcaatgtctgcatcccttggaacgaaatatactttccataatttatgtaatctgtaatcaggcattctattcagttttgtcatgtctattttaactctggctaaaaacaggatatagaacaccatcaggcagctccattcttctgagttctatcatcataaagcatgcaaattattattgtgcctattgaaacaatgaagacagctgcacatctgatgccaaaacactgaagatatttattgatgtacttcactttaaagtaaaaacactttattagggaaagcattaaagatttcttcatggagaattagctaaattgatacacagacacattgtttcagcgttcttgtgggttcacattaatttattcctgtagtaaacttgctttctttccatagtatgaatagcccaatggatatttttgtagtgatgaaaaatagtttatgcaattaataacccatgttctcttttcatcaggttagtagcagggagtgacatcacgagagaaaacagtagccagggataatggaatgtttctaatgaccctttgaataccatcttcataggctggggcagaagggccatattcttgcctttccaccccttttctcagtgtcttctcatggagttgtaaaaataatataaaaaataatttaaagattaagaaaattatgttcgaatattggtgtttttttttttttctagatatcaaaagggtggtgagtggcccagctaggaatctacgactcatctgacaacagtctctgtctccatgtttgtgttcctcactcgttccatgtatacacccccataggtacacctgctcagtttgcaatttacaagccatgcatttctatgaatctttacttgggttcattctagctccccagtagtaatagttgtctcctccttaaaacccatcatcactgcctgcttttaaacaatgactcctacttgacaagtgcacaccacggttacagtgtacctaagagtaaggcacgatcttacccgtgagtacttcacaagtgaaaggtgaagcaaaatctacacaaacaggtatcagaattctacatattgaatttccaaaatgtactggtgagtaatcatgccattacatacattatccatgtgttacatatgatcaataaggttttattaagctctctgggttccaaatttcttacttgcaaaagaagatactgatcaagactgtcttgtccaacacataggtttctccagaagataaaactgtattgcatatttatgtatgatgtcatagtttttatattcctttctggagtttagaagctaaattttatcagttttattagcacgacaagacaaaagtaacagaatcactgaaaatgggtatttcttcagtgaagactattctttcatttctgccataggagagaaaaataatgtttcattttaatataaggtgaataagactgggctaaattaccacacccctctctaagtatttgatcagatagctagataaaaattcaataaaggtattgctatggatttcatgtttgtttacttccaaaactcttatttagacttagacccaaggtgatagtattaagaggcagggcctttgtgaggtgattaggctctggggactctaccctcctgaatcaaattaatgcccttatacaagaggcttcacacagtattcatccccttttcgcctttgcctcccttgtgccatggagggacacaaagttcatccccttgggtaattcagtaagaatgcaacactttggaagcagagagattggactgcttccagacaccaaatctgctgaactcttgatcttagacttcccagcctccagcattgtgataaataaacttctgttatttataaattatccagtctgtggcgttttgttatgcagcaggaacagtctcagacaagcattgtggtagctcattttgaaatacgcccagcgattctcgtctcctagcaggtaagctctatggtcccctcccacgttgaataggtttgatagggttaaacaacagggtattgtgtgaattacaaactgtgatttctgaatatagatgattataaaaggctttgcagcttcctcctttttgccttggatcacaccttctggggactccagccacggtgtcatgggaacactaaattagccctacagggaggctcacatgacaaggaactggggtccccctaccaaccaccggaaaggaaccgaagctgtgctcatgttgacctagttgacccagaacactatacccaaccactgcagaatacataaattttttgaaggacaaatggagatatggactaaaatagatactatgctacacaatgcaacaattctcaatgaagtccaaaacatttaaattctaaaaagtattttctctgaccaaattaggaaaaggtaacaagagtattttttaaagaccccaaatatctggaaaccaagcaaaacacttgaatacacaatggatcaaataaattgttacaaataaagttaaaaaaagttgaaaccaaataattagaaaaataagacatatcaaaatgtgttggatttagttacagtagtgctcatgggggagtgtgtagcttaaatacttatattacactcgaaaaaccatataaactcaattatttaagattctgcctcaggaagttaataggaaaaaaatatataaaattttaaaaggcaaatagagaaattaggaaagccaaaggcattttaggggaaagattaattgatgaagattactgagacttatcaagaaaaagaagagatatgtattaactacattaggaataaaagatgcaaaatctctatagatcctaaggacattaaagagcgtacaagatatactgtgaataaatttttccccaaaattatgaccacacaggtaaaatggacaaagtcctagaaaattacaacctattaaaactaacacaaggtagaatatctgagcagacgtataagaaaaatttaatatttgatattacaaacttttttaaagttaaaatgacaggcccagatggtttcactggtgagttctgccgagcatttaaaaacaactacaacaaaacccagtattttaagaaatcttttgaaaatagaggaagggcaaagattgcctaagtagttctaggagattaacgtaattttgataacaaagtctgtcaaagacctaaaaaataaaactaaaaggaaacacacaaaaacaaacaaaattacagaccccgcttcattatgagcctagaagaaaaaaacctttcttttttcgttttattttattttattattattacactttaacttttagggtacatgtgcacaatgtgcaggttagttacatatgcatacatgtgccatgctggtgtgctgcacccattaactcgtcatttagcattaggtatatctcctgatgctatccctcccccctccccccaccccacaacagtccccacaatgtgatgttccctttcctgtgtccatgcattctcattattcaatttccacctatgagtgggaacatgcggtgtttggttttttgtccttgtgatactttactgacaatgattatttccaatttcatccatgtccttacaaaggacatgaactcaccattttttatggctgaataggactccatggtgtatatgtgccacattttcttaatccagtctatcattgttggacatttgggtttgttccaagtctttgctattgtgaatagtgccacaataaacatacatgtgcatgtttctttatagcagcatgatttatagtccttttagtatatacccagtaacgggatggctgggtcaaatggtatttctggttctagatccctgaggaattgccacactgacttccacaatggttgaactagtttacaggcccaccaacagtgtaaaagtgttcttatttctccacaacctctccagcacctgtcgtttcctgactttttaatgatcgccattctaactggtgtgagatggtatctcattgaggttttgatttgcatttctctgatggccagtgatggtgagcattttttcatgtgttttttggctgcataaatgtcttccgcatcacgccacctgacttcaaactatactacaaggctacagtaaccaaaacagcatggtactggtaccaaaacagagatatagatcaatggaacagaacacagcctgcagaaataatgccgcatatttacaactgtctgatctttgacaaacctgacaaaaagaagaaatggggaaaggattccctatttaattaatggtgctgggaaaactggctagccatatgtagaaagctgaaactggatcccttccttacaccttatacaaaaatcaattcaagatggattaaagacttaaacgttagacctaaagccataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaagaaactaccaccagagtgaacaggcgacttacaaaatgagagaaaactttcgcaacctactcacatctgacaaagggctaatatccagaatctacaatgaactcaaacaaatttacaagaaaaaaacaaacaaccccatcaagaagtgggcaaaaaaacccttttaaaattagtagatcaaatgcatcaatacatgaaaatggctagtaatatttgtcttcggaaaggtaaaaccacaatatgtctgctcttatgactaaattatttttataaaagcagaataattaaaagagaaagaattttaaaatgtattttttcctgatttttcagttagttttactctgtagagtagtaatcccttactacaaaataaataaaagtgaaaagacaaaaattggaaaaatctttcaacttttatgaaaaaagtgacaaaaaatattggtttgttaaaaaagaaaaaaaaaaacaaactacaaccataaatgcaatctagaattagaaacaatatgcgatttaaattttttaaattcctaattttaacctcgttttcatttccaccctttacatgattttgttgtaattgctaaatcatttaaaacatctttcattaagcctctaacattttaatcctgtttttatttttccttacttcctcaaggaaaaggacaattggtaggatgttaggaactcgattccttaatcaaccttgttgggagagagaaaatgaaagcgagccttccagagtttgccaagccctctttagtgatggcacaacattagcaagaccagtagggaaagcactagcaatagaggcatcaattagcaataacagaaaaagcagcccctctgctctcttgcccacccccacccccctacccaaagcatgtggcttttatgtagcatttccattcaagtcctgctgagcaaaaattccagtgcctcaagacagctctgttccatcttgaagaagaatgacaaaagcatggtctaatgcaaatacatacattcagtttaaaaaagaaaaaacaaaaacaaaaacaaaactacaaaaattggtaatttgggaaagcacctgcagaaagaaggagatggccatattaccacagcaggcgcgtgacagggaatttagatttttccttatgcaaactatccacaaattctaaagttcataagcaatatgttgccaaaggaagtgaatgtgtttataaatcagggaatattggtccaaccagttggacaaccctgaggctgagatgtcaccggccttgaaggcgtcaccattacagactctgctgaggatggcagcacagtgcctgcaacttcagcccagctagacatgaatcatctgattgatttagggaccctgacagagcttcttccccaaaaatctgtgcatagaataagaacatccttatctagttaggaagtttaatgaagcttcttggagtaagacaaaatgaatggcatctcacaactcaaagaaaaggaaaaagaagctatattggagaagctccaaaaaactgatattttacattgtggtgattttgattatttagaaaatgagttttaattgctcagatcatgtttgctgacagtttaaaaccccttggatactccaattctttcctaatataaattttatcctatccgttctttgtaaccctaataagctggacaagcctaggaagaagaatatgaaagaaactatcgacgcttgcaacaacttgtgggaacctcacgggaactgtgctaagtgaaaaaaaccagccctaggtttttgcatactgtgtgattccaggataatgctctaatatgatcccaaattgttaataaaacattctggaaatgacctaatagtaaaaatggagggaagatgtgtggcttccagaagttaaaggaagtaaatatgtttatcataaagacaccatgaagcttcctgatagccagataaaagttctgtgtccccagagtttccctgtcagtatccgggctgtattattattgtactctagttttgtgagatgttaccattgcgtaaggatggaagggggctctgtattatttcttacaagtgcaagtcaatctacaattaccttgaaataaaaactgtaattaaaagaaggagcaaggactaacaaaggtgtggtcctgttttcaacaaaaaatagatgcaatcaagtatcaacaaacgtattttttccatatttaatctcatttttcctactagttattctatgaggtagatgttattgctacatttaagttgcaatttttttcaaaaagtgcatataagtaatttactcaataataaaaccttacagctacaaagtatcacatcactcttctggtacatcttcatgaacaaagacaaataaggaagacctccaagagggagggacttactcgaggccacaaaaacagtcatcagacagaagttccaaagcctttttcattaagcactaattctttaatactgaaacttgaaatttgaaagcaaaacaaaattcagtacaggcagacagacttgtaaatcattttgaaaatcatattttcttaaaatactactattactacactctaattcattaattcgttctgactgtacattcatggaattctaactcattacaaaagtgactggtcaactcccaatttgtcaagctcttaaaatagggcccacagagttacatccaatctcctctactgatgcagcttaaccttgaataaagtacaatgcagacgcgagacttttcttaatgcaccaagcgatttcattctttctcattcattcatcaagtatttaagcaacctgaacttcttcaggtacccaggtagatagatgacattgacaagtattattgagtttctggtcaattaattcttacatctttttcaactgagtgaatgaacttgtgaaacaaatttcttagtctgagatgaaaactttgcatgcatccttgtcaaatttcatcacgtttctggtagcataagagagtaaactgcaagtaaatgttggcaacaatcaggcaagggttgaagcttgttaaactcactaaccagctgtgtggtttgggtaaattaccagattgctctgagcttctgtttcctcatttacaaaatggggataacgctatgtacatcatggaattaagttcctccccagtgactgccttgggctagcccaagagagatgcgtcatccaagcttagcctttcttcctggagcaactggcattcaatctctgggtgatgggaggttgcggaaatggaacaaagacccactcttctcacctcctttcagggcatctcagcacaacttagcagccaccctagctctgagctcccaaggaacggctaagtccaccatggccatggtttcacagttcaacttctcttgctcactctccttccttctccttcctgcaggtgattttccagggaccattcacactccccagggaaccacttgcaagtctgaatttgcttctcaaagaacatgacctaacacacatagctgttcttgcattttgagcagatgctcttaattctctcaatgttaaattaagtagaaaccacccaacttctgtcccttttctttccaaaccacctgtaatgaaacctattatttttatcctctctggtgtcaaaaagcaaggcgaggctttccctggctataatttctgtccttatacacttgatttcattatctgtctaactttctgtctctctctcattcccaaatctttcttcttcgatactctcacattcttactctttctcattttgtgtttgctcattcttcctctcgtgtctctgcctggcatcctgcctcccacactctcaaccgcaccctttcttctgtctctcccgttctcttaatcttctttctatattttctcttttatattgtctcacatttatttttattttagcattattttccctttgtcacctagcataataatgcctaccttacgtgacctaggtgaatttctaccctgcttaactctgctcatctttagaaaaaaggatgcctgaggtcaaaatttccccttgtgaccaaacaggctaagaacggtggtatccaagagaaaagctcacttgacctctgaagaacgtctaactttattagaatatcatttctgtgctaaatgacactcccccagcaccatgacctttgacaatcacagtaacaatgactagaggaaaccacaaaaggagaaagaggaaggatagctgcagtggggctgtgaggaggacactgcccattctcagtaaagacatgaatattcttcccgttgtttttaatgcccaatcccttcattaaagatgactgatctctgccttcctggctctcagaagctgagaagtagatttgcgagtcgtgttcccacttctcaattgcatggccattgaatacagcctgcaaagctagagttcacttttgatttaccatactggctttgcagcacagaagacggaaacgtcttacttttgcgggaaagagctttgtcggtaacaccttttctcaggtttcctctccaaactcactgaatttctcagcctctgtctctctctatccattccccaacatctctcttcactggttatccatcttcttctttgttttcaacccatgtcactggttaggatgcaaaactaaatctctcaaaccttaaaaagaaatatcatttcctgagactatacctcccacatgtattctctctctctccccttcccacccaaccaggttgagagtaaagcccaaagtcattgtcttcatgttttcaccttcagctcattcctcagttcattgcaatcagctccccgaccccaaagctctgcagggacttctctaaggtgagatcccaccaccatttattccaacagcctcagctcccaccctcccagaccaaacacattgatccctcagcatgtggactcatccctccctctggaatcactagtctcctggtttccatgacaccgctgtgttccacccgcaatcttccccctctactcatttttatattcagcgaaaaagcactcccctgccaaggtctttcctgaattccacgaagggtcacacacccctgttctgtgctcccttggtgcatacagatccccttgctgagggtctcaaaacttattcttgtagagaatgaagatattctggtcttgccgccagagcttctgacaaatagtaccatgtaggattcaggaaacttaacacaatcctctcagggattccagtgcttaacaaaacattgcttggcaagacattccccactctttatggtgacaatctgtttggctgcctgccttttgtattacctataagctccataaggacatgggtcatgtccatctggttcagcacattttctccaggaattagtggggtgcctgccaacttgtagatgtttgaaagaagaaagaaggaaagaagagagctcggtatgggggaaagcacaggctttcactgagaagacattttcagaggttctctgagaagaaaattagtaaatggtacatggttagcattctgtgtcattatttttcactcatttttgtgtccttcatagttttcaaaaaaggtaatgaaccatataaaaaagtgacacattccatatatccaagtcttatatagcattctgatttaacacaatttggattctgacttgcattacttagttattatacctcttctctcaaaggttaaatggggataataaaattatgtgcactattctaaggaataagtgaagaaatatgtgttaatgggcttagtaaagtgcttaacatatagaatgtgcccaacacagaaagctagctcaagattattttaattattattgacacaacatcattcattagtttgggggtatttttgttatgggcaataatgccactcagtctaccgagtgtgtttggtcttggagggtgagagctgaggcttctggaatgaatggtggtgggatctcaccacagagaagtacctgcagagctgtggggtcagggacctgattggaatgaaccgaggaaagaatattacatgtattattgttgaatacgttgctgactttcagatagaatgccgctataatggaaacctactttctctactagcctgttttgtaaaggaattatatttgatattgatttatcataggacatgtaaattttcgaatgagcaaaacttaacttacacttaaatacaccttttgctatgtttaactctggaagctcatcattaatagaatacagtcttaattggcttgatactgttttgagtgtaacctccacttttgactacagtacatgattgtcttaaaaagtatttttggcttgtttttgagaagttatcacgtaagccctgttgtcaaagagcttagattctaattaaggaaagttaaagccactaggtaatatcgtttataaagaaacattaaacatgagtcattatctatcatgccttaaaaataaattacaaagtgtcagattttccactcttactcctttttaattaacaccctagtcttgattggacgtgtttaatttttttaagaaaatacatgggaaggttttaaaataaaaaacaaacagctagaaataactcctactgcttcatggaaagctttgtacacctcttcatgtcttggattatcttgcttttacaacagaaactaaaatatttaggtgtgctcacctgaccttcaagtgtgatacacgaattctcagaattgtaaaagaacgtccctgaacttaagtaatttaagtgaaagaaagcacatcaatttcctaattttatctctagtaggttctagtggagttttaaatcaattttacttaaacattaaaccaacacatataaaaattgaagtagtgggttataattaataattcactggtgcgtggttaaagaacatatattctttaagtcgaatgaaaaaatagaaatatttggcgaagggatgccataactattttactaatggatgctgtctacattattagtaacataaggggcagtctttttttttttttcttttcttttttgagatggggtcttggtctgtcacccaggctggagtgcagcggtgcaatcctggctcactgcaacctccacctcctgggttcaagtgattctcctgtctcagcctcacaagtatctgggtctacaggcacccaccacaatgcccagctaatttttgtaattttagtagagatggggtttcaccattttggccaggctggtctcgaattcctgacctcaagtgatccacatggctcggcctcccaaagtgctgggattacgggcttgaaccaccacgccctgccaaaagcagtcttaaaggtgaataatgaggatgcaaattagaaaaaaataataatctaataaaatttccaattttattaaaattctgattcaataaatattttgttgtagttagaatgattccatcattgaatttgaaatgtccatggaagaaaataaatataaaacaaatgaattttaatgaagttatcaattttcttttactcaagttattatttgcacttttgctccacgtcagaaaaacagcaaacagagggatttttaaaagtatttacttatatgctgcattgctggaagataattatgttaaagctggcactcagcaatgcaaacgtggccaccgctcctttctatccctcagtattataattgtaggacatacacctcacatagagtagcaagaaaacaattccaataaagagccccacaacgagttcttcaaaatcaatgctcactccctaaaatctgtgaagacttaggaaagctgataaaggcacaagcctcgcttggtgtgctggtgtgtataaatgtatcctgtatttaacatattctactttaagttgtagtcacaaggttggtaaaatactggaagaggccttatccttaaaatggactatttagcaatggagaaacaacagaattttaacaaaattagactccgcattgtaagaaccgtacagagttttaaatagtcagtgctcccagttctctatttaaaaatgtcattgaggaaaagggactcacgtaactctgctaagacattttatgcgcctaaaaagtgaagctacttttacataatattacgtagcacatatcacagggaagggggcaattttatttcattgctagcactacttagaagcttaagagggacgtaattctgattattcttagagaaatactttctccttaagagaagaaaatttttccttaaattctactaaagaggacaatttcaaaatccattgaaattaatagacatgtattgataactatttaaggtcatcctagaaaaggaagacaaacaggcaaaacctccattaatttgttccaaccaactgagtatgggaaacccgagggcaacatttcctggcttcgtcctttcctgtgtctgatgctccaggagaatcatgacgtgacacttcagccaccagggctgctgtgctctccaccgtaaggcaatgaacttcatattggcttcagcatattatgagactatattatgaccatattatgacactcttatctttggtaaaatgataattaagcatattgtctttaagtttcagtaggcatatttaaaaaaagaatagaagtattttggaaaattattttaaagaaatgtgattctctttcttaacactaccaataattagcatatcatcttaagcaattatgagaagaatgacgtgaattaagaatgtattaaatcatttccaaacagaattcagtaggtcctttttcttgaatatttttccttaatgtgatttttgaaataattttgacaactttttaacttccacattttctttaaatataacttttattccttttactgtattatttcatgaaatctattttttaatagaccaatatttttaatttgttttgatcaaagcactttgctggttgaataatcattataagtagaatttaaataattacttctggacttgccaaaacacaagttttttttaatatttatttctctgaatcctttattactcttcctgtcactcctctctgtgtggggagtatcttatacatagtgggggtcaaagaaaagaccactgaggaatgctgtgaacatttttgtgacttgttggttattgcatagtttgaacaagttgtgttctgaatattttaaccacataattaactcaaaggcccttgtgcctaaaatctccagccataaattatacaagtcatattgactgtttgcaggtttacagtaacaagtaaacagaaaatttgaagtttcacattatgtaaataaagtataatttacctatgtttacataatactttgctaattaagctaaaaaatcacatttacataaaaaataatttatcctatacaatttaaataaaccaggttttaatttccatgaagtaaatacaaatgtagaagaataatgaaagttaaattttatatttaacgtgatatttagaaagccaaattgtttaaagccaacagaggtgtacaatttttaatgcactccccttgaatctgaatatctgaattaagatattaaatagaagttacatagatgttatgttagctcatgattcaaaggaatatagtgaaattttacatactacgagttttctcttttatatagaacaccacattgaaaaaaagtggcagaatatcggtatgctttttccctatttgaaagtcgaatttaagccaactatgattgagaggagaaagtgaattttaaaaaggaaagcaacagaacggccgggtgcagaggctcacaactgtaatttcggcactttgggaggctgaggtggaaagataaactgaggtcaggagttcaagaccagcttggccaacatggtgaaatcccatatctactaaaaatacaaaaagtagctgggtgtggtggtgcatgcctgtaatcccagcaatcgggaggctgaggcaggagaatcacttgaacgcaggaggcagaggtttcagtgagcccagattgcgccattacgctccaacctgagcaaaagagtgactgagactacatctcaaatagatagatagatagatagatagatagatagatagatagatagataaagaaaaaagacaaagaaaatcaatagaatgcaccagagagctggtgtgaaggacagtgtggaagtgacgctgtgtggatggaggaaaacggcttccccaacagatggtgcctccgtgtgtgggggggatgaggggacacagccgtgcacacgaatgtggtgagcactctttggagccaaacctgggtgtgagcttggctgcactagctgccctcgtaacctggacaagttgactgtttgtaaatcaggggtgatctactgggggaggcggtagggaacaaggagaagaatcagcaggcgactgtaggaacccaggccagaggtggctgtgagctggactcatgggtaacagaggaaagagtgggtcatatttagttttgagaactatgttggcaaggcagggcggtcaggtgtgtggatttgctgtgggaagtgaggtagagggaggaatcgaagatgatgcctggattaacgctggagcaaccacgcagggtggaggaatctaactttcagattaaatagcttcagtgggagattcttgtagacgcccacatgaaaatagtaatggagcaccgtgctgtgcttgtgtaggtcagaggagaggcgtgtgtcacacatgtggggacacacatgtggaagtagcgaccgcacttcagatgcatttacagacggagaggaaacgccggcttctagagagacagggcagtggggagcctccttctccattcagacaaatgatggaggtgagatgctgagctaacactgcgcatggagtactggataaacaggcctgccagggagcaaacgcttatcaaggaaataaaggtgaagcatagttggtgatgtgtttggggcatattgtgtatgttaaaagacagattgaagaggatactggagagacatggggaagtcattgaaggttttgaactgggaatggggagatagtgaataaagtattcaataatatagtattatacaggtggactagaaatggagagaccatggcaacaaagatcttgagaaagtcatgtaagtagttgagctttgggctaacaagagcttggattaatgtaactgcagaggaaacaaagtgacgtgacggatatggaaagaacttgggaggaagagaggtaggatgtgctgagaagttgttggggacggatagccacagcgaacacaaactggtttggttacaacgtactgcctctccttaactcaggctgatctttcatgttccctaagaggttcctccgaggagattaaaatgtgtaacctttaatatcaattctgttattacctgatataacatttgccacattagcagcttcctgcattgcctggttgtatgtggctgatgtagaaactaaaacaaacaaaaaagtaaaaaagaaaaaaaaatgacaatagtgcagctagtgattgtagttctttcttgcaatttgagcattttgtatttttgtgttgtttttcctattttccgaaatttgaagtggaaagaatgtccccactagtatcaatgtaaacatgcaacttttaaggaactgggaataaatgtatttgggagagtcaaagaaaaccaagaaacaaagtaatgtgcacctgcagagctgcgtgtgttatagaagagaaaacatccacattcaacaactgagggttcttgtaaaattaaaaggttatagaagctatgatgaggtgcatccgtacttcaatttgttcaagtcacgtagttttatttctctacatagtcctattacgtgaattcagttctaaggttttatatatgtatttgtatgcatgtttattcatttgtttttgcattggaatgtatttaaaactttttaaagtgttgaaagctaaactatcaatgttaagagtagaaactttatacacacatttttgtttcagttatttaaatgtatcattcctaaaaagattcatgcctaaaagaaggacaaaatatttcttaaccaaaaacccagagttgtcagaaacataggaaaggataataattcatgggtataatgtgtggtgtgttttgttcttgtaactacagtgttgttttatgttatatgttatcacaagactgttgttggatggttcctcaaaaacatccagggtcctagatgttctataataggtgagggctgactaagagatcagtttttctcttcaaaatggaaccactgagatgaaactcttaataattataataataataaaaagcaaccgactttccctgctagctcttgatagcaagcaggcccttgggatgccattgtgctaggatcaccacatttgtctgcagaggaaacaacccagaaataggacagcttggatttccatatggggctcccagacatggcctagtggatgcctatggctctaatccagacatagagtgaaaacaggaaggaaaaatgcaaaccagatgatccccatctaaaatgtaagaatctttgaggcaatccccataggctcaaattatgagacagccaatgactacttagaaaaaactgagaatgttaaatcctttcttaacgattgataatgcacgccactaaggataccttttcttaagtttgtattgtgtaatctgatcaattacaatgaaagatatcttaaaaatctttactaagatatttagataagaacataaggcaacaaattcagactttccaaaagcgtcactcactaatccataggtaatcatctgagaaaataaaaagaatattgtatgagttttttccctgcaatttagaagacacttgcggagttgcactccgacgctgtcttctgacccatcattcttgatatatttaatggaggtgtgtgtctcaggtaaaggattcctgcaaagccatcttgcaattttaaagctctcagttgcctcagttttatacataattgcagagcaaacaccccaaaaacaaacgccatttagatgtgtgagccagtgagtaaattcaaagggatgggcagagataaaatctttgaaaattatttttccacccccatctttttttaattaactgatgcctcattcataaatgtttactctttaattatgtactacaaaaagaagcacggctgtgccttcccctctctgcactctgagctgcaacgagctgttcatttctttctgtcatgcttaccattatatatgctcaataagcaattgctgattgaatgaatcaagtagcttggaaggagataagtcccttttgtagtacaaagaactggaaatcagaaaactagattacagtctaagctctgtcttataaaatgggtgatactgaaacacttattttaatttgcctcagttgacacctttataaaatgtgtaaaagaagaatgcttaccacacacgggtgttataagaattaaacagaccacacatgaacgttgtatacatatacgctaaataaagcatctttcattaaagggggttgtaataatttgtgccaattaagaaagatttagattccctttgaatgtcttgttgcccctggtgtgttcagattcacctcaagacagaaagtcagaggactactcagtgcagtatgattctagtaacacccagattgattagcttatgttggagataagctatctgcaacatagggattcaagtaaaaaactttaaaagatgttcttgtttaagacagtgaattttagcccttggaattcagaaagaacattcaacataaggttaatacttaaaaaacaaattcagtgtagttgtcaaattctgggtaagtacgaacattagttttagcatgattacaaatgctgtgggtgggttatgtttgccctgtctattgtttcagacaacgttctattacactactgtgtgactacgtctatccatggggcttcatcagctgaacatttggaagaaaaagagcatcatatgaaggtaaagttaatttctgtttgatcatggtatgttcttattttttagaatctgtggatcagatggaaatgaactctgtcaagagtgatttgcaggagttcatataatttttgttcaggcacagagaatgctcacttaaagttcttgttaaaataaaatatctcaacaacaaaggctgaattaagatgatctttcactcatcagatttcatataaaacccttgtaaattagaataacatgttttgcagctttagaataaagctaatttcaacacaattctatacacatactttgaatagaatctaattatattacaataaatacaatgtacttcagatgtaatggcatcagaacaaaaggcaagtaatttggaacaagaacttcataaagtatcacactgagaataaatgcgtatcataatagtgttgatcttcactattttttttctacaaaatttaattttccaaaatggatttgtcatttttttcagggtcatgttacataatatgtgcaacatgcatcagacacatattgttccatgttggaagttgtctagctcctgtgttttagttttaggccagttacccagctgcgaagtcaaccacagagagctgagaaagtggattcagtcagtggattcggcctgaaagattgggaactcaacaccctctctaaggttcaaataagtgaaggtagtgaaataccccatttctacgtattggtggtttttaattcttcactgtcttacggcaaataaaggttctcatctctgtagcacctactctaggtttatttccattcagcaatatttatcccttctgctctcctttgtcagacagggatagaattgcagtcattactaataagaagacaatgtcataaaaagttgtctcttctcatcactaaggctatgccataaatcttgctcactcattcatttattcccgtccagaaagcactgaggaccaactgtgggttagaaccagtattagagactggggtacaacacagaaaaaatgttaaaactgttttacaattttcaaagaggtaagaatacacatgaactctcttagactccaaacaactcttcagctgaattaataacaaatgtggatgcatgtgacacatctgtttttttcttcttcattctagacattattttcatctgtttttttctttttttgtccatctctgctaccagtggattccttctttcaggccccaaccatgcatatgtcttatttatctgaacacacacacatacacactcacacacacacgcacacacacacacacaccatttctaattccttccctcttcaagtgtctttctttgttctgttactttcatcgcctctatccttattatctctactgaattacatgaaggagctatactcactttctcccattttcaacatctgttcagtcataaaatctggtaatcacgcctcacctcctatcgcttacctgaagctgctttctaaagccttgcaatgccaccactcagttctaatacaccattcctaagcctccaacaatcatcttccacagtgctccttccagccttcaatgctgttcactacggattgtgccattatgagcacctttgtgaacaaactgaagtactgtttaaggcatggcatatatcaatcaatcaaactgttcttcaaaaccatcccccaattaaaaaaaaaaaacctcactttcttgggttcagaataaaccaatgcagtctgcttatttaaatacaaacaaacaaacaaaacctcttcttttcttttgggactttacttgctttctcccctccttaaaactagaacctcttcctgagttaatctcccagccacttcccttatgatagtactgggaaggctactttaaatccctgattgtatccacatcttgctcccttagaacatccttcttttccgtttatttaagttttagttgtactgggaaccagttcagacatggagacttttctaacaaaaaatcaacaacaacaacaatagtgaataaaaatactcatttattttacttcctaatacagttgtctaaactctcattcatttattttcatttttatgacttccagaagaagatataatgtaataacgtgagcatgcactttagaatccaagaaatttgggttaatccagactcctactcactggctttctgactccggggaaattacttacttttcccaataccttggtttttatgtgagtaaaatggggcatatactaccactaccttggggaagggtgaggattaaatgagattatatagtctctagcatacagatggaaaacagtaggcatgcagttaattgtcatagtattcatcctttttgtatcttattagtatcttttaccaaatgaaaccttcaccaaatgaatgcctcgtgacttctagattctggcagcattcctccaccacccatctccttccaccttccctgtgtctagtcagccaactactctgtagcccgttcaaagcagaatcaaattcactatccttttatctccaaatgttgcttaacttttctaagccttagtctcatcaactataaaatggattaaaaatgggtatcttatagaagtgttgaaggatcaaatcaaagaatgtataaagagaacagcatcacctgggaggtggtaagagctcaaaatatacagtttccaccgtgataatggggataagtatgtccatcatttcgatgatggaaaaagggtgctgaaattgccattcatactgggagactctttaatttttttcctcataaacttccacactgctgttctagggagctgcaggggactacataaatgaagtcatcgatcttacctttagagtatggtgccaaaaaataaaaagttaaaagttaaacatgtataaactgtaaaagcaagagcctcagagacttaaaaatatatgttagaaagcctccatttatacaagaaataaagaacagaaagtggtgtatatgaaggtggaaatgctaagaacccagagtattgtctgtaatcactccatcagcacaatactgaaatctgaactgcgtagtcctagaaattcccaatccacgcagcctgtgattgcagaatgatgcaaaggcagatgatgccagagacgagacggcgctgggttcagaactatgcatctaccggttaaccagcgaatagtcttttaagggcctcagcaggacacttaagaaccactctatactgtctatgagtccatctgaatacatctatatgcctacatacacgtatgaattcttggttttccttttgttttttgctgtttctcccctgaggttaactcattgcaacactttggtgttcttccaaactcccatgttaaagagtttcacttgaacagctgtggaaggaaagacagtgcaaatgggcagccctaaccaataccacattccatctggggccctgacaacgatcccactcaggttggttgggcaggtgaatattttcattggctgcacagttacccttgtgctctgacactgtcaaaacaaaaggtctccatggtgcagctgtcctcagtcaccctgcagtcaccaaatatgccgaccaggaaacatacctaaaaaattatggatgtgtaggaagtttcttaattttacagaagtacattttaaaatattccaacccaaatgtaggaggaccttctgaagtaccttggctcattttaaaagtctttccaaatagaatgttgaatttatgaaagtgatggtaaccaaatgattgagtaatcaaaccacattccagaggagaaaagcaaactgggccaatgataagtgaaagcttttgcttaggacagcaaatgctgggtacagaagtctgtgagttcaaagtgaacggagaattactcactccgcacatctctgaattgaatctgaaaattcaaattgcaattgcccatcatcttgttaacaactactatctctcctaataatgtacagcattttcccagtggacttgctgttagagcttctaatagagaaaggaggactcttgaatcccatggtgttggggactggggacccggcaatagctgagggattactgtcacagatatgcagaaatcccaagtcagtcttctgagatcagcaagttttacctgcgctgcactaatttctgaagtaatgctcattgaaacaaataagaaatatataaaaacaaaaacaacctcaaatcatgtaaatgacttactggttttgtttttctgtgttaaatgctttattgtctcttttgtaatttaggactcatgccccttgcccttctgtaatgttttgtttttagatatgctatactttacacattataaggaagatcagagaaatcatgatcttagctttttctattaattttaaacaaatatgtagaatttttgctttgtttttccttgcaagagaaactggacattggtaacttcgtaaggttaacccctctggagaatattctccctgattctgtcataatagatttaagaaagtccttggtcagtttcaggcagatatcaaatctgtcacttgaggggcagaattctttgaaaacttagcgacaatggggaggcttatggtcactgaaatgtcagcttatcacaggaggctgactcccaggctgaaataattcaatctaatgtaactcatgtctactcaaatgcctcctgttcttggccttttaaatgttttttgctgtaaaactttaaatactccaatattcaggacatttactgataatgttctcctaaaatgtatccaaaagattttagacaagatattggaagcagatatttttgaatttaattagtccaggacaacaaaaggaagatgatttttctccttcagcagttgtgtgcagcccgcattcatatcctgcttgatatcaggaaggaatctatcctgagaaccagcgcccttacctctgcagtctaaaggttatagcaaagtgctgagtgctggagtcacacatttactttaaaaataagtgacaaattccctgataactttaacacgtgcagagccagcaaataaaaatatttgtattctaaactttttactctttgacattgtgagttgactcagcgggtcagagaattatgttacatggttgtgcccttggttttgagctccagacagttctataaagtggattctatctctgaacacgagttaacagttattttgcaaagtagccacaactgtgagccagtcagcacaaaaccagtaacagcaacattttctaacaaaaaggtaaatatatataattatatacatataaatctatactgatgatcagtgtatacatacattatatatatcatactgaaagtatgacgtgtgtgtgcatatacacacagtgatcatcaatattctccagagtagaaaaaagttggttttgaattccagatctccaatgattttcagggaaccattggccaaattctctatcttttctaaaccttggcttttttgtctgttaaaaaagggtaccataacatccacatgattattttaaaaagggttttacatatatataaataaacatataaatatatataaatgtaaatatatatacacacatgtaaaactgactgcatcaaagtttgatacgatggatacaaaaaatgttggactcattcagatattttcatgtaaacacttgtgtagtcttaaggatctttaaatctcattaggtatctgatatgccacatttttacatgattataaactggagtgaatgcttaaaacccatgataagagttcctttatccaagacttgatagtaggaaaagctgaaacttcttatattacaaaagttacctgcttcaaaacagaatgacagaaagggtaaattccatgacagcctcttcataaaatgctctaactccctggcagcattgtctggtgctatatctcttgcagttaatatttgttctctccaggttcccaaggccaaacagctttgtgcctgtgttgcaacattcactcctcaaaccctgtgctgcagacgcgtgagctcctgatgttctaagagtgccccagctgcacacctgcacaggcctgtccctgccccagcctggcccttctgggcattactcaagtactacaataggttctccctcaagacacacaaatgatcaagattgacctgtcccacagaagcagagtgttgattcagtccctcgtctgcagcagttactgtccttgattttcactggaatttagttcattctctagggtcatagtgtgtgtgaatgtacgtgagtgcggatacacatagagacatagatacataatgatttatctcactccatcttttcttttgagttctaagcacccatgtgcaaggattggtgttctccacatgagtgcttagaacacaaaaggcattaagactgcacactgtgaaaaaatgcacagggcagtactacacacacacgtgtacacacatgcacacgcacacacacatgcgcacacgcatgcacacacacacacaggatatgtgcactgaatgtatttgactctattgaattttcttgctttcacggattgaggccccaccctcccacaccctaaatttgcaacttttcaaagccacttttctgttaaactgtaaataaatgaattaataattgcatgagaacggtctgaattagagtgtctggaatgaggctagtttgtcatacatgggaaagagctgtgccacagactagtaaaacagcacagttccaggcggtttcacacaatagctggcaacagtcccaagaggaactaggtcagagcccggggaaaagcacaatccggctttccgtttcccaggaactgctggctatttgctgacctttacgaagagtgtctttaaatgtttccttgagatcaaagcctctgagtgcttagccttacatttttaggtattactttttcttttgtatccattaagatcaatcccactgtgagtgagaattacacaacagtagtttaaacatgcttgctcacagccactgccaattcgatcataatagaacagtttcacattaaaaaaaaagcaattcaattaaaaactacattatagaaatgctaagggcctaattccaactaaaggcagcaatgaaatttaaagtaaagacagcaagggagggttttaatgtgtccttagctccctacatgtaatacacaatcactaataacgtacaactgaaaattagatatccattccatggatgccatacatcctaagattattccaagggcagaaaaagctcacataacgtcaaaggaaaccctaaatattgatcaacggccgtattcaactgtaaggtggaattttcattttaacttcatttcattgctttagtgatcttaatcttgtaacacttctgaattttttttttatgtttatatgtgctttagacatgtaactatgaataagaaggtgtttatagaaaagtatttttaggaaagagcatggacactggttaaactcattaatgatgtattcattcagtaaataattatatactgaggaaactatgttccagagatggttctaggcttcattaagcttattttctgctggatgcagacaattaaaaaatacgacaaataagcaaattcattgtctatgagtaggtgatgagggctacagcagaagaggaaacagggaaagcaaaggggattggagtagcaggtggaacgtggtttctgaccccattagcaggtttacctgtcatattagcctaggctggggtaccccatggcaagatcaacccacagctttctggatcgtagtaaacataagcttatttctcactgaagaggctcctctacagcgttgaaaagtgtcctttccactgagttacttgtcaccccttttgctgaggccatgaccctctgagcttcccgggacaacagagcagacaggacacagctcggctctgtgctggcccctgcaggcttcagcccaaggttcggtgcgtcctgaatacctgacctgaattagccacaagtcccaacttcaccacaggaaaatgtagagcaggagattgcatcttcgggtgtgccaccatctccactgcatcaaggtaggccagattttaggggtgccaggcaggagaaagagctatgtagagtctctgaggcaggacaacccttgtgggtggagggaaagtgaccatcgatttattacatgtttctctggtgagtacagaccagcgtctgtgcctgatggacacccggagatctatgagaggaatccagcattgggtcagggagtgatctataaacttccgagcaggataaacacaagtattaatgtatgtgtttctgtgggtgggaaaatacgttagagcttacctcaaattctaaaaggaagtatccacaatacctatattttttaagtcaaaataaagcattcaattacaatgctgcataattgatctggtaaatattatacaagtcatttccatatcaaactctatagaattttacacaccaaactctcagctttcattctctctgcattgctcttgagtaaccctgttcaatagaaacagaatgagagcctcctatgatattttaaatttaagagaagccacattaaaaaactaaaaatgtgagttaataattaaaggtgaattaattttacgaatatattttattcaccaaaatatatccaaaatgtgatgttgataggtattcactataaaaacagtaaaacattttctttatttcataccaagtctttaagatctgatgtgcgttttatacacacagctcttaagttcaacaacagaccccgcacagctagtgatcagcggccacagtggctgacggcgatggtctgggagagctcaggtctacaccagcacacactatccgaagtcagagagaaaagaaaaactgccccgcatttcttcaactcaagtcatcgttaatatttaaaaacaaatcaataggcttatttataaaccaaaacgcgttgtggttctcagtttcacagggagaagctctacgtcagagactcagcagatgggccttagacaacactaacaggagagaaaattgtatgagagctgccacatatcacgcggcacatctccaagcaggcatccatgtcaacgacaacatgaacaaggtgataatgacgacagaaatgaggactaacaaccaagcatagtactggttctactacacacaattccagtcaacttcagaaaacaaatgcaacaaaaaggctgaaaaacacttgcactactacagagctagaagtagctggcgccagaatggaaacccagttccagctgattcaaagtgcttgccatttcaacacgctgcactgcctcatttagaacttcctgaaatagagaggatttccattcaggaataaagctccttacaaagccacctgtagaggataaagtcctctctatacaaaaatcactcgctccacagcagaaaatgtcttgatacacatcacattggtacggatttgtttaaagcactggataatgattacaagtgaaacggatatttcaaacaccgaagaattccatgtctacagcactaattgatatctgggctaatttttaagctacaaagtagcacctgctggcttctaattataagcaagcgctttgtgaatagctgggagtatgagcgactcaaactgcatgtacaatgagcaccaccgaaagctcatttgaagtacaatccatcatctgtgtccaacatgacagggaaccgggcagcgcacacgctccatcagatgctgtgattaaagggagggacgctgcggtttgtcacatgactgcacgaggctgtcaccacctgctgttaataactgacaggcaatctgagcctgctttataagaacgaagagacaggctgcacattctctctgatggaaatagaaggaattactcactctttcatcttcctaaatacaaactgaaacaaataacattttcgtcaaagttttgccccctacggactgaaaactgcagtaaaagtagcattgaccggggagcttagagaagtagaaagtaagggaaagacagaaagactgcaggggagagagagagagagaaagagagacagagacagagacagagacagagacagagagagagacagagagagaacaagaaaaagacggaggaggaggaggaggagggtagggaaggggagaagacagaagagagacagttttatttttattaagttgtatcagactctatgggaaacaaatcaagcttatgtgaagtccttcgtaaacatttaatatttaatttctataggttgagttgtttcaaatgctgttgaatgatctctgggaagccagtaaactcatatgacaattgtaaaaattgggtgttgtatgatgattctcctggcatgcaagatctcaccccgggtatctgtatcaagaactactctcgaccatgttcatagcatacgacaaagtgactgccatgttgttcatcatttgctcatgaagggctctgctttaaaagcatcagatttagtggcaagtgattgctcttataaatgcagttttaatttgataatttatttgtaaccccaactgttttcccagaaatcaccatccactgatatgccatccctttagatttccacacggcaacagcacaggttcccggcccgagagtctcagaagagccttttgaaatgccacctgacactttcgacaaattattttcccccttttagaacagttaagcagacaatacttaaaataaacgaagtgtatgcataccgacttttgttacatttagtttctaggcagctcattaagatctgaaatatcttgattctaaagcacaagctcctaagtagcatggcaaagaccagcagagttctgcatatgcatgcacaacatcagcctatctgcaagaatttgtcactttagtggaaacagccagaaatcatttaaaaaactgtgacaaaaaattccatcgccttagaaattgtccatttatgtataatttagaaactacagtttttccgaattatctggaaaggattggtttcaggacctccatggatacaaatatctacagatgctcaagtccgtcatataaaatggcatagtatttgcatataaccgcatccattctccctatatacattaaatcatctctagattatttataatacctaatacaatgtaaatgctatgtaaatagtgttatgctgtattattcatggaataatagccagaaaaaaatcctgaatattttcggtatagacacaaccatccattttttttctgaatgtttttgacccttggttgtttgcagaacacacagatatgaaggagcagctgtattttttttctatattcctcaaagctgagctatcattttcacgaataaaatcttatttcatagatttactgggcatataatatagtgacctagcaaaaataaagaatcttaatcacggtgaaagtttcatctatttgggaattgagtaccacaccactaaatatgtaaccctactttacaatcccatacatgctgtgcatgaataagtagacttattgtcagtagtcactgaagttttcaggcaaaattgaccatcatttcccagtcaatgtctggaactacgcaggagcatttgcctttggatattgttggaatcaaaagctctagacaacatcattggcaaccttgtaagtttgttgtccattatcattaaataattttcaagatactccgaggcatatgatgctatgaaaaatcttaaaacaactatgtcttatttttaaagtgtcatgtaacataagacagtttgatttctgtggtcattgactgagagactaaacaaaaagggtgttaccataaatacttaaaacagagtaagataaaaataagggagaggtccaagacagtcattgtgctttttctcataataaagttcttttccaggcaatttgggcacagaaaatgaaataagatcatgacaatttggtgaataatactctatgaaaaagtccaaggactaactagaaccacagaatcatcctgtgttaactaaaatgattaagataaactgtgcccaggctagactgaaacttgaagtcacccaatgatcacgtggaataataagctttcctccagcatggaaataacggtggagttggaaaagtgtcttagaataataaggtttaaatatgcaaatctgccatttcatctggatcacatatctaaagaataaaatttaaaatctagagaatatagatatgaaataaaataaaacaagactgaaagcttggcaacgaaacaagtcatgatatactgtgagaagcaattttaatttatttatccaccatttcccaggaacttgtgaatttttggcctctaacttcagcctatggatatgtatgtttttaatctaagggaaaagtcagccagcagaaagagtcaaaaatatagtactctggaaatctacattttcattacttttcctttaagccagatccctctcataaatactccaagaaatgttaacttttcatatattattttcccctagcgtgtgcaagttaaggattttcatttgtatttaatttttaaacaattttctgactagtttaatttttaaacagatttctgaaaaccattttgtactttctccctaatatatacctgatatatacaggtgtgtgtgtgcatgtgtgtgtttctataaagttacctaagaaaatgttttgctgcttataatttcagggttttttttcccctttctcatgctctcaaccatccagaggttcatgaactcagattacagacattcaaacgagagatattttcaagaatatgtatgtttttaaatgttctgcttctatttctactttttttaaggaaatcagagacttttttccttgaagagtactgaaatattattttcttatgtcaaaagacataaagtgagacaatgacattctagaagtactcagctgatcaattaataagtattacagtttctttctaaaatgcaatctgagctggaacaagctcactaagagatgcctgcaatcagggactccctgcgaaaggaaataacttaataaaccttgcaccgcatggaaaaatctggtagaaatctagtatctttcaaggattccttctacaaagttttgttttgctctggtttggttcgtacactctaatgatttcggacagaaaagtttccctgttcccaatatttttgttgatatttgtgttatgtttgtcatcatcttttggttccacgtctttgctttctattatcatcagtcagtttgttttagatatagatcagtgaaatcttatgagcagaagaatctgatggctgaagaaagaatctgctgttacgaaaaaagaccttgggaaaagtttattgatgaaatacacatggaaataaacagtattaaaaaagtatgtatctttattatagaattatttatattccttaggatatatacccagtaatgggaaaagcacatgcacgagtatgttcattgcagcactatccacaatagcaaagacatggaatccacccaaacgcccatcactgatagactggataaagaaaatgcagttcacatacaccatggaatactatgcaaacataaaaagaaatgaaattatgtcctttgtagggacgtggatggagttagaagccattatcttcagcaaattcctgcaggaagcaaaagacaaacaccacatgttctcacttataagtgggagctgaacagtaggaacacatggaaacagagagggcaacaacacacactgggaactgttgtggggcatagggtgagggagagcatcaggataaatagctaatacatatggggcttgaatcctaggtgatgggttgataggtgccgcaaaccaacatggcacatgtttacctatgtaagaaacctgcacatccagcacatgtaccccagaacttaaaataaataaagtatggcaaaagcacagtctctgtaattttacatacatagttttttattgtattattttgtttataccaagtcttttaaatgacatgaaatgtataaaaatctactttatgttaacatttgcaattttgtctgaggctagtcttgaaataaaaggaaactgaaggaaccacattagcccacaagatcaggggccccttcaaagtgctgggcatccagagcttaaaagagctgggcagtctatagctgctgagccataattatcaagaaccagtaacacctctttcaggggtgtgaagctcacctcctgaggttcttagaaggcatcaatgaatgtctctgatacacctttctgtgcctgctcccgcacatttacacagactccaccctggcaacggacacaggcctgtgatgaggctagggctccatcgcagagaacccatccaggaagaaaatgccctgacaaggctgagcttgccagtaaatatttaataagtaaaagaggatgtgttccctccccattctcccctggttcttccaccctcctgccaatggagtgacccatcctgaatacaggaagtttggaaaagacatcccaaactggacacagcacgtcctgctttctctgttccctcttctggggaggctgacttcacagtctgtgcgtgtatgagggctggttctcagcaagcagggacctgtccaaaggggatcctgccccaaatcccacaaaccccagacaagcccctatatttatatatgagggtttgcaagtgatatggagatttaattacatgtttaaaaatattaaacaatatatccttaaatgctccagcttatggctccaaacgttagaattttatacacacagacataacttttgtttatggctcttcactgtattgcactttgctgatattgcgtttttaaaaattgaaggcttgtaccaacgtggcatcaagcaagtctattggagccatttctccaacagtaagtgctcacttcatccttttgcgttacattttggtaattctttcaatatttcaaaagttgttgttattatatctgttatggtaatcagtggtcaatgatccttgatggtaccatttaaggtgttttggggatgccacaaacacccccatgtaagacagtgaacttaaatgattaatgtggtgtgtgttcttactgttccactcatcagctgttctttatcttactctccctcctcgggccttcctagccccagagacacaacaatattgaaattcggacagttaaaaatcctacagtggctcctatgtgttcaattgaaagaaaggactgcacatctctcattttaaatcaaaagctagaaatgattaactaagtgagaaagacatgtcaaaaaaactaggcctgctgcacccaacagccaagctgtgagtgcaaataaaatgttcttcaaggaaaataaaagggcttttttttttttttttttttttttttttaaatgagacagtatctcgctctgtcacgcaggctggactgcaatggtgcaatcttggctcactgcaacctctgcctcccaggttcaagcaattctcctgcctctgcctcctgagtagctgggattacaggcacgtgccagcacacctggctaattttctgttattttagtagagacagagtttcactgtgttagccaggatggtcttgaactcctgacctcctgatccacccgcctccacctcccaaagtgctaggattacaggcatgagccaccgcgcccagccagtgctactcttataagtgcatgaatgagaagaaaatgaaacagccttattggtgagatggagaaagttttcaagttatctgcataaaacaccaaaccagctacaacattcccttaaaccaaggcctacttcagagcaagctcctcattttcttcaactctatgaaggctgagagaggtaaggaagttgcagaagaaaactccgaagccagcagagactggttcataagatttaagaaaagaagccatctccataatataaaagttccaggtgaagcagcaaatgtcaatgtagaagctgcagcacgttctccagaacatctaagatcattgatgaagacggctacaataaacaacagattttccatgtagacaaaacagccttatgtaggaagaagatgccatctaggactttcataggaggaaagagggtaagtcaatgcttggcttaaaaacttcaaaggacagcctgactcctctattaggagctcatgcagctggtaacttttagtggaaaccaatgtttgtttaacattttgaaaatcctagggctcttaagaatgatgctaaatgcactctgcctgtgctgtctaagtggaaaaataaagtctggatgagaccacatctgtttacagcacggttaatgcagtattttaagcctactgttgagacctactgctaggaaaaaaagattcctttcaaaatattactgctcattgacaacacaggtggttacggaagagcttggacagagatgcttaaagagattaatgttgtcttcatgccagctaataaaatatccattctgcagcccatggatcaaggaataactcaaactttcaactcttataacttaataaatgcataagtctatagctttcataggtagggattcttcgatggacttggtcaaaataaattgaaaaaccttctggaaaggattatctttgctagatgccattaagaaaaattgtgcttcatgggaggaggtcaaaatttcaaaatgaataggagtttagaagaagttgattccaacactttacagttgagtttcaagaatataataagacttcagcagaggtacctgcagatgtggtagaaatagcgagaggtaaaattagaaggggaggctgaagacgtgactgaattgctgcaatctcatgataaaacttaacagatgaggaattgcttcttccagataagataggaaaatagtatgctgagatacaatctactcctggtaaagatgccataaacattgttgaaatgacaacaaaatatctagattattatagaaacctagttgataatgcagaagcatggtttgaaagaattgattcaaattttgaaagaattgctactccgagcaaaatgctgtcaaacggaattgaaacctagagataaatctttcatgaaaaaaagtccatagatgaggcaaaatatcaatatctcattttaagaaattttcacagctaccccagccttcagcaactaccatcttggtaagtcagcagccaccaacattgaggcaagagcttccagtagcaaaaagattatgactcactgaacgcttagataatttttagcatttttggcaacaaaatattttaaaattaaggtatgtacacattttagacataatactgttgcataaaggttacactactgtgtacacataattttcatatgcactaagccaacatattcctatgattcattttatagtctaaaactgaatctctgaggtatgcctgtgtttttatatataatgctttagacgtatttttttacaactaaaaattatcttgaaaaaacgtaggattctttcacttttgtcagctaattcataatttattatttggctaataaggaacttaactgatcatacatttttaaataaatatatacgtgatcaaactccacacttacctgaatgtttatatgtgctttgcccataattgctaaaatttggaagcgaccaaggtgccctgtaagaggtgagtgaataaactgtgggacatcctgacaatggactgtcaatattcagtgctaaaaagaaataagctatcaagccatgaaaagtcatggtggaatgtaaatcatatttctcagtaaaaaaaaagccaatctgaaaaggtacatactgcatgatccccaatcatatgacattctgggaaaacaggaagacagaagaaagatcagtggttgccagtgactgggggcagggagaagtaaacaccaagaaaacagggttttcattattttatttatttatttatttatttatttatttatttatttatttatttatttatggagagggagtctcactctgtctcccaggctagattgtagtggcaatcttggctcactgcaacctccgcctcctgggttcaagcgattttcctacctcccaagtagctgggatttacaggcgcgtaccaccgcacccagctaatttttgtatttttagtacagacggggtttccccatgttggccaggctggtcctgaactcctgacctcaggtgatccacaagcctcagcctcccacagtgctgggattacaagtgtgagccaccgcacccaacataaaatagaatctttaggacggtgaaaccactctgtatgatactataagggtggatacatgtcattatacacttgtccaaacccatggaatataccacaccatgaatgaaccctaacgtaagctgtacacatcagatggcgacgtatgagtgcaggtgcctgaatggaacaaacgcgccatgaatgaaccctaacgtaagctgtacacatccgacggcgatgtatgagtgcaggtacctggatggaacaaacgcgccatgaatgaaccctaacgtaagctgtacacatccgacagtgatgtatgagtgcaggtgcctggatggaacaaacgcgccatgaatgaaccctaacgtaagctgtacacatccgacggcgatgtacgagtgcaggtgcctggatggaacaaacgcgccatgcagcagggcaggtgttgctaaaaggggcggctacgtggagaggcagggggtgcgggaaactctatagtctgttcggttttgctgtcaacctaaaactactctaaaaaatagggtctattaaaaaaaaacaaaaagcacctggcatttactgtacaatgtgccagaaaaagaataagctttctgaaatcagaaagtgaggtactcgaaatgtgtaccatcctttgtcttttccatgaagtctgagaatcaggctggtaagaggctacacctagtgactatcttcagtaagatggcctgacgcttaacctttttttttcttttcgcagtttggaaactgtcagtagttaaccagaatgaaatctggcctcctttctactcccttttcccccttgagctttgttttttcttgctgccacattctagccaaggagaaaagacagacacgtcctcgaattatctgagtattattcatctcgatggttgctggaatggcttccaaggaccccctccatctcatggtcgtttctgtctgctttcctctcatctataatcccaaggaactcactcgaagcagcatgcgtggctggctggtgggatcctccttatacatcaccgtctgcctgtaccaacactgtcatcgcctcatgcttcataacaccgggacaccaggcaaaggagctcccaagctgaacctctgcctgccgcaaggtaaatacaagcaggaccgcatgctgcaatttcagggttatgatcgtcttaataaatgatgcactcaatgtgctataaatcatctccctccgaccaactctctcggcagcctattataatactcactgattgtgacagctaatagcagctacaataaatgatggcaatgattattttttacaaaggacttccagttagagaaaaggtgtgttaaaacgctgaagcgcccgcacttctgggtgccaaatagacagactgtatacctgacactggccttctctagtcagtaacttcatcacatagcttttagagaagtaagtttagatgtcaaatagatattcagaaacacaccaggcccattcagagaatgtcaggctcagaacgtatcctagaggacacctagttagaacatctcactttccaaacaaaagacagagactcagggcatgtcaaaaaccacaaaacaaagtagaggaaagacatttaaaactagagaaagaaattttcctggaaaagtcagggcaagtcaataggaaaaaaaaaaaaagcagtgtacaaaggacaagagcaggcacatgagaaatgacataggtaaaaaaaagtttttctcaagcctcttagtcatcagggaacaatgaagggtgtaacatcggccatatgattagacaaattataaggcttgtgtgtttgcaggtgtacagaatagtgaggaaacggcccttggcagactctcagtgggagcagaggggtgtgttggtacatttatgctggcaaatagctattaatattaaaaactaaatttttagcacatgctttgttccagcaactaaacttctgaaacatgcccttaagaaatgctcacatgtgaagaagttcgacctgtatggatgtttactgcagcaaacttaaaaatagaagctttgcaatctacccatctgacaaatgtctaacatccagaatctacaaagaacttaaagaaatttacaaaaaaaaaaaatcaaaaagtatacaaaggatatggacagtcacttctcaaaagaagacatttatgcagccagcaaacatatagaaaaaagctcatcatcactggtcactagagaaatgcaaaccaaaccaaaatgggataccatctcacgccagtaaaaatggcgatcatgaaaaagtaaggaaacaatagatgctggcaaggctgtggagacttaggaacacattttacactgttgatgggtgtgtaaattagttcaaccattgtggaagacagtgtggtgattgctcaaggatctagaactagaaataccatttgacccagcaatcccattactgggtatatgcccaaaggaatatgaatcgttctactataaagacacatgcacatgtatgtttattacagcactattcacaatagcaaagacttggaaccaacccaaatgctcaacaatgttagactggataaagaaatgtggcacatatacaccatggaatactatgcagccattaaaaaggatgagttcatttcctttggggggacatgggtgaagctggaagccatcattctcagcaaactaacacaagaacggcaaaccaaacaccacatgttctcactcataagtgggagttgaataatgagaacacacggacacagggaggggaacatcacacacagggacctgtcagtgggtggggacaagagaagggagatcattagggaacgtacctaatgcatgtcgggcttaaaacctagatgatggtttgataggtgcagcaaaccatcgtggcacacatatacctatgtaacaagcctgcacattctgcacatgtgtcctagaacttaaagtaaaattaaaaaaaaaatagaaacaaatggaaacaacccaaatctaaatgtcaacaggcaaattactaatcaaagtttggtacatccacagcagggaatgctaagtgaacattttttaaagaggttgatctactactgattttactgttttcagttagaaatcaagtcacaggatgatattgatgtgtcatggactgaatatctgtgtcagcccgaaaacccattggttaaactcgtaatcctcaatgtcctggtatttgtaggtggggtgcttgggaaataaccaagtttagatgaggccttaagggtgtagaccagaggataatagtagtgttcttctatctagggaggagaccaggacttctgctctgtctgtgctctgtgaggaacaaggaagcacacaagcacacacttgcaagccaggaagagagtcctcccagaaccacagtgggctggcagtctgatcacaaacttccagcctccaaacagtgggaaatgaacatccatggcattttgctacagcagcctgagctgagtaacaaaacgttctacgatgcaatttatgattttaaaactcctacacgtttgtgtatgtttctggagacacatctgaaagggttcgacaaagtacaggacagttgccggagtctggtaagggtagtgggagggtgagaggagctggggatggttaataggtatcaaaaaaattagtttaaaagaatgaataagacctagtatttgatagcacaatagggtgacggcagttgatgataatttaattgcacatttaaaaataacagagtataattggattatttgtaatacaaaggataaatgcttgaggggatggacaccccattatccatgatgtgaatactacacatcgcatgcctgtatcaaaacatctcacgtaccccataaatatatacacctattgtgtatccacaaaatttaaaataaaaaaaattaattggctgacagccatgactcctggggcataaaaaggatttggggtaaagaagggttttcaccttttattatatatacttcagtgttatttcaattttattgattacttagctataagataagattattttataaaatcagattcttacttagactaatgccaacatgctgaccgtatgcccatccaattgtttgttgagttttctctccttcctcctcctctctgtctcatccctgccagtcacttctcacacaaatgctagaagaagaaccaggagatcaattatttccaaatttctatatttggcatcttctggcgataagggataccaaaactggcgaccgggaggctttcaaatggcctgtggcctcacacttttgggtgccaaatagacagtctgtgtacctgccactggccttctctagtcagtaacttcatcacgtgacttttaaagaagtaagtttagatgccaaatacatattcagaaacactccaggctcatgcagagaatgtcaggctcagaatgtgtcttagaggacacctagttaaaacatgtcactttccaaacaaaagacagaagctcatgacatgccagaaatcacaaaacaaaggagggagaagtcttttaaaattacagaaacaaattttttctgttttattgtttatacaccatggaatttatttaggaattctgttcctatgtgcctgaaaatgtgtataataagaatacttttcttacatggtcatggacaaactatacatgaaacatgaaccttttgatggcttggtttattaaacatactagtttagtagtccaggaacaaaggagtttcttttctgactgggtctgtttgtcaaggtatttttattttattttttatttatttttatttttatttattatttatttttgggcagagtctcactctgttgtccaggctggagtgcaatggcacgatcttagctcacagcaacctctgcctctcgggttcaagcaattctcctgcctcagcctcccagctatctgggattacaggcacctgacaccacacccagctcgtttttgtatttttagtagagacaccgttccaccatgttggccaggctggtctcaaactcctgacctcagatgatccacccaccttggcctcccaaagggctgggattacaggcatgagtgtcaatgtatttttcattacagaattcacacgcccaccacaccggtcaagggcttctttgctatacttgcttctagttactttcctatttctcactataataatattaattgtaaccctgacagatttgttaatagaagtgaagcaattgtctaaaatgtaatcaatcttttatttttttttcaaaagagaagtaaatcatgtgcataaacacctagtttaaaaaaaaaaaaaagaagtgggaattcttaggaaactaagccaagattttctaatttcaaagttgaagagggttttcatcattctgacatacttcattctagaattatggcagcaaggataaaacagcattaatttgcacaaaattacaaaggtaatattacagtacatcacttattttctaattgtaacttagttccaaggctttgggggggacaaaaaaagcattcttttttcaatactccaagaaatttaaactattagaatgactctcagataccaactcatgaatcacacatcacactccctgattttatattaaatgattagtgaatttaaattttaataatgcttatgtatagatttactaaaatatttttaatcattaagaataattttaaatctataaactttattgtataactacatgttccttttaaaataaatttataaaatatatatcaatatcatagaaatataatattgtatcgtataggatatcagagatacttactacataatgtcgctaagttattttcctgacagacttgataagaatgacagtgactccaacaccgtgttaatgatagtctatttgctgacttttgtgagggaagtgcagttggtttgacttcgtacatttcttaagacctggttatttatagatttgctggtcataagacagctttgatgaccaaatattaagggatatttaacccaagaagaaataggatttactatatactcagtgccaacaatttgccaggctgtacaccaacatgatcccattaaatatgaacaacaaacctctgacgcagttagcaatagatccagggtggaaatgaagaaactaagagacacgtagattaagtaaactgtctaaaagagaaccagaaagtaccagccgcattttaaatacctgccagtcaccccgtgctttcccaatgtttggaggacatcgcatgccctacaaaattagggctcttctgcagagatggaggtgataagcctccaatcgccaaaccaaaccatgtgaggccaggaagggcagaccctcaggggctgcagctgggcatggctaaatgctgtaacccaggattttttcctagaagtaacactttctgtgaaaggggaagatttctggctcttatcaatggaagtcactgtcttccatcaaaaaaacaaatgatttaatctccccctccctctgtaacagagttcacagagaacagaaacttggtccacataaagaaaggcaactcctgaagaaactaatagctacgagaccctttaaggacacaaatccacgttaaattctaggctactgcaaagcagcactgtggctagacctacggtgataattggcaaagacgtgccactgagcttccagctttgacaaattacaatcagagactggaatttttctgtgtttaattattaaaagctttgatgctttcataatgccagtgagattggaaaacagaaaaatgatccatcagtacacaaaataggaagatgaagaatatttaggcagtccatgctgagatgttttttataactcggctacatgatggaagggttaggaattccttagagccaagttcacagttaatgacagaaacatgtagtaaatgatacaggctttgtagcttttagaatatattaggtcaacaaacattttccaggtcactatctggagcagatgcatgccaattagtaggctcagtgggagcctcacccatcccataacgtcctttattaattcttatctgggtgtgccacatatttcatttgctttactgtttcttaaatatatttggcctttaatgtttaaatatcattattgtgggtaaatcagtgcagttgaattgcttttagaagattcgggactgtgttttctttgatgattaacattgaaaatgtgaacttgtaacacatttaaagtgaggaaattcaacgttaatttctatggtttttatcacttttgaaaaaaagtcatttttcctttgatgataacattggaaatgggaactggtaacactcttaaagtgggaaaacctgatgataacttctatggttttatcacatttggaagaagtcacattgtagatcattagaattcaatgtgtttatgctgtgataatttactgatgatgaagtcagaagaacccaaaataaaatataatagagaactaagttcaagtgaggacctatagagaatgagaacacggaactttcaacgagatacacattccagggttgtatgtgattcctgaaatcagatttcacaatctcttacaaagaagtttcttatttgtcaattacaactcaaaaaagctggaaaaaagtttctgatgtacaggaaacaaagaataattaaaatattaatggattatctaacttttttttttctacattgcattccggaacgacattcccaacacacagacttctacgcacagaacaacgaagaaaaaaaagagaaagaaaaactattttctgcaagaagtcaagtgatgaatgttgtcctaaaacagtctgcggaggcgcaggggaggaagtgggggtgggcagtacgaccaggaggaagcttcagggctcctgggcaggggagtgtgaggcctgaggtcattaacagtaagcactgactggcaaattaataacatcaatttaaacagttataattccacaggatcctctatcaagctgattctaaatgagaaacttttctttacggatatgaaatgttttcttctccatatcaaaaaggagacaggggatttgtatttaatttttttccctttagtgtagaagggaggaaacccacgaagctgcagatggccactgtggacttctctccacggggtgaaatcaccaactgccccttgagtgtgtcttcaagtatcaaagccctgagaacttacagaagctttgtggccacctgcgcccggtagtggggaccatctggggtttcctgtgcctggcaccagcacgcacagccagacctcactggcaaggcccagtgtgaaagtgagggactaagtggctaatctggctggacttcctaggtcaatagggacttccctaagggggcttttccctaagccagaatgagtcacagctgcaaactaagggactgaaacttcaaccaatcatataggaagtttaagctctagttgcagcctgatgtttttaaccaatcaggcccaccaacccacaagcagatacaaaataaactaactctataggacagaaaaaggaaaagcggaggggttataaggagatataagcataagacacccaagccagaaacagcaactcttccgggtccccttccacctcttggaagttttactgtcgcttttgctttcctttcactttcataaatcttgccgccgcacactcttggggtccgcacgtttctctaattcagctgtaacactcgccgctgcagtccacggcttcattccttgaagccggtgagaccaggaacacttccatcgagaaaaaaacctttgatcaggagaagacttcttgtctcaaaaggaagataactcttggggccccaaaattactaaactaaagggaaaggtcgagctgggaactgcttagggccaacctgcctcccattctattcgaagtcacccctctgctcactgagataaatgcgaatctgactggcttctttggaaaagctaattagaaactctaaagagcgcaactgtttgtctctcacctacttgtgacctgcaggtcccctccctgctccagttgtcccacctttctggacgaaaccaatgcacatctttcatctgttgcttgatgtcccatgtctccctaaaatgaataaaaccaagctgcgccccggccgcactgggtacacgtcggccggacctcctgagactgtcaggggcgcgcagcctcaactttgttaaaaataaacattctaaattaactgagactgaaactgcctttgcagaattataactgaggaaattatgtcagtgacagaaatcagacctaaccaactctatgttgcttctaacctttaagttgtccttgttcattcctgggcataggctgaactaaatttgcgaaggaattcagttcacagtttgactctgaaacaaaattgtttacagcccttatcaactgatagagcccttatcaattgatcaattgataacagcccaagaagacccccatcttacctggtgtccagtctgctttgcaggactaacaaattagctacaagtttaggacttacggtttaggagacacgcagcctctggctccaagagtatgaaccttcccaaattgcttctggggatcacattactattgtaaaacctaagatctaagatcggtggttgtgatatgttgcagaccctgcactccatggatcagctgataccaccaagacttttaatctggcccgaccagttttgccattgcacccagaaacagaagacagcaagaaaaactcactttgaccccctgtgatttcatcttcaacctgaccagtcagcactacccacttcccaagcccccacccaccaaattaccattaaaaaccctgatccccaaatgctctgggagactgatttgagtaataataaaactccagtctcccacacgaccggctctgcatgaatcactctttcttcatagcaatgtccctgttgataaattggctctgtctgggcagggggcaaggtgaacccactgcatggttacgagacctgtctcagctattcagcattcacaccagaatggtgccaaacacccatcacaggacagcaccctagcgaagacacaaaccaacatagtaacatagatttcacttgcttaacctgtgcaccccacctccatgggcacactggaagcaggaggtctcccactgatggtcagtgctgcagggaggccactgatccacaattgtgggatggagactggggacgggccaccttctgctgtctttcatcaatttatactgcacatgtccttgaggctttctgtatttggttttcttctatctccttattagattctgagggtttattaatcattggttggttacttcactctcctggaagctgctcctctccgtttgaaaagccaacaaaaaaataaacatacaactcttttctcatagaaacaggcaacacttcattctggagatgtgtcctaacctggggtaggagatgtccaggacaagtaaagtggatgttggcaaagatcagtcccaggaccacagcatctgtctcctgggaatgggttagaacacaggctctcacgcccacacagactctgctggaagagaccctgcaggtgaggacctacactgtcaagctgatgctggtgcacattcgagtttgagagccactggcctacaaaatatatataccctggcctccaaaatcatagttcaagttttagccaaaaatcagtcaatctcctgtgattttttttaacaatcctagttatctgattcacccagagaaatgcttctctgatccatctttgcatctgctgcagaaacaaaggatatttaaagttcctgctatccctggaggtggctgtccggccccctccaggatcaaacccatggccttacggaaagcttctaacactacaggccccgctccaggttattctcatgcggctccctctgcttttcagatttcttattctagacttctttctttctggcagtacaagcctctcccttccttctttatccttcagcttcagccacctgaaaaaaaatctccaatctggaaaatctaaaccaaccaccttttctgaaaggacacagttttccaagcattaatgaaaaaaaaaaaaaaaaaaaaaaaaaagaaaatcataaaaactaacttcaactgcagacttctccctccaccagaaaccctttggttttcctagtcagttttccttcctttccacagagggattttctaattgtttctactttcccacaccacatacaacacccaaagtacctgtatgcatattagaaccactcaccccctttacttagactacttataaggaagatattaaataataggcagtcatgatgaataaatttaagaaaggtatattcagcatttactatgtgccagctaccaagtcttgacatatattgtctcatttaatctttactctgaagtagatggtatttgtactatcattatttatcattcttattattattgttactgttttgcagatgaagaaacccagacactgccagcaaatggtgaaggcagaattaaattcaggtactctgactccagagcatgcacagttaaacactattctgtcttgcaaagccttgtgatattggtaaatgccactgctttgggaaagggatgctgtcacttgagcaagtaccacattttatattcttcaggtgatttataacatctcaagagcagtggacaagacctcaaaatggttcctcaacagtcttcacatgcatctggcaaacactgtcaggccagcactcccacccccacctctggagaaaagtttgcactcttggtcggggacccctgcggaaaaagtgccctgagaaaacagcagctcctccttgaaaggcatgtttctgcatggctgacaggtgcaatcccgtggaggaatgcatgagtaagaatgatctgagaagactcgtgaattactacaaattagggtcagtttttaatgaggagacaagaacgtgaaccaagtaaaaacttatgtggatggtaaacagtaccttcgatttggaactaaaacatctgtgatgactctattgggaaagttgcaagacaactatgaatgcacatatgccattccacatgctctccaaggtttaaaatttaaaacaaccaaacaaacaaacacattgcttactcaaaccccctcctatattctatttttacagataacacatctcatctcttttagcttatctccaaaccttcaaagaccattgttacaaagcccatgcttgctttttcctcttgaagctttagctctccacatggaaatatgtcttctttctttcatcccataccccacaacctcacgcccacacactgtccactcatccttgctggatacttatactttcatcccacacaccacagcctcacacccacacaccatcaactcatccttgctggatacttatatcctagtgcaagtagggtaagtttcgggattcatgtcattattggtaagtgttacaggctctgtgcatgcgctgtatcatgaatatttctgtctcgtacaactcatattgttttaagaattcctgttttagccgggcatggtggcatgtgcctgtagtcccagctacttgggaagctgaggcaggagagttgcttgaacccgggagtcagaggctgcagtaagccgagatcgcgccactgcactccagcgtggttacagagtgagagtccaactcaaaaaaaaaaaaaaaaaacaaaacaaaaaaaacagaatttttattgttgttgttgcttttgtttcatctgtacttatcaccaacacatccccaacctcttcttccactttcaacatctacacttaatatgttcaaattcagcagattcctatcaatttcctcttctgaggatgtctcctggggagccttcagatctgctgtcaacaaaactagcacagtcattatcttctccctcttttcatgtggagcctgggaattcattttttgaaccttcttgaatgcattcccagtttccttgaccacctccacccccaacacaccatgttctcctttcttggctaatttcctcttttaggtagatgtactgagacaggtgcatgggagataaaaattgtgaagttttgtattgtgaaaaagtctaggagtaaatgacattttgccagggcataggaatccgattttgagattggattccatcagaatattttaggttatttactttacgttttttattattattattattactgacctactctgacttgtttcctctctggaaatttggtaggatattctcttttgtcccaatgttctgaaatcacctaatgacattttgttatacaagtccattttcattcagtattcagttttcttgggccctttcaatctggaaataaccatcctggaaaatttcttcaacaatttaattttctccatttgttactccaactttattttctaagttgtctctgacaccttttctttcctagatggttcctgctttttcatagcattctgttcttgttttgtgaatataatatatccttttacttctcaggtaattttaacaattatatatttaagttcttatatcttgcaaattttcagtttcttcccagttgctttaccctatgtgtttattgggaattttgcctttcttgtcagaagatttttatggcagtctgcttatattagaagaaaatgatcgaacctcctgagtgtgtgtgtgagaggagggctagggctgctccatcaccatggagtcactgtcagtaaatcaagcttgcttattttactgaaaaagacccaacatcttttccttagttctttctttctcttgagtggctcagggtccctcactttcttcttgtcagtctagtatgtaagtttggagagccaaggatgtctatattcatgcaaacgattagtttaacatctttattctggtataatccccaaatatgcctaaggtcttctattccaaagacccccagtaatggaagtggaatttgatcctaattccttgtaaaatatacttttgatcaacttttttactctgcctcaccgtcatcctcagtttagtgcaaaaatttctggttctgccaattgctgaagcttttgagtgtaccctgaggcgagttgatttgattcttggctttctgaagttttgcattaggattcttctttcctggttcttttaaatcaattaccactgaccttatgttttctaacttgcaaaattgtattacgctcttgtcttctaccatttaatttgtccttgtgaacttgtgactttgaagtaatcattttgtgattataatgtaattttagtggaattttggaggggagtagataacacatgaaagtattttgtctatcaactcaaaggaagattttgaggtggttaacatttttctttgtaacaaaatctgtcaatgcttacaaattatatatttgtatatataatattgtactatgtgctatattatatatatattatttaacttagaaagagtgttcatatgctgagataggtagaacaatgcattggatggacggattaattattcaggctttctgaatatcatatctaatctataaaatagaaaacattatactttggtcttaaaagtctctccctgctgttggaatctagcattaatgactccactggctcaagcgtgattggatttgtcctaatcctttttagaaatgcctcagagaagtgtgatttctaactgctgttaaaaggagaaccactgcttattcatttacaagttataatcataatgtagattttagacaaaagactgagagtagtacatcaaaagacttcatagttaaatagagacgccatttctataagtatacggcatgtggtgtggctgagtacagaaaggtaggagatgaactgtaggaactgaagaggctgaatctacacagagcttcctgtaatgtgaggtctgactgtgctttcatcttccacttggtgacacctacacgctcctcaaaataatattctaatcacatcccttaagccttccttgagctatttgtaccacctctctctcaactacccctgaggtcaaatatacgattaaacttcttaaaaaataaaagtttgaaaccaaatattttccccttggatattcactaaacattatgtttaatatcaacgcattttgtctttaactgtagaaaatatttttctcatatattgataaactgcatagtccctaatgcttagttttacacttgagaataggtacagcttcttgactagttctcaagtaaataaaacttaaaatgttagatagacttcatttattgcatcccttgcaaaaaatatactatcagaacaatgcagttgttatcaagattaaattagtatacaaatgtgacttttttttttttttttttttttttgagacggagtctcgctctgtcacccaggctggactgcagtggtgcgatcccggctcactgcaagctccatctcccaggttcacgccattctcctgccttagtctcccatgtagctgggactacaggtgcccgcaaccacacctggctacttttttggtattttttagtagagaccggctttcaccatgttagccaggatggtctcgatctcctgacctcgtgatccctgtgactatttctatcagaatcccttcttgatggcataacaaaggtaaaagcaaagcattatagattcttcaaaaacaggtaaagaatcacatatggatccccaaagtctgtcttgacagtaagaacgacatttctacagatcagctgttgcctgtttgtttatgcgggtaaaatttgtcatggatttttttttttttttttttttttcacggggtagtaatacccctttctaacatctagcactgctggattatgaaaattttatccaaggtgatgtttattctctgaaggtaaactcagactgagcaagacacaaaggagaatataaatgtccttttctgtatttcttgtagaatacatcttgactttgtgcctattctctagtatggtgtctgaaaatgatgtttacccatagaaactatttttatttaaaggaacaaaattccatttaacttttactttaacaggaacatgggtagtataatacattttattaggcattcccctgtttctgggtataattttaaaatgcaaagggggcaataaataaggccctttgtgctatagcatacatcatcaatggctgataattcattccagcacagtgtttggcattcattctaagccaaataaatattctatcttcacaactcatgacaaacctgatgagcctcgcaactcaatgtggggcttccacgcacttccgctgtcatgtgtgaatcaaaatgttgcagagatagtgttgatgttctctacaatccgtttaaaaagacacaaactgtgtgtgaatgtaaagaagaattgatataaatgcagatgatagacagtttgtagctcaagacaactaggatatatgaaatttattctatttctagaaagattatcttttattaacaaatcctgaagactatggtaaaagtcatttatttatttatttatttttgagatggagtctcgctctgttatccaggctgcagtgcagtggcgcgatctcggctcactgcaacctccgactcccgggttaaagcgattcttttctgcctcagcctcttgagtagttgggactacaggtgtacgccaccatgcccggataatttttctgtatttttagtagagaaggggtttcaccatattggccaggctggtctcaaactcctggccttgtgatctgcccacctcatcctcccaaagtgctgggattacagacatgagtcaccatgcccagctggtaaacatctaataatattattaagcaaagacttcaataaaactgatttgcttaaaagtctaagtttatactggaatgaggacaaataatgatagacttctcagcatggtaagcacttcacaaagcttaataaagtgacactttataacatatataccttcacacctctgtgacgtgttcctaacataaatttaaataaatgttatcatttaccttatttttctttcagccccaaatcagctagtatagaagaaaagcctgccctgcaattattcctcatattctacttttccttctcctcctcatggtataagggttttgtaggaaagccgtgcattaacgccgatatgtgtaataaacacatctttcatgctaagcattgtactagcaatgcgaagaggaaaactctaaaatctccatgtaagtgtagggaaaatatgtacaaacatttttacaccataatacataaagtgtaatctcaagactgtttatggttatggttttttttattattttatatccctgataatctgatttaaatatatcccttatctatagccatgccactctgaccatgcctgatctcctctgaaacacacacctgctttgcaatcagggttacacatataaagacaggaaattttttataagaaatcttgtaaacatagttatccagggaaacagaataaaatcttgatgttttctttttcaggtcatgcaaacaaacatttttaaacttcggttttcttatccataaaagaagagaaataatacttcagtatacatttttttaaacatttaaatgagattagctattaataaagattaattgctattattataagattatcaactcaacatcaatattgctggtataagaatatcaaattttcttttatgatttaatgacattgaaactcatgtgtatgtttgactatttaaaattaaagttgaaggaaagtcactgtccttacacgctgaattgtgtctccccagagttcgtatgctgatatattaaatgccattgccacaaaatgtgactgtatttgaggataaagcctttaggttggtgattaagctataaagacatctttaaggtgggtcctcatccatgacgatttttattcttatatgaagaaatcgggacacagaaaggcacaaagggatgacctttgaagacagagggagaagacaggtgtctacaagccaaagagaaagacctgaggagataccaaacctgctatcactttgatctccgacttccagcctccagaactgtgagaagataactcttgttgtttaagccacctagtctgtggcacattgttatggcagccctaaggaatgcatacaacttccaacaaacacacctacacacgtgctacctgattctctgattctacctttaaaatatatctagaatcattcaaattttccatccctaccgcctttgatttctgtgaaccacaccacttacctcttactacaagagtctcctcctgacattcatgtctccaatataccccttctgagccattctcaacacggcatcatgagtgatttattttaacacaaattttgtccttggccttggctgttgaaaatcgtttgatagcttccaattgctcctagaataaagttacacaaattgctcggaaggctttcaattatctagtttttgctaaactcttcatctcattcctcaaccaacacatctgttgtatactaggcaggctcagcttagtgtctgggttctcttctgcctctagaatttttattgattattttgtgagaggatagacccctttcttaaactcttagcacagtgagttcacatagaatgaaaaaaaattcttccataataaataattgcataaatgttcttgacgcacacaaaatattgtcatattctggtacaatcactataaaattttcattagacaggcttccatttatcacttcaggaccaacaatgttgagaattaagctgtcccatgggaatatatttattcatgtctaatgccttccttaacaaccattagaaggagggaaggaagacagaagaaaggaagaaaggagggaggagcgaaggaaggggaaagaaggaaggaagggaaaggagggaaggaaggggaaagtgggaaagagggggaaggaaggggaaagagggaaagagggggaaggaaggggaaggagggaaggacggaaattatcagaagcaaaatgaatataacttacacactaaatatccccacatataaaaccaaagctttaggaaagcctgagaaaaaacagttatgtttcagattggaaacaaatattaaataagaagaaatgagttttgattcttaaaatatcaagaggaaaatttagtttgcactgttaatagttcaaagatgtttgggataatatatgaagaagaaaccaaaatatttggatattttgcttattagtcaggatattattattgtaataatataattcagtcaccaatttatcatttaaagaattgctgtgtaaactagaaagagaaactgattaatgataggaataaaaatctagttaatatccatttttaaacaatgggatagatgtaactacaaattggcatttttttaaatctaataagaaaaatgttctgataaattgcaatgatttgggatgttttatttagcatatgttagttttccctggattgggctttctaaactattggtgttaagtcaaatactgtggaagtcctagtcattttcatcacaaattgaattcaatttcaaaaaatattatgggtaaaaaccaaagaagaattttaaatggcacttggcaagagaaaaaaaatgaactgactcagcaaaaggacttcctttgaaggaaactttccaaaggacctctcaaaaagaactgctataactatactgttttcttagaaaagatacgatatacacaaaagaacagctatgtgaacacaaaaattgatcacatatatagaaatgaactattgaaccagacttgacagattgtaacttgaacacagtcaggaacacacagggaccatctttttttagcttccagattttatcactatcttgatctgttagtgataataaaatattcatcgctgagcacaaatgaagctgcctgcctgcaacttgactggagggtcccttgaaataaataacataaaactggttctcagcaagcatcccttttgaaaaatgcctctgtgtgttagcaaaccaaagaactggatgctattatattactgtccactacagcaatagcaaacatgctcttcaatgactctcagcaaaagatgcaaaatgcctctaatttacagtatttcagaagatgccaattccagccagcaagagaggttgaatatatttccataaaaatagtgagacagcattttccttttttcctcttattgtctcacaagtgtgctgtgagtcttcagagactacgtaacatcttatgtagccatcaagccaacggctcttgaaaggtgtgcatgtgaattatttgacttttataatgattagtttgttggactcaataatttgtaagattgtgaagggatcctgacatccaaatgtttgacaaactctaggtttgctttgtgattatttacgaatttcagagaacagaaacttaacaaagaaaacagtcacagccactctttctcccaagtactagattaaaatatcatcaaaaccaatattcagcctatatcaatgaaacaaataaatgtgggcacagtgagaaaccaagcagctgtgtatttttacaacatgatcacagttggttggcttttcgggctctaacttcctttgctacttcccttagttgtctgcttattttgggagaattttcaaaatgtggaacagagaataagccattcataacagatgctgtaaataggttatccatttcctcctacctaatagcattagcctcatcttgcctggaaacagttgcctttaattaattctccatgatgcctcttttctggtagctatgagaaattgataaagaaacatggtctaattttaatcaaaataggacgtgtcagtggcactcaggctaaccttgcaggctaactcagacatgttgaatagagaatgcaaacttcttatgctaaatagattaatgaagaacagaaaacaaaagttatcgcttgtgtttaataatgaaattaaatatattgtcaaaatagagagtattttaaaaggtaattttcactacagaatataacattgtttttccttttaaaaatattatggtagtgtttaatattccatttgtattatgttttctttgatggttacaagatttgatgttaatggaactggttggtttgtaagatacaaaaaagacaactgttaattgatcacatttttataagcagtttcaatataaattcatactgaaagtaacttcttatatagctgtaagacaagagatcacatcgataaagatactgtatttcacgatgttgtattttatataaaattacactttcctaaatttctcaaggaaaatctaagccttataatccaaattaattttccccttacattatgtcagaaactcagttagtgttattttaccttttggatgccttacattattttttttaattaatttatttatttacttgagatgaagtctcgctctgtcgcccaggttggagtgcagtggcgcaatctcggctcactgcaacctccatctcctcggttcacgccattctcccgcctcagcctccagagtagctgcgactagaggcgcccgccaccatgcccggctaatttttttttttttttttttttttttttttttttttttttttttgtattttttagtagagacgcggtttcaccgtgttacccaggatggtctcaatctcctgacctcatgatcctcccacctgggcctcccaaagtgctgggattacaggcgcagccttacattttttttttttttttttttcaggtctctaactgatgggttttccttttctcctggctatgccataaactaaatggcaagatgcaggtttcagaatcatacacttcagagttgagatttacacatttgagttgtggcaaagctggggcaaggagtcagtgttctgatacctgctctggcactttgcctccttacgtccagttctgagctctcagcctcaaaaacaccttctatcaaaaaaacacagaacgcaggaggaaatgcctacaagtgccttcattccatccactaaaaatgtacaaaatctcaggagacatattttgaggaaagtgatggctattttatctaagaaagaatcccctggatcagatcctagattcttagaaattcaagaaagcaaaacaaaaaaaattaaacaaaggaaaaaacatctcttaaggttgacttttcaaagtattatttctatttttcaaagttaaattgtaatgaattcaatatttcttcattttttaagtgccaatttaactagaggaaaaatactaaaccaactagttatctttaattatcagaatacactatgaacagtggctttcatttaatggtatttttttgcccctgaggcaaattctatagagaataaagttaatatattgtgaattatttaataggaaggttaatttatatttaatacaaataatttaatccagtcctgcaagcttctatttatttggaatattaacaaacattgtcgaacactcgccatgcatctttcctgagctgtgggttgactgtacggccacatgcagaaaggacatatgctgcatgtttcagcacctgagacagacttggggccaccaaaaacagagcaacaatgtcttttaccgaccacaacacagctacacatgaagacccctgtgattctaatcctggacccatttcctactggttttatcacatgaaaccctttacttaaactgtttcagtttcagtatcttcctggaaaataagagtgtcctagtggtgctttaaaggcgaatttagcttcattatgcatcagtgtaaagtgttgcataattggcaccctgtgtcttacagctgtcgttatacttatacgaaaatttattacaaacgtaatgaaaattttttgaccaggtagagggtatcacagtggtgtttgagctgcttttaagtgaacattgctgtgctaagcactggaggtaaagaacgaaggaagactctatgcctgccctggaggcgtggacagtccagtgaggaaggtggcgtggatgaatggtctgcattcagtgttgtggatctcaggggagtggcactcatcctgcacgacgatctgcatatagctccctgagctgcctatggaactgagtgggcatcaaggggacaaggagcagaggaagggcatttggaatagtgggaccagcagatgcaagggcaaagggatgccaaacagtgccatttgcaaatgttagaatgatgattttggtgggaagccccgagtgatgcttgagtagatgagtacaaagaacccagcagggcacaatcacttagatgtttgcacactgagctcagtgttctacaggcttactggacattccacagagggccttggagcagaagaacaaagtgatcagatggaaattttagatcagcatgttcatcagaagcaagggtggaagggaggacacctcatcttcagaggatggataaaaggaagtgtggatggcagcaagggcaggtgaaactatgtttatgtgggcaggggttgcaggtaggaggtaaatagttctccctgacctcaatttgcctggaaggatagaagacacatttgattattaaaaataagacaatagccaggtacagttactcatgcctatagtcctaacacttttggaggtgaaggcgggaggattccttgagcccaggggtttgcgaccagcctgagcaacatagcaaaaacccgtatctaaaaccacaaaacaaataaacaaaaattcatctggatatgaaggctcagcctgtcatctagcactttgggaagctaaggcgggtggatcacttgaggtcaggagtttgagaccagcctgacaaacatggtgaaatcccatctctactaaaacaatacaaaattagctgggaatggtggcacatgcctgtaatcccagctacttcggagcctgaagcaggagaattgcttgaacctgggaagtggaggttgccgtgagccaagatcaaacatttgcactccagtataagcaacaaaatccatctcaaaaacaaacaaacaaacaaacaaaaattagctgagtgtggtggtgtgcacctgtagtctcagctactagggaggctaaggtgggaagactgcttgaacccaagaggtcaaggctgcagtgagccatgattgcgccactgcactccaggctgggcaacagagcaagaccctgtctcaattaaaaataataataatagagtagaaaacccatggatggtgttctggacaatctgtaagtcttccccactctaagtatcttcatctcctcccctccagctttgctctcccctagggtggttttgattttctaagcgtgtaaatgggctcagcaccctcactccaggtttcaaatcaaatctctgcccaagagggcatttgggagattgctgatcgccaatgcacaggctcagtagggccgacttactgctaacaaaaacttcaacaccaacaacaaaaagtcctcgtatctcaataaatgggaagaaaacataaaagatttaggcagacagaaagacaggtaatattccttacaaacattgccgtttcatctatttagttctaacaaattataaaatatcccccaaatctacaaacttcccattttcagatctcataggtctcacttacctatgtttcctccaagagagctccaataagtaacagaacgtgtctctcacagtttcaaaaaattattcccagccttgtgatctatcagaaagactggaaaccttcacatttacaagatactgaagaataagcttgatgctgaaattccagcgaccttcaggtagtgaaaaatccgtaattcccaagatggaaattaaggggaaatgaagctactactgttcagagaagtatgctcatgaagcttgtatgctccaagaataccaagaagctaaagaaagatttggctaaacaaaggaaacacagtgatacctatcatttagatagcatttcacggtttaacactgcttttgtatacaatatgccatttggtcttcacaataatcctgagagttattcgctacattttcacacatgtacaaacaaaggggttaagaagctcttacaaacctgtacagaacgagtaactgtactaagaaatggagttgtaacgattcctccactatattttcaccctaattcacaagttttttaaatctccagatctctaaacttctccagaaattgcttaaattttggagagcaggcaattctgatctaataatcttgcaactaaaaacggatacagtgattcatcccatgccatcgacaatacacagaagtgaaacatattgtgaactctattttacaatgactaactgaacatataattcatcatttatcgtgactaacagtaccatttagatattgagagtaccaatcctacaaggaggaaagaaaacatgagaacttcttagagtgtgatatttgctatgctatccaaaataacatcatggtgttaatttgtttataaattatgacattaaatttctctcaacttatatattcaatgatgttccaaaacttctatattcaaagatgttttaaatgtttgaatatataagttgaaaaaaaaataactccatactggaacattccctaatgtttgaagcaacatttgttagcagatatccacatatgtaaaacatatgttaaaaatgatactggtgaataccatcatgactcaagataatcaccagattaaaacattttttatatttagccaaattatagtgatacttaatttactaatacaacagggttttccttctactcttggtataaggtaatgtttcatgctcccaaagatttgctatctttatccacctcattagcctactctacgaggttatgatatttggctgtaggcaaatattagaggcctcagggagaggacagttttctttgggtcaatatttctgcctgctaccataacagaactagtttccctctactcctctgagaataatctaccttgttatttgctaaattcacaagctcgtgaaaaaggagctgttctagatgaattctaagtttagcaacatgttcagacactaaaatgaccatttttattatatggtagaaaaacacgtttttttcaattgctagcttagcagcactggctctgtatttaattgcaaatgagagagaaaacagtaactgattctggccgtggcttctttgcagttattgggtggctgaggtttagggcattcctagaggccagacctgacacaacgtgagattacattgaacttgccaatcacttcattagtgcaaaacaggcttcaacaaagtctcgtatttatttttaaaagcctaacagaggaaaatgatttcttaaattgttgtgctgtttctaatatcatcatttgataatatgattagtagctgacaacacaataggagaaattatttttaggtcatatgttgaagtatttgcatcataaacagaaatacccagaaactatcagatgcttagttttcaaactgattgaaaaaaaaaaaatgctctccatttaggaactagtgtccaattccaacccaatcacacaaacaaaatgaacacaatgaagcaagtttagtgacatgatatcttcatctattaacttgggaaactatggaggattggaattagcatttctagagaaacaaatgcactagcaaatgtgagtgttcaaaacaggtaagtgctgagaatgtttccctgtccacagaacggtgtggtctaaaccctcttatagggttagcactatctttttccatttgtcctcaaagaaatttctccttcaggccacagctttgtagtattgctttttatttccagttcttcaaatctgattcatgggctgctgaaatataatgacgtcttatcccttttttttttttttttgctacagactaagttaattaggtggaacccaggctgaaagttcggatacctttggtaaatttgttttattacaggaggtgtttaatatatggctcatagttaaagctggttaaactaaagaagaagttgatattaagtttatatcaaatctatattgtatacttgtaaggcttagatatgacccacagttgtcaacccctttaactagttgtgatgcccatggcactctgagggtacacctgataccggaaggagagcattgactgtgagttctccaggttcttggcatttagaataattggataagatacacaaagtaacaaaggaaagaaacataggaaggaagctgtgaaaggggggatttattaaagccagaaagcacttcacagggtgggagggggcccaagcaagctgttccagggcctagttacacagttttctgggatttaagtacttattttgaggtccctctcagttaccccttatctggatgaagaatttggtccctggctaattaaaggctggggtgaattggcccgtgttgcagatgaagggatggccagtgcttggcccatagccaatccaaggcactctccctttccatctgagacacggtggaaggaggagggctatagagaaagcagcctttgatcctttgttgttaggaaatggggagacggaagtttttcctttccattaactttagaaagtttgagttaattgggcttaggttccctgcccccagacccagatgtttcccttctgatacagctttgggaagacagcacgaattggccttagacctcctgcccctagatcttgggcttcttccttgattcagcacaaactggccgtaagttccctgcctcaagaccttattctgcctcacactcaccccacttaaacaggataccccacttaaacatgtcctggccatattcattctacttctcttctttcttctgtaattttctgataagggtgtgtttttagaacttaatttatcttttctgttttgccaggaaaaatctgaagtgaagaatcacatttctctagtttcaactgctccatgagcatatcccattctgcaaatggatatccgcttgagggctccagtctaaatgcttcacctcattaccccttccctccagaatctggttagagtctcctaattgttatctggattgctcagctactgttaagtcataaaagaggtgaagacaagcttgttcttgtttgtctggagcttctttttatcaggagataatcagcaggacctctatgtcccgactgtgcggttttacatactcggcaaagagtggagatttcctcattgacctcttccaactttctagagacttctcagacataggagaacaggaatgatggatttaccaggttgtcagtaagagttgcatcaccaaaaagcaacattcgcaatcattcacaatgcagggaaccaggggaattgtgtccctgggagaagctgaaatagaactaaaaaataggctttcagactctatcagtgagtggagtgaagcagagaccccagaaatcatttctaacttgaaaacagaagggaggatagcatttgtttcataaaacgttctctactttatataaataataattatcttctacttttccgcttttaaaatatttttaaatgtttctaaaatacaaagatttaaggatgttaaaaatgtaacttggttaagaatataattacatggcgcagatataatagtttagacacatgtaataaaaggcacgaacccattcattcaattactaaaacactagtacgtgtttatattgagtacagatcctcttttccaaataggacattcatgacctggacaggtataactggaacttgtagagttagacttccaatgctttcttgttgagaactttatggtactcaccattttttgaggaaaaaaatgatccaatatgtcagaaagatctggaaaaatgtcccaaacattatatactatagtcttctttgggcaattgtgacttaatctgggaaaagtgacttaatctacaggttactatatattttttgtattgaaatatatacggtaaactagacggcatgtgagccctgtcaccctcaaacattgtcatcttgaatcccattcagaatttctttattattacattgttattattttttgtggagagacggtctcaccatgttgcatgggctagtgtcaaagtcctcggctcaagcgatcctgcccacttggcctctcaaagtgctgggattacagcctcacaacaccacacctggccacattccgcatttcttaatgaagaacatatatttgacttgtcccaaggaaccaaagtcaacactgattccctgcaggttctgcgtcagctcgcaccatgaagagtttttctgtatgaggaatgcaagggttggaatggcttccaggaagcagagccgttcacaccagctttgaatttgttgagttttcaaaatcatgtcttgctcaatgctcatcccttggcacatgattggccccattgtttgtaagactgaccacgctgtttcttgttaccgctgtcatttgtagacagggtgcaaattttgtaccctgcactaactaggtattcaaaaaaaatctgttggggagtgaacacttagcaacattgcagacacttgagggaggcaattgcatgtatctgcctcccacacaccaacataatggcagtcggtgaggaattcagagcctacatatgatgggtgacatataatccagcctcatactccgctggccaagtcgattctcaaaaaaagggtgatatcgtttggaaacatgaacttggagaaaacctctcccaggaccctcatccactcgaggcagtaattcgcgtagtgcagtcggcacagtgccatagcctctgcttggtgtctgacacatccaaagcaggtggattcattctgataagcttcagcccaacatcgacttgcagagctggcaattcggggttgataatgtggcacagcagactccaaagacgtgtacccaggatgtgtctcagcagtaagtgtagagttaacaatgttgaaaaggctgtttacccagttcctcagacgttgtgatgtgcacagtgtgtgttctctggttaaaacaccacaactccagggaaggaagctccattattatctgtctaaatgtttatatggacacatttttttttttttttttttttttttttttttttttgagacagagtctcgatccgtcccccaggctggagcgcagtggtgtgatctggactcactgcaagctccacctcccgagttcacgccattctcctgcctcagcctccagaggagctgggactacaggcgcccggcaccagactcgactaattttttgtatttttagtagagacgagtttcaccgtgttaggcaggatagtctcgatctcctgacctcgtgatccgcccgcctcagcctcccaaagtgccggcgtgattacatgtgtgagccaccgcaccggccagacacactgaactttaaggaagtcaactcacctcaccggcatcaggcatcttcatcaggtaagagctccgccagcacttcctgtccatccactcagaggccaggagagtcagagatcgggggttttctgggcttttccttcaccctcctgccctaactccagctgtcctcactccaatgactgtttagaaccatcccctcctgaccaatctcttcctcagttaccctcacatgattcttcttctactctccccccctgcccccaccaccaggcaacactccctcacacaactactgaaaaagaaagcacgcatgatttgactgctgcctacctcgaatccttcagcggctcctcctcacctgcgtaattccatacaaagttcccagcggggaaggggaagccttctgtatgctcacctgtctattgcgccccacccttcttccctcagtcctcagtggctgtgctctcctccacactgccttccccacatgctgccctgtctagaatggcttttccacctaccttctggaaagtcccacgcctcatttcaataccctacatgattgcctttgtgctcccaccacaatctgttcctgtctccattagagccctcctccttaggcattttaattagtcatgtataaacctgtttctggataatgataatgaccctaataaataatatcggttccctaatgcagctggacatgtggcatgtagtgcatgaaggttactctgagtgctggctcatgggaaccccattctttgaaatatctgacatcaccatggtcaggtttcagatgcagacactgaagctcacctaggttaacaacccccggcaagccatggacttgccatgtgagatcagagcctgacccaatgtgccgactccaaagccgggcaggaagacacatcatcagaaagacttctctggtctggaaatggtagctgagcttcatggaatcaggggctgcatgtgattcttctcaaagcctcggaggctcctgcagcacaaactctggggtgcaccaggtagaaacccacagaagatgcaccaaagccctgagtagaggttaggtcttaaaaccacgggttccatgattgtttcccatagtctgttctatgacctttacggtaaagaaatatacaagcaggaggaagacttttctcttgaaaaacataacacagatggcatctttgatgcgcgtgacatgctctgggtgaagctcaacttagagtcaataacagctcctgcctaagtcagctgggaccactataactaactgtaagttataagttgctatagactgggcaactttaaaacaaaatgaaaaactcagcaaactatcacaaggacaaaaaaccaaacaccacatgttctcactcataggtgggaattgaacaatgagaacacatagacagaggaagggaaacatcacacaccggtgcctgttgtggggtggggggagggcggaggaatagcattaggagatatacctaatgttaaatgatgagttaattcctgcagcacaccaacatggcacatgtatacatatgtaacgaacctgcacattgtgcacatgtaccctaaaacttaaagtataattaaaaaaaaaaacgcattggctacttggagttctggaggctgagacattcaagctctaggagaccagctgtctggtctggtgagagccttgtgtgtagacagtagctgctcctggaatcctcaccttgtggatggcagagagaggagcgtgccctcgtgtctcttctagtaagggcactcagcccacagcgagggctccactctcatcacctccttgcctcctaaaggctccacatcctaatgccatcaccctgagtttagaatttcaacaggtgcattgggaagggatgtcatgattcagtccctcatgctgcctttggcttgtgtcctgggaaagatggcacatggtcgagagacacagcctgcattccattcccaacatagttcaccatcatctgcacttttcagactacctaacttcacctgtaattaaacatttcatattaacttttttttttttttgagatggagtttcactcttgttgcccaggctggagtgcagtggcacaatctttgctcactgcaacctccacctcccaggttcaagcgattctcctgcctcagcctcccaagtagctgggattacaggcgtgtaccaccacacccagctaatttttctatttttagtagagacagggttttcccatgttggctaggctggtctcgaactcctgacctcaggtgatccgtccacctcggcctcccaaactgctgagataacaggcataagccactatgcccagcccgtaattttcatattcctaaaaaaagtaaagataagctttcacatattcactgagaatttttaaaacatcactccagtttgcatttctaaaaagatacactttggtataataaaaccaatatatcttaggtggtaactgccatagctctgagcaatatttgaacggtatttctacataagggccaataaaaggaaatcttccaatatatttgaaggattactctatctggaatcttgactgtaaatactcagggaactaccatttcaatactaaccaaaaatatttaattctaagtacagatcaaaatccgaaccagatttatgctaaaagggaaataaacaactggtccttctgtctgtagaatcatcctagctcaacacctacagaatggaggatgctaagtgctacactgaaggaataaacaatgctgagtgatgctgagctccaacagaaacattttccaaataacctcaactccaagcatccagccaggccttgctggatgtgtcgtagttgcttcagggaaggtcacttgagaatttcctattaaaataccactttaattggttcattctctttataaattaaatgcataatgattatttgtaagctgacccaggtccactctaatgttcagtaatctacctcttggtgttttgttaaattgtgaacaacaggaaattctgtgatgtggtacacaaagttcagcactgtcacagagaagtcagagagactgatggatgcctttaaaatatcctcaacgctgcacgtaaaaggcacgtgttgctgtgggtgaagaagttaatgtaagtaaaatgaactcgtttgttttttaagggagtgtattttccacattgtgtattttaaggaataaactgtgatatcttgaggatagacaaaatccaggtatgtcctgaggcatctgtcttgtagtcacaggatcggccccaggaaaacagggccatttttccatcatgcacctccctccagcctgcattccctttccccagatgtagaagtctccaagcttcctcagctccctgttaggaaggacatctctaaattctctaacccgtgccattctaactcagtgtctgcagctgtcttttgtgcctggctacctttggaagtaatgtggactctcttatctttggatggcaggcttttgacaacttcagtgccttttaccggggcttagaacttcagctaacagaatttttcacaacagagatatcttctagaaggcagaatttctctttctgttcttccaagtgtaatgaattaacatgaccctgctgaaggattcataactcaggtacaggtaaaacaagcaaacaaaccaaacaacaagcattaactgcaattccaatattcttccagttttccaaatggttagggtgcagataaggagtgtttagcatttggtttagaaccttagggtgtggaaagcagattcagaatgcagattaaaaaggaatttcaaaaaccaacctgctttatctaaaaagatcatttaaatgtgtagtttgcgcacttgcagaggtgttgggagaagacagggagggacagaataaccttaacaatatggattataaatataaaaaaatgtcctgctgagaaacgcctgagaaagagcaatgttttgttccctctcctgtgctttaattacagtctgcaacgtccaaactttcagtaaaagtcttccagatacaggactagacattattttggagaaatgatgcaagagaaattgtgtcccatatgcagacgtaataaaacggttgaggagcctacagctaagtttacgggtggtgccagggtgcaacttgcatccttctcccagcagaagatattaggatccctgttcaccaaatacattagaagagccaatctttgaaagcaaaggaattcaggcaaaatcctttctgttaccataacctcttcttgtaatatcaagtataaatacggtgaagtttacttggaaagctaaaatattcagactactttagaccatgcatgtgtaaatcatttgccttgttatagatcctaagatcaatgcttcaagagataaatcacttatttacagtgagacattaactacaattcagtttctagatcctgctgaccaagaaaaatactctttaaaaatataaataaattctgagacatttgtaattgcaataagatattgaatcacccatatctagtttaacaaacacattatacagaagtgaaccaaatggaagattttggtagtgaaactttatcatagacttataccataacattaaattaacatggggaattaaaatgttatccttgtcagatatgtttctcatggattgtgacatgtagtttcactttgttatcaagaatctgtggcatcattattattatgtcaacattataggtgaaaaaaatccaactgatttcctcaagctcacacagataaattaacagcgggtaaatactagaggaagactgtagctttttcctagtgccacatttcttctgcaaatgcttattttatatgaaaaataattgttcgaagtttttttatatatatagcatgaatcaattatatttccatgtaccttttctattgcaggcacacattaaatattagagggcagagaagtccatttgtctatcagcagagataagttttgcctgcataaaatcaatgggaggtgtaagcagttacaatccttcctgcttgtggtttgctagggggtcattttaacgtaatcaatgtgtttagctcgataccttcatttgactatgctttaatttttttccctttattaagaactttcccaaagtccagatttatatgggtaatatacaggaaattgtatagaaaaatatcaacgataattgtttgaaattggataatttataaaactgtagctaacatagttcttacatctttggagaagaaggaacaccatacactttcaacattattcccactttctcaagagaatgctctatgatggtaatatagaaatacgatggttaaaaatctacttccagttataaatcagctttttgaattgaatatttacagaaatcaggtagacacgtaagcaggaatgcttatgtactaatgtttttaaaatcccttacttaggccaggcacagtggctcacacctgtaatcccagcaatttggccaaggcaagtggcttgcttgagcccagcagtttgggccaaggagtatggaaaacactgcaaagccctgtctctacagagagtaccaaaaaaaaaaaaaaaattagctagtcatggtggtgcacacttgtgttcccaactccttgggaggcttaagtgggaagatcgtttgagcctaggaggtcaaggctgcaatgagtcacgattgtgccagcgcaccgcaacccaagcaacagagcgagaccttgtctcaaaaaagaaaaaaaaaatcctttacatatacacacacacaatagatatatacgtccatagtaatatatacatataatcaaatatatatgcatgcatttttatgggaatatacacacatacacgtatagtgagagagtagggaatgtatgtatgtgcatgtgtatttatggagaaatgagaaattaacatcaaattagacttaagatttttctcaaaaactttatgaaaggtgtatactctatcctcttctcaaaatcttagaaatggtatttgccttcatttttctgctatgacaaggtgaacaaatctcgtagcaagtgcataccatttattacaattgtaaaatgacttgtaacgtgttattaacagtttttgaagggggtatgattctttttcagatgtgtaattaatgtagccgtaaaggaaaatggcaatgttgtattgaatactgaatcttgactgtggtgaccatgccaggaataagataagcagagcccagttcctgctttgccgctaactcagcaactcacccaaggggagctggagagtatgccagaaatgatacatacggctataaagacagagtgtccaagtttgactcagttcatctccgggctcttctcacttccgacattgccccgttttgtgaacttgactgtgtctctttctacattctggaagcaacagtgtaatactctgcagttctaggttccctagcctcattcatgctgttgcctgtgccccgcacttagcagatgagccagtggataaggttctgcagctctgcttcccagtctttctgacatttctgctcacaattgttgaattacaaagcaccagctggtccctcgtcagcagcggcctccacgcaatcatgggaaatgctgcattccgtcacagggtgccctgagatgtccctgctctgtttcctctcttcaccttgcaaggcagctgacatcctttattttctcataacgtcactgcctggaatttccgcttccatcaatccggcagtcccacagatataagaacccatgcagtgggcacggtttcagtgtggtgaccctgtgctctaaaaccctttgtcaggggaaacacagtttttatgtatttgtgtctgaaacaaaaaatgacggaacgtcacatgcaagtggtgaccgtagctatgtggctttcctgactcatggcagcaaactaacatctcagattccatcatctaacccagccaacgaggcactgtggatcctgctttcaagtgttttctgcattactgacagcaaattactgagaaggcagaatccaatgatagctttccatcctcattttgcaccgtattttcagcttgctgccacatttgttttcctaaggaggtaataaataaattggaagaaacactgaaaatacagcaaagagtcaggagtctggcttcacaatctgcgacagctgagggtgagatatacaattttacacctatgataggagatctataaccttagatgccacatctattcaggaagaataatatcaaggttagtgtaagcatacaatgaaataaagtttctggcaaacagtaatgctaaaaaataaataaataaataagatgtttctgttctcagcttcctatttaagttgaaaggatgtagtccaggagtattcagtcaagcaaatgtccatgttttgtgacatatatctctaatctattgtataagtatagacaaaggcatttagcagatgccactttattgcctcaaagagctgaaaatcaatgggtatctgtggaaggagaatggtttaccccaagttcaaaactgtgtgcagacaagagccactgtggagaaagagcagaagccaggacactatgcttctaacgccgtgagctgggccaagaggtgaggtctttggcaataggaatgcatgagcctacaaaaggcctaagtaaaaagttttaaaaaaggaattgtattctagtcccttagttgataacctgagaattctcattaaaaacgtacaaggaaaaagagatcatgtttgtagacctaccttatgcaagtaaggctaatatccccgtaagatatgaatatcactgatcacagagaaaataagagaaagactgaatgttggaaagagaggcacgattataaattagtgaaagctttctgatttgttgataccaagtcagctgcatcacagtccacaaatatttgttgaagtgatacatttttctaaattccaagtctattgacaataatacaaaatgttatattgaaaattaagtgggctaccctaatgctactccagaaacacgactgcaagtttctgcagtgataaacctcatcacagaacctaacactgctgcagaatttgtcctgttccaggcccgatttgtgctttgaactcatgcaatgcctacagtggccacatgacgcgcatgcactattgttcccatgctacagatgagataaaagaggcactgactgtttacataatttgcccaggattgtccttttgcagtttgtaacagagccagatgactgggtcacgcaaatgttgaaaaggggcagcagagaggtgaataagtccgggtgtgaattagggggtggagcagcaagatcagcgtttgggtctcgcattagagtctcacctgcatgactcccgcagggtaaacagccacgctgcttctaatgctctgctgtagatcacattccttttactttataaatcagaacttgcctctgtttggcaggaaccttgtttgggaaatgaaaatatggtaagtatgtgtttccttctagttaaacaagggaaagtatcgttcttaaacgccaaacttaaatggttaaaaaagttaagtcttaggccatgtcttagaacgaacgttcttatctttaaattgtgagtcattttttcagatagagacaaggtttgattttttatcactcttggttagctgatgacataatacacattcaaagaaacgtgacagattttaagcaaatttctaatcaacagtgttctacttcgtcaaatcacaacagaaacattcctccgtgtcagcttttgtcattgatccccggatctttccagtaatttgtgtattaagagccacaaaggggaatacacaaagctgcaaagtcaattaaatcctcttaaataaggcaaaatgaaacaacaaaaaagtgccatcctatagccctctctgttcccagtaagtgcgggaatgagcttttgaggaatgcacagcccaggtgttctgcagctgcacattttaatcatcaagtcaccaaagtctgctgataaacatcaaaaaagcctaatggagtcacagacccagtggcctggttcctcagatgagctccatagattcctacagaaatggaattggaatagggctggctggagttatcagagcataataatcatccgatcctgacattaagagtccctctgcctcacaccacccagaggcaattcgttgtgtgaggggtgtgggaacaaggtttcatatctggactgggatcactgtgatatccttggggtggtagcaaaatctttctttttactaactttttaattatggctaaagagttgatggggttgaaaatgctttctccttttcaatgaaggctctgaacggccgtgcaaagtttatgttctctctggttttgataaaacttaaatgaatgcagaagccaatggcaagtccataaaatttctcaatgagtctctgtactgacttgagaaagaaaggataaatatgctattggtgctaactcttttattgagcatttttatgtccaattctttatcttccttatgtgtaataaagtaagttcctcttatttgacttactaaattcaaattctaaaagatcacttctatccacatacccaaaagcattcagttagtgacaatattaaaaacaatgggaaacagtagtttttgctatttggtgataccaggtacccatctgcttgtgatttaagataattttctgtactgtcaggggcccaagaagagactatgtgcagtttgcagtggggccagtgacagcttcaacctttgaacaggaaatccagacagtacagacttttgggaagggcccaaattacagatcccagcagcgagcagcaagtactatgaacacaatcacagggaggctttttaatttatctgagcttaagtctcctcatacataaaatggagtgcatttttcttacctctccggacatttgtgagggttacgaaactttatctatccaaccaactttgcaactgcttggcagatgatgcatacatcccagatgatattaagtaggggtggtggccaggcattgaggggcatgttatgcacacaaggagcctgtagaccagaacagggatggacccgccatggccagggtgacaaatctcactgcctatcttgtggaaaccctaagagtgtattttatatttttaagtggtagaagaaacatcagaagaagattttgggacaagtgacgatgtatgaaatttacatttcagtgtccacagaaggagtttataagaacacaacagggcccgtttgtctacatcctgtctgtgactagtttagtgatgcaattgcagagctgggtcactgcaccagcaactcagggtgggcagagcccaagatatttaccatcattttctttgaagaaaatgtttattcacgccagctcaaaggttgaattgaaaattttctattttcgtcctttttctttctctattttcccctacctccttccctccctccttcacttccttccttccttccttctgactagcggagaaagaggctcaaagaactggttaaagcagctctagctacctctagtcaatgactgtgttgtcattcccccgtattgctaagaccctctgccggtcatgtaacaaatgcaaatctttcacgcagagttgattttcagaacagctcagacctctgttatctgggcatggggtgagggcatcccctcacgcccaaccggccttgggtgggtctgcacagttgtccctctggccgtccttttcctaggagtcagggccagggctgacctgcctggtccagcgttcacagctgggtgaacttgcccagggccttggtccagctttagtcagtctcctatcctccccacaggaaaacaggatgctgaagttgggcttggtcctatcctccccacaggacaacaggatgctgaacttgggcttgtccctgaggttaagcaagctgtaaggttcagaacatcttttagcaacgtatgccgagattggccaactgttgctaggaccctttcctgctcaactgcccccatacacggaaccaatgcctgctcaaagctcctgctacccctacccctgcttccccattacaatacaagaaaacccttttttttttttttctgtttgagcttaagatccctgcagtccctgaggtcagaccattctccctacggccttcatcatttttagtgaagtctctcctttcctaagcccagacatacttattttggcaccattgatgctaggacggaggatcatgcccccatgccagctctgcagacatcgggaagactaaacaacagaagtacatgtcaagcccttggaggaaggatgcaatcatctctactgcaaaaatacattgcaaagaaaacccgaaagaaatagtaatatgaatacagccactagtgcggtcatcactattgcaaaaggatattgcaaacaaacaaacaaaaaaaaatcaaagaaacagtaatactaatacagccgctagtgcagtcatcagtatggcaaaaggatattggaaaaactcccaaagaaacagtaatattaacacagccgctaggttgtgtcctaggttcactatgacagaacagtcctcgttcccctccttcttatttttctggcccagaaatgataattttcacagtggcgttgctggtggtagtggaagatcaacgccgtaataatgagtattatgggccagcagctattcctaaaccaccccattcagtccttatcacaaccccatgagaaccaccatcatcgtcacttgatgggtgtgaacactgaagtgttgggattttagaactttcccaagtttatcatatgggatgatgtagaatccaataataggaagtcagttttcagaatctgaaatctcaagtcctcagtttactactgtttccagctgaaaagaaagattatctttctataattattatttgttttttgagacagtttcactcttgttgcccaggttggagtgcagtggcacaatctcagctcaccacaaccttcacctcccagattcaagcgattctcctgcctcagcctccatagtaactgggattacaggcttgcaccaccaggcccagctaatttttgtatttttagtagagacgaggcttctccatagttggcaggctggtcttgaactcccaacttcaggtaatccacctgtctcggcctcccaaagtgctgggattacaggcatgagccaccgtgcccagcccgtaattctttattgatagataaccgtgaaatgttttactcattggggtagcatttagtgtaagtttaatttatacctcaagtattttaaaagctaaattaatgtccattattagtactcaaatggaggaaatatttttatttgtgattcagtaatcccactatgtgatatctaccgaggggaaaagaagtcattatatgaaaaaggtatttgcacatgaatgtttatggcagcacaattcactactgtaaaaatgtatccatcaatcaacgagtggataaagaaactgtggtatatatatgatggaataccactcagccataaaaagcaatgaattaatggtattcacagcaacctggatgggattgcagaccattattattattattgtgagacagagtctcactctgtcgcccaggctggagcacagtggcgcgatctcggctcactgcaagctccccctcccgggttcacgccattctcctgcctcagcctcccgagcagctgggactacaggtgcccgccaccacgcccggctaattttttatatttttagtagagatggggtttcaccgtgttagccaggatagggagaccattattctaagtgaagtaactctggaatggaaaactaaagaccgtatgttctcacccataagtgcgagctagcctatgaggatgcaaaggcttaagaatgatataaaaaactttcgggccttgaggggaaagggtgggagggggtgagggataaaagactaccaattgggttcaatgtataatgctctggtgatgggtgcaccaaaatttcagaaatcaccaaagaactttcatgtaaccaaataccacctgttctccaaaagtatggaatttaaaaaaaaaaagaaaaagcactgaggacattaaaaaataacgtcttaattccaagtattaactttgaaaattatgatttactgactaagacttaaggggaagtatttgtcttttatatagcaaaaatctggctaattgttctttctaaagtctaactttatcataaagtaacacaaaacattctgattcttggaaagtactgaatttaggaaactctccagcaacaagcataaaaataaaataatgattgaaaaccattttttgtaaagtaatgaagccaactttggaaatttggtgttatgttgacatatatatacgcaactttaaattcaatgaaatagtccagaataaagaatatatttcaataaagtaagtgttggtcatgtgtcttcatgaggtccgaacatcggttgaaagtcagacaatcattatgcttaagcaaggaaaaggagattttcaggtgatttaaatatccacgtttctcatcttgcatgaggctgaagcctccatttacacactgtggatgtccccactttcttgcagacactctggaagtctttgtacttgtgtgtgcacagacacatgtccacgcaatgtcccacactccatgtcttcactcttgccttgtggcaagttgcaattattttctataaggtgatactacatttactcagtcacacttggatgaaagcatcattttacccgtgaaggtggtgtactgtaaatatcagaaaagaagaagaaaaggaacttgaagtttctaatatttccttaaggagaaattctaaaaaggacatactgctgttgttctctgctgaacaagtggtttaatattacttgaggccactgcatacctcatcagatgtatttatcagttgatataaaaattgttaattattctttggtgatcactttgtccttcttcttctggtttgcattaaatcacggcacttcttaaaaactgagcagtcccagatttgcaggaaatgtaaataatgtaagagatacatttccaggaaatataaacaaataatgtaaaaaaaaaaaagtcatgtcttaagacatgataaaagttcagaaggatgaagtacttgcaatgtgctacttcctatctcatttaattccatgaacaaccctctaaagcaagcactcttaccatctgcatttacatgtgagccttagaaacattacataactcaccagctacacataattgataagaaacagtaagtgacagaattagggctaaaatcccggtctctttgactgtaaaaatgcaggctttcagccacagaattaaaggaatcttagaggtaaacttgtcattcctccttaattttttagaagagaaaattgaaactggaataagttgaatggcttactcaaggtcatgctgctgttgagataaaagaaaaaggactgaacccaagctgaacacgcaaagtccactgtgcacctcctactacttgacattgttttggacagagttcatcaagcggtacattttgatctatacctgttaaaaatctaaatttaaaatgtcaaaagtttaatgtgttcttccaacgtcaacaacagccataaaaattattacaatttagcagaaaaatctgccacgaatcataagaaaaccattgctgccatcattttttactgattctggaaccagtttcaaggaatcagatattttgaattgtgcaaaagaaacaaaatttgttcattttttcataatctgctatatgatatgtcactgcatttttttctttgccatagaatttaattcttttagattttataatggttcagtaagtcaagacttcatcagttcatatccctttcgtttaaatattcagtaagtatagtacacaacatacctttaaaattaatttctttatggtggcattgtgcctttgactaaccattctgtatttgccttcgactttgctaaactaagcaatttcccttaatgtcaaccttgataagcaagtaagcattaaggcaacatttaaacactgaagcaatatatggttacatgattctaaataaactaaaccagtgcgacatcgtaattagtttccctgcctgctttgcgcaacttttctttccaaaattatatgcatgtcttttaattgttatgttaccagtattcatctaagaaacattctgcaataaaatgtagcagattttccaataataaagtttgctaaagaaaactcagcaaagtttaatggatttatgttactacaaaagaaaagtgcttgtttttaggtaattttgatgttcaaatgttttttggttttatcttgacagtaaatctttgaggatatagtgtaactgataaaataataaacagaatagaggtgaattcaagacttacacaaaatttaagccagtttgatgaacagttttgatcctcataaatctaacttgccagaatattaaattttgatatttttaatttattttacctaagttactttgattttttaaatatagattttatattttaagagcagtttttctaggttcacaaaaaacattgagtagaaggtacactgatatgtcatgtaacacctgctcccatacacagagcctccccaactatcaacatcccacgccagagtggtgcatttgttccaatcgatgaacttacattggtaagtcattatcatccaaacccccagtttacaatagggttcactcttggtattgtacatgctatgggtgtggataaatatataatgctatgtgttcaccattgcagtatcacactgagtagtttccccgccctaaaaatttccctgttgatttccccttcctccaaccctttgcaaccactggtctttttactgtctctacagttctgccttttccaaaatgccctagagtaggaatcacaaagtgggtaaccttttcagactgacttctttcacttagtaacgtgcacttcagttcactctatgtctttgcatggctttcggttaattttgttttagcaatgaataatattccattgtctgatacaccacaagtttatcatttcacctaccgaagtacactttggttgcttccagattttggcaaccaagaataaaccttctaaaaacatcccttggcaggtttttcagtacacgtaagtttttagctccttcagataaataacaaggagtgtgcttcctggactgcatgttgagagtatgtttagttttctaagaaaccacccaattgtcttccaaagtggctgttccatttcgcattcccatcagccataactcagagttattttactccatatccaagacagcaatctacattgttggtgttatggattttggccaatttcttttttcttgtttttacgtttgtattttaatgtgtgagttacttttatttagattttatccttcaactcacagtacagacattgttttgtgaaatatttaatattaggtaaagctacagcatcatttggtgtgaattaaatctagctagataaaacttcctgttttaaagtgagtgttttttcaaaactctgttgactatctacatatggtaagtggagtaaaattcaaggaaataattttaaaacaagaagtaacatataaataataaaatttttttatggtggatgtgatgatcttgattaatcagtagcactaatactgctaagcttacaattttggaaatgtaatgacttattcaacagtgtcattacattttaattttctacacctataccccttcatcattaattcaaaaattactactctaaataccatgccatgaaaagagaaacactgggtttgaatcaaggtttggttactcgttaggtgactttccatctgttatataagttttccaggcttctcaaattaattttagggtggtgatgtgggattgaggaataatcgtgaggagaaattaaataagcagagtaagctgttggtacatgtgtcattcccttctcttctttataaacattacattaagaaaactccaatacttatcatgtttttaaagaatacttttaaattttattatacctgatagtgttctcttaaaatgtaatcattagattatatgagtttaaggaattaatacaggatttttggaagaaaaaaaaatgacaaaaatatttgaaatatacaaaagttagaaaaaaacaaaatgatgttaaaaaagattaattttctttaatggatacaaatgataaatatagaatccatctacatttaaaaacatatctaaatagtattcataaaacaacagtcacacactgtacttgttggacagagaacacttacacattcaggtaagtgatgctaatatccttgagggttgcaggtgacctctgaaacagcctggcatgcttcccagaaatgaacccctaaactaatcaaacgcaatgccagctaatcctaccaatgtccccaggcgtaaatctagatataagctgttgtataagccaccaagccccgcccaaaatcttcttgaatgttttcatagtagtaatttatttaggtaccttattggtttacatacttctgtgattgagtccctcacacaagacacgattgaattttgagaatataagattttaaaatatgttgctgaggtggaggaaagattcaagtactaaaagtatttaaaaaatacagtttgtgcctgtagtcctagctacctgggaggcggaggcaggagaatggcgtgaaatccagaggtggagcttgcagtgagctgacattgtgccactgcactccaagcctgagcaacagagcaagactccatctcaaagaaaaaaaaaaatatatatatatgtatatatatagtttgatagtagtcctgaaaaagagacttcattatctgtttcaactgagcagtaggaatttttataattattgtagagtttcctatgttcttgtatgtttttgtccatgacacctgaggtttctgtattggtagaggctgtgtagacagtgaagtttaggtgggtacagatgtgtgtttagagaaactaagaattcatgtgctggtgcatgcatgacaggtatctatatttcagcctccactgcttaatatgatacctacgcctagccagtaactatcagcaacccaaagagctacacaccctccaggtgtcactgttcttttcaaaaggacatggaggtctgttgcagcgaaagttacagctgttgatccactcggttaagttctgtgtgccgggtatctcagctgtagaagcgcaaacacgtggtgtcccacaaattccttaggactctaaaacaactcttactaaaagatgtgccatttgtagaaaatataagcatcatgttttgtttgaggtggtgtcatgctatgtcgcccaggctgagtgcaatggcagtcattgctcactgtagcctcaagtgcccaagctcaagtcatcctcccacctcagcctgccaagtaggtgggacctccggtgcaccaccatgcccagctaatttttaaagttatttgtagagacatggtctcactatgttgcccaggcttggcttgaactccttgacacaagggatcattgaaccttggcctcccaaagtgccggaattacaggcgtgacccatcacacccggcccaagtatcatttttattacaagtttaatcactaagcatctcatcatttcttcctggtcatgccatgaggtgttagctcacgtgttgtcactccagccgcattatgtcactcttactaggttgttgcaaaactaattgcgttttttgccattgaaagtaaaagcaaattacttttgcaccaaccaacctgtgcctagcacagtatcagatatatatatactggataaactatcattactcttactcttcaaggtgtcactgtaagtaataacaattgaaacaaagtttgcaattatgggactgtacatctctttatatccttttcttgaccttatttacatgctcacactttaataagtgaattcccaatcttgcattaattacattcttaatgatgaggtcatagagcagcactgtctgatgcaaacataatgtgaaccccataacattattttaaatttgtagtagtctacttgaaaagcaaatgcaaaatagtcagttttatgacatatttcatttaacccaatatatccagattatcatatcaatatgcatttgatataaaatacataaacataaaagttcttaatggaatattttgtattatcttttttgtaacaggtctataaaagaccatacgtattatacacctacagcacatgttatttggatgctaaagttcccacaattaaagataaaatgtatatataccacacaataatagccataacatagaatgaaataacatttgcagcaacctggatgaagttggaggccattaccctaagttaagtaactcaggaatggaaaagcaaatactgtatattctcatttataagtgggagctaagcaatgaggatacaaaggcatgagaatgatataatggactttggggactcacggtgaactgtaggatgggagcaggggacagaagactgcatattgggtaccgtgtacactgctggggtgatgggtgcaccaaaatcaagaaaatcagctctaaagaacatatctatgtaacccaaaaccacctattgccccaaaactattgaagcataaaaaaagcaaaatgtagccctaccaaaatgatcagggtgtgtttaatgagacaatattttacactacttatctttttaaaatttaaatttgtttcaatgaacaacaaataatatttaaaatgtatttccttagcagcagcagcctcattttgaatgctcagcagccaggtggggtcagtggccaccatgtcagacagcacatgctgaaggcactgtgctttctgcctgcccctgtgctgggtgtttgtgaaatctttttgtgtttcccaggggactgctagaaaacagcaacaaacggggaggagaaaaaaacttagaatatctgtagataaatgtaaaaccctcaacttcccatataaacccaagatgttacttaggtgacatttttttttctacctacttctgaagtagaaaaccagataattttttccagagggcctgtattttaacttggaaaatcctgattttagggaaggagtgtcttcgaaggtgagaaaaacagtttttccttgcagtttagaaaattcgtgtctataacagaaagcattcttacgtaacttagaggtatctaagtaagactttgtgaagggtgcctggtgacacttcaatttaaataacaaactatgttaaatttcataggctaaagtgttcatgtaaaagaaatggtaatagaaatgttaacacactggaatagaatgacggtggctgagagactacattagaaaaattaaacctataacattttctaaaatgtatgtagctacctctgatttatataaaatcttgcttgttgcagaaattagcagcaaaaattcaaccatttaaggatatgcaaatggcagaaaaaaggatatgtgggggacagataaatccatctgtttggaagatacagattggccacataaaaagatattggttatatgatcaatttaaaatgataaatagtcaggctgggtgcagtggttcacacctgtaattccagcacttttagagaccaaggcaggaggattgcttgagttcaggagtttgagactagcctgggcaacatactcagactccatctctaccaagaattatatataaaaaggccagacatgatggcttaggcctgtaatctcagcactttgggaggctgaggcaggcggactgcctgaggtcaggagttcaagaccagcctggccagcatggtgaaaccctatctctactaaaaatacaaaaaattagccaggcgtggtggcagactcctgtaatcccagctaatcaggaagctgaggccgtagaattgcttgaaaccaggaggcagaagttgtagggagctgaaatcgcaccactgctctccagcttgggaaagagagcaaggctctgtctcaaaaataaaaaaaaatatacacacacacacacacacacacacacacacatacacacacacgtatgtatgtatatatacatatacacacacatatatacacaaacacacacaaaaaaattagttgacatggtaggatgcacctgtactcccaactacacaggaggctgaggcagaaagggctcccttgagaccaaaaggtcaaggctacagtgatccttgattgcgccactgtactcagtcttggtgacagagtgagacccttactctctctctcaatatatattttacatttattttttatattttagtaatattgcaatataacgtatttttagaaaagggatgtggtaaaagtagaaaaaagggctctaacatgcaacactagattaaaataagttacagacacagaacacaacagtgagcagatgagaagcagaaggacaatagacgggctttgcagggacaaaacgctaccaacatgtgtgcaagatgaacatcttagatcatcatgttttctactctggagtacatcattctcacattttttaaaaaatgctgttattaattcttttttaaaacacaaaaaaagaacccaactcttagacctcattggctattcaagttaggctttatttcttttccttacaataaaactctcctcttccctttcattttcctttgaactaacttcattccggctctctgttgtcttcagcctccaccacagttgctttagacacggtgactgatgatatcaggactgcttatccaaccgccagtgccaggccttgctctgtttaaccttggcctttgaggtacctgatcatctctgctatcctcaggccgttctcctcattttcctactatcttatcagccgcttactcttactctgttccagttgctggtttcttcttttctttctgacctctggatgtttctccctacctgtaagcctgctggcttagtccttgaacctcttttctcatccctgtaagctcactggtggtgatgcccagcttaatggtgtaaacaccgtctctacggtttcagaatgttaacatagtgtacgtcaccaacacatgtctgagcaaagtccagcagtgttctcaatactgcacacagatgtctgatgggtgcctcaatcttcctgagctcaaaaggcaactcctgatccttcctctaaagctggtccctcccatgtgccttcttccatctagataaatggcgactgcgttttccacttcctcaggccaaaaaacatgaggcattgtaaatactcgtctttttctcacatcccacctttaatctttcagctagttttcttcaacatatcccaaatctgactcaattctgaccacctctactgcggccttgtctccattttctctcctccagatgaaatggcagcctccaaactcatgttacttttctcatattttgctcttctcaacacaggcattagaagaatcttgtgaaatatgagaaaaagtgcatcagtcccttgctgctgcagggacgccatgagagccaacgccggaagagcacactcctggatggctccctgccctgtgcatggcttgctccctaccccattctcacttgtggaggttcaaacgcccccttgaggactattcatgggatgcttctttaccgttaaacgtatcttccttccaccagcagcactttctgtctgcccttcctgaattatttccatagcatgcgtcatcatttaggatactgtgtaatttacttctgttttctatgagtacctgtttccactattattatagaacgtaactcagaagagattttggcttgcgtgtgtgttttcctccatactgtatcctttgtgcatagaagagtgttagagcctaagagatcgtaaaatcaataagagattaaataattatttgaatactcaaaacctctaggtaaggaattgtgggtgagtcaaagattaaaaatatgtatccctaacctgttttctccctccaggggcttctcttgtaaaagttacccaaacctccttgttgataagagtgaaggacctttcacagtccacgcgtttctctctgcagaactagctgttatctcttctctttccccatctctctttctctttttgaattacccccttgccttgggtagagtctatgaatttaagcatttgcgtctcaatgatataaaaagtaacaaattctgtctcatttcatgcagttccgtatattcggataatttatgaaaaattgaattcaagagccacctgtgaaaagcatatgcatgtataccttgaatttaaaatgttcaaatacttcccctttttcctaatctataggtgcctctacttccttctgactgtaatgagattaatgaaatgttattaagtagaggtaaagtctatagtcggagtattggaatatggaacatggacaatggatgaaaaccttagcagtacactttcaaattctgtttctacaaacatgaattctgggtggaaaacatttgttttattacattcacttaagagaagtagaataagttggaggagctagaactctgacaaaagtaaactgatatagctagcatgtggatttttttttttctaaattaatactgtttagaaaaaggtagctaagggacacagaatttcaaatggttctgtttggggattacctatgtattcatcatgatcttctctcatttataacataagcatgaattcctgtaacatttttactcctttccaccctgcaaagtgcattcaaatcacttttcccattcacttattccaatgcctgtacaagctgtgttacgcaaatgtcattatcccagggctgcagttgacgaactgagactgtaagttcacaccttcagcatgggataatggccttccatatgcagaatgcaccgatctctccatcctcatctgtcagtgttcccctccacggtgcttaccagagtccagctgtactacctgcccttcagcacacaaaggtgaggtatccatgctcctgcttagtgcccatgctgttagtttcctctggatcaaatatccatcaccatcacagacctgtgtgaaacctacccgcaaaggtccagctcaaccgttcacttgtccatgcagttttcctaactcattcattcacctggcatttattgtaagcaaccctacgccaggctgttttccaggtgtagggattacagttgtggaaacaactccttaccttccttgaattttctctacaatttcttatggtatttattgtgaatatttgaccctattaattactttgtaatacaatcaatttatgcatgacttattggctctcctgaactaagaaatacataagaacagatgcatatgtgatcaatctttgtactctacagtttctttagttgacacttaacaaatgtacaataactactggatatggagtgatacgttgccaaatactacacaattccttaggggacggtcccactaaatttcactaagccaaatcccaaacttgcctgtttttttcccaatgcagataaactggtagaatatttagaacaaagttaatttgcttattctgatatttatgtgccaagcttctgaaattttcatctttttattttattcttttttatttcttggctcacaatccaatttacttgagtaacttcattcattagacaaatcatctaaatcccagtttaataaaaaatgcccattatgtgtgattctctcattacttacatcaaatacttgaatgcaattgtctgcatgtttttacataaattatgtttctcgcaatactctagattttgtgttctttcttgcataatgtaataatcagcatccttcatttgaatatcacggtttaataccaccaaagcagcacataatattttcaaataaaaggaaacacaatgcacgatgcttaaagtatctctttctcaggggaaggcgtatcacggagagtttatcatgcggatcatttcagtaggtgcatgactacctaaaatttgaaaagatggacctaagagaagtgtttgtgccttttaatgagaaaaactctacgccatctaaaataaaacactggaccaagagaatagggtcaagtctgcactgaacaaatgaatgtctggaatcctctttgtttcctcttgcaatgcagtaaccactgagcaggtgtggctaccgagatatgactagtgtcattgagaaaataaagtttaaattggattacctataattaaatcaaatccaaatctaaatagccagtgggtctcatggctcccgcgttacacagcatagtctaggtttcccaggtgttgtgttacaacagacactatcttattcacatgacaattaaaaaaaaaaactgaaggatcaacaatattctctaactatttctgctttgcttgcagtggaaagtgaggctccacaaatccagaactgtatatatggtaaggaacatctaactaagctcatggaacccaccctcctggtatttatgaactcctgcggtcctcccttaaatatgggctggaccaggtgtttcacacatattcattagaatattgcaaaagtgacaggatatcacttgacattaggttgtaaaaagactgtggcttccacctctttcttggatcccttacccacagagaagcctatcccatgtctttaggcagcccctggatatgtccatatggaagggactgagggctgtccacagccgtgtgcgtaggcataaaagggagcccagcccattccaggagttgagtctgagtcccagcaacaagttaacagcaacttacagaaaaacctcgagggctgaggcaggcagctaaaccatgctcagattcctgacccacagaaaccttgaaataataaatgcttggtattttagcccctaatattgcaagaaatttcctgcccagcaataaataacttccatcttaatttcagggaaaggttgtatgaaccacacggaggaagtaactatacagtgcaacaagtatagggttgctagattgattataatagcgcataaaaatacaggatgctcaattaaaagtgaatttcagataaacgaccaataactctttaatgcaagcttgtctcacgcaacatttggaatgtaataaaattttaaaaatgttctttgtctgagttccaaattgaagtgggaaatttgtgctgtatatggcaaacctaaccagatattcagtatgtggtgatgctgaacagaagatgagacagaggcataaagagaagtttgcatttaacgtggtgactacagaggtaaaggtcaccagaggacgttactgaagcacagaagaagagatagtaagttggatctagagacacagctaagtgctctcggtagatggggataaacaccatcctcttgtggtttacaagaaaggagaaagataaaattatcaaatgatgtaacaatatgattcgctgggtttaaaagttattagatacatagctttgtggaagttcggaaacactgaatgccacttttcagacccaaaactgtgataactgtagtaggaaaatttctgaattactcaaataattcagcaatcaatgagaaaattttttgtcattaataaaaaacttattttcaatattaaaagtaactcattctatgactcaaaagttagtggtgaggtgcgcttgaggaacaatctgatcaggcttctcagttcttccctacttcttgggaagtctcttctctccgggtttgaagtggcagctgaagttctgggctcagtacacatggctcagggtatgaactagcttcttccctcagccttgaaacaaaaacaaaaaactttctcctgactggaagcaaaggatatgtgaccatgcctggatcaatcaccatggccaagggaatgccctgagttcattggtttaggcctgggccacctgcctgcttatgatccaatcaacatcagggagactcacagagtggagggtagggcaagcctggaaagggagggtcacccaccaaaggctcgtggctgcccctagaggagaatgttaaactactgaggaaaacccagagcctcagcagctatgtgaggacaccgtcttgaaagcaaagcgctaaaaaggaaatgaatcttcagcaagaatagaggctaagtatttcatcatttttaaaggtcatccactacatgacctaggtattattcccgttttacagattaaagtgcagtctctgagagagcaagtcatttgcgcaaggcctaattcctttaaattaagagaaattgcacttcaccgtgtatgtaatctcctgacaatggtttttctattgtttaaataataggtttggaaggttattaaatctttgagaaactatgggtatatataataaatgacccccatgtccacccacctctcaaaagagatgtttttataaatactgcatgcactctggctgggatacacaatgtctgaagcctcttttataataattaaaacaaactctaagacctgggaatgtaggaattataggaaacagacccatgctaacatgctcaaagaaaaaaggtgtctagaacactgaagagagaggaagagggatgtgaggaagagggatgtgaggaagagggatgtgagggggaggggagggagagagacagaccgacacagattgtgagagattcagattagtttgtgtgccagagaaattacaccttcgcctcaaaatttcagataaaatattgatgttaatgtacactagacatctcagccacactctgacatctttgcagaactgatgtcaactccttaatttaatattgaagtctttaaaattagtattgatggctctttgagatacttgctgaattggaatctcttatctcactcttttccactttaagtatattacattcctttctaagtgaaccctgggcatctttcactgacttttactttgcactttcatagacaaatttctgccaagaataataatatctgaggaatagtgtaagacctcgaccatcaagaaagatcattgttgaaaagtgatttttaattacttcttactggggaaaattgagctcaagtcactaaggtgatctcacaatgtcaaccaattaaatgaaaccatttatatttaattatctctgctgatgggtcatatccttaggacagtgaatcttccattgtttaggttaaagttatcttcgtcacttttttctaaatactttttaacagtgttgggctctagtctgatcttctctcttacctgcgctatacttttattgttcaacggaatatgtttaagtaattgacatctttattttatgatagcaaaagcatccaaaattgtaaatatattttcttaaaacattacacaaagacaactgatagaagcccaatggataaatgtagacatgataaaaccagcccttagattttttgaaaggtatattaggagagtaaatatacaatgatcacgcaattatcacagcataatttgtgatggcaaaaacttgaagtcagaactatctaaaggtaaagaaactacatatacataatgtcctcacagaagggagaattttattgtccaagagaatgttgcctagaaaaataatggtgaaatattaagttaaaaagatataaagtcatgaatactatgatgatcatggcaatacaacagcatatataaaagtatgcagagtgaaagtaactggaaagaaataaccaaaatgttaccaagcgagtaatggggtccagttgatttctagtcctaattaccacttttctgtgtggtcactgtgcaggtgctgtcgacattggtggcatggggcagctgggcttctctcattgtattctctgtccttgagaggctagcccaggcttctcgccatagccatttcagggttcccaagaagcaggagcagaaaagtgtgacttagatgtggaacccttgcagaatcactcctgctaccttcttgtagacagaaagtctcaagggcagtccacatttataggggtggaaaagagactctatgtcttgatcagaagccctgcagaaccacatccaccctgttggatgtggctctgtaggctatatagcttatgtacgttcttatatacatttggtagattagactgcaaaaaatgagaacaaaattctatagcaagtgtccatcttatctatattgtttgctgacgtcaaccttttaaattgaaaataaattagtatgacaacaatctacactcttaagcctcttattctcatttttcccttttctcttatttaccatgatttttaccttggaagctttcctttcctttttgattattttctcatcctggcaccttctaacctcctcactcactactggttctataccttcactgtgacatatcaatcaccattctgatccctactaatataccccattttggcagtagaagtaccctctagtagaagggacataggagtaggaaattctaatccataaaagacacagactggcaaattggataaagagtcaagacccatcagtgtgctgtattcaggaaagccatctcacgtgcagagacacacataggctcaaaataaaaggatggaggaagatctaccaagcaaatggaaaacaaaaaaaggcaggggttgcaatcctagtctctgataaaacagactttaaaccaacaacgatcaaaagagacaaagaaggccattacataatggtaaagggatcaattcaacaagaagagctaactatcctaaatatatatgcacccaatacaggagcacccagattcataaagcaagtcctcagtgacctacaaagagacttagactcccacacaataaaaatgggagactttaacaccccactgtcaacattagaaatatcaacgagacagaaagtcaacaaggatatccaggaattgaactcatctctgcaccaagcggacctaatagacatctacagaactctccaccccaaatcaacagaatatacatgtttttcagcaccacaccacacctattccaaaattgaccacatagctggaagtaaagctctcctcagcaaatgtaaaagaagagaaattataacaaactgtctctcacaccacagtgcaatcaagctagaactcaggattaagaaactcactcaaaaccgctcaactacatggaaactgaacaacctgctcctgaatgaatactgggtacataacgaaatgacggcagaaataaagatgttctttgaaaccaacgagaacaaagacacaacataccagaatctctggggcacattcaaagcagtgtgtagagggaaacttatagcactaaatgtccacaagagaaagtaggaaagatccaaaattgacacccgaacatcacaattaaaagaactagaaaaacaagagcaaacacattcaaagctagcagaaggcaagaaataactaaaatcagagcagaactgaaggaaatagagatgcaaataacccttcaaaaaattaatgaatccaggagctgcttttttgaaaagatcaacaaaattgatagaccgctagcaagactaacaaagaaaaaaagagacaagaatcaaatagatgcaataaaaaatgataaaggggatatcaccaccgatcccactgaaatacaaactgccatcagagaatactacaaacacctctacgcaaataaactagaaaatctataagaaatggataaattcctcgacacatacactctcccaagactaaaccaggaagaagttaaatctctgaatagaccaataacaggatctgaaattgtggcaacaatcaatagcttatcaaccaaaaagagtccaggatcatatggactcacagccaaattctaccagagttacaaggaggaactagtaccattccttctgaaactattccaataaatagaaaaagagggcaccctcactaactcattttatgaggccagcatcatcctgataccaaagcctggcagagacacaaccaaaaaagagaattttagaccaatatccttgatgcagattgatgcagaaaccctcaatacgatactggcagaccgaatccagcagcacatcaaaaagctaatccactatcatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctataacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctttttgcagataatatgattgtttatctagaaaaccccactgtctcagcccaaaatctccttaagctgataggcaacttcagcaaagtctcaggatacaaaatcaatgtacaaaaattacaagcattgttatacaccaacaaaagacaaacagccaaatcaggagtgaactcccattcacaattccttcaaagagaataaaatacttagaaatccaacttacaagggatgagaaggacctcttcaaggagaactacaaaccactgctcaatgaaataagagaagatacaaacaaatggaagaacattccatgctcatgggtaggaagaatcaatatcgtgaaaatggccatactgcccaaggtaatttatacattcaatgccatccccatcaagctaccaatgactttcttcacataattagaaaaaactactttaaagttcatatggaaacaaaaaagagcccgcatcgccaagtcaatcctaagccaaaggaagaaagctggaggcatcacactacctgacttcaaactatactacaaggctacagaaaccaaaacagcatggtactggtaccaaaacagagatataaatcaatggaacagaacagagccctcagaaataatgccacgtatctacaactatctgatctttgacaaacctgacaaaaccaagcaatgggggaaggattccctatttaataaatggtgctgggaaaactggctagccatatgtagaaagctgaagctggatcccttccttacaccctatacaaaaatcaattcaagatggattaaagacttaaacgttagacctaaaaccataaaaaccctagaagaaaacctaggcattaccattcaggacgtaggcatgggcaaagacttcatgtctaaaacaccaaaagcaatgacaacaaaagacaaaattgacaaatggaatctaattaaactatagagcttctgcacagcaaaacaaactaccatcagagtgaacaggcaacctacagaatgggaggaaattttcgcaatctactcatctgacaaagggctaatatccagaatctacaatgaactccaacaaatttacaagaaaaaaacaaacaaccccatcaaaaagtggtgaacaatatgaacagacacttctcaaaagaagacatttatgcagccaaaagacacatgaaaaaatgctcatcatcactggccatcagagaaatgcaaaccaaaaccacaatgagataccatctcacaccagttagaatggcgatcattaaaaagtcaggaaacaaaaggtgctggagaggatgtggagaaataggaacacttttacactgttagtgggactgtaaactaattcaaccattgtggaagtcagtgtggcgattcctcaaggacctagaactggaaataccatttgacccagccatcccattactgggtatatacccaaagactataaatcatgctgctatgaagacacattcacacatatgtttactgcggcactattcacgacagcaaagacttggaaccaacccaaatgtccaacaatgatagactggattaagaaaatgtggcacatatacaccatggtatactatgcagcaataaaaaatgatgagttcatgtcctttgtagggatatggatgacactggaaatcatcattgtcagtaaactattgcaaggacaaaaaaccaaacaatgcatgttctcactcatacatgggaattgaaaaatgagaacacatggacacaggaaggggaacatcacactctggggactgctgtggggtggggggaggggggagggatagcattaggagatatgcctaatgctaaatgacgagttagtgggtgcagcacaccagcatggcacatgtatacatatgtaactaacctgcacattgtgcacatgtaccctaaaacttaaagtataataataattaaaaaaagaaaaaataaaataaaatacaaaacaaaacagaacaaaacaaaacaaaagaagttctaatcctgccctgccagcactggccatatgaaaggcaaggtagctcactggttgtcatggaactcaccttagaaaaatggaaacatggcactaactgttagaattccttcttatctaacattgtgttaatctaatatctgtatgtctttggtacaagagttcacaaatccaaccaaccaaaataacaacaattatgatatttaaaagctcacgatactaaattctgaacttgtaattactgtgcattggtatatttatttctaaattttcaaggtgccaaaattgccccactctgttaattaagccggggatgatgctgtgataatggcttaccatttccgtacccactattatggaataaaagcaaaaaagtccagctgaaaaataatgcaaaaaactaaagagtctccaaatatgaaaataggacaacagacctattgaacattccaacacatgattgaccagccaattccaagtgctgcgaaacagccatctattttggtgtatttgctttaaaagtaaatgagaaagcattgaataaatagacatcccatatagcaccgatgatttaaatttggtacttattatctatagccataccaccctgaacgtgcccaatctcatctgaatttgatatttattgtaaaacaataatgatttatgacatatatatccatgctaaaagaaatgcaatggtacggtttctcatttatttatttattttttttttgaatgcttaaactataaggcagggttctccaatcttttggcttccctgggcaacattggaaaaagaactgtcttgggtcacacagaaaatacactaacactaacgataactgatgagctttaaaaaaatcaccagaaaaccttacaatattttaagaaagtttatgaatttgtgtttggccacatgcaaagccttactgggccacaggatggaaaagcttgctataaggcttaaaattcatttatatttacattccattgcctgtaagaaaagttatagatgatcagaataatattgactcaattcatttatacttttttcaatataatctcccctcagaaattctaaacataaaacaaaataaacaacaattcttatcttgtcattgaaatattacgtattaacgatttaggtgactaattgactatgcagcaaatgcaaatgtaatatacattcgtacaaataaaatgataaattctcctttagcctagttgattataacatgatttcacagtgataaccacaaaggcaggacaagtacttagtactttgctaggtgattctgtttgtctgtgtctgcgtgtgtgtgtgtgtgtgatgtgtgtgtaatgtttacatttttaagtacacagaaactcatacacacccgtgtgtgtgtgtgtgtgtcggtgtgtgtgtgtgtgtatacctaaattaggtatttaaacctacctgaatagcatttcaatgctaaaacttaaacacaccaaaagaagacagaactaaaaaaacaacatagcaccaacaaaatagacctattagttttctgattaggttctgtgtttcattctcagtttactttaaacttatgatacataagaaaaaaacggaatatatctagattatcgtttgcatgatttgtttaaaagagggtaaagttctaagcttgcccttggtttcagtaaatttattcttgtaatccccaatacaccttccacatgccttacccaaagtatattatcttttaaaacttattagagagatcagtaaatgctgaacctgcccagcccacttatataatgaaataataaaatgtggattaaaacattgttttaataatcaaataagatacgtcacattattagcgaaatgttggacgggctatatatgctcaatcgatatttgttcctttcaaacataatgatgtatgatcacagaaaagaatttagcattctactctgagggaattttatggacaacagtgtttatcatatatactcattttcaggagtgacccctaaaaatagattcacaaattgtgaatgcccgattaatttgaagctttaagttagaaagaaaaagaacagctatataaataatggaacatcatttttttttctcactagtaatgcagtctcatagttaaatgaagtgaagggaatataatcaagttaaaacatgcaattataagggtcattctaattattgagacagaaattaatagcatcaaactcagagtctagaactgtatgtttgaatgggagaatgtaattgaagacggtggatagaatctcaattagcaaatgaagataatggccaataaagaaagaggcaaggaaaggaaggatcaaagtctttcaagtaaagagtaattacatgggatgagtagaaagtacacgtgattgtgttatatgcacagataccactgctagatgtcacactcatatcacagcgacaccctatatacagagatcatctttatgcagtgataattttatttcattttaaaagttaattaatgcgtaagtgcagtatagccctaggatgaatttaggggaaaaaatgggtatacagagtttggaaaatggagaagatcatctctaagaaaatttgcagtagactgaaaatttaattctgtaaaaaaatatttacactacagaatcagcaattaaatatatttaaaataatttattcatgtctgatgattaccactgaagtaatctaaatggtaacttcttctttcaataaggaagctgatgtaaaagcaactccataaaacatactgtgggtcacagcttgtcaataatttttagcccctcaatgacatgttcttcaattggaggtgaaaacactttgctttttctcttctatcatgcacagacattactggtttatttgtaatatgataagtcagagacagacattcctttaaaatttgaacttaagtaaaaattcataattttgaacttttttaaaatgattctgtcaaattgataagcacaattttaagtttccttacaaatacttaacaaaaataattttgttgtgagcagagaaatttaaaactatcaaatgatgaaaaataatatatcattttaaaagattagtgaagcaatatgagtatttcgttgatgaaagcttttctttcagcatcacttgagtatttctgtaagtacttattaaatgtctcccctcctggattgcccacctaccacttaaaacactcagtgagttttttagttggggcatgtggacagtttggccacagcttggggcagctaccacatgatagtctgggaaacctatgaactgctcctgagaacacagaaggaaaattctcagagcctccgacagtgtcatacacatgacaagggtacagttaatgtttgctgataatgatggcaaattctgttattatctaccctgcaataattagccaccttccctctgaaaactacattttaggaatgttaactataatttctaaaacttcattaaaatatataaatgcataactatgaaagaaaaagcaatggaaatgttatattaaatctgtgtcagtctgagcctaagagtataactgtaagcagagacaatatatttatttagcattcagcacagcccatatgctcatttataatctaacgctattcaggaattaatggctgaggctaactcttaaacatgagttttagacaagtcattagtcatcaacactggaactgtgctccctgaaaactagctatttccaattctaataatctggagcatatgaggatgttccttgcggcactattcacaatatcaaaggcatgaaatcaacctcaaaggccaccaatggcagactggataaagaaaatgtggcatgtatacaccatggaatactatgcagccataaaaaaggacaagattatgtcctttgcatgagcatggatggagctgtagaccattatctttagcaaactaacacaggaaaaaaaaaatcaaatgttctcatttataagttggagctaaaggaagacagatggacacaaagagggaaacaacagacaccagaggttggaaggtgggaggagggaggggaccgtgaaaaataactaatgggtactgggcttaatacctgggtgatgaaataatctgtaccacaacctgtgacacaggtttacttatataggaaacatgcacatgtacccctgaatttaaaataccccaacactttcggaggccaaggtgggtggatcacctgaggtcaggagttcaagaccagcctctgggtggatcacctgaggtcaggagttcaagaccagcctccccaatgtggtgaaaccccatctctattaaaaaatacaaaaattagctgggcctggtggtgggtgcctttaatcccagctacttgggaggctgaggcaggagaatggctagagcctgggaggcagaggttgcagtgagccaagatcgcaccactgcactccagcctgggcacctgagtgaaattttgcctcaaaaaaaaaaaaaaaaaaaaaaaagcaaacgaagaaaaaaccaaaaagaaacacaaaaatgcaaaaatgagtacaggctgggaacctgctttcttgcctttgaatcctggccctaccccttgcaattcgtcatgatcttgggcaaattgtttaatctttttgttttagggaccctgtcttaaaaagggctcacaatagttttgtcacaggtttactatgaagattaaattggacagggcttttaaagtacccagaatagtacccctaagcaataaacatacacgtgtgagcttgataaataatgattttaaaaacagcatacaccatacagactcaatacagatccattcagggaatccgaaaacactattctgctaatacaagtgggcataaagagaaacatgcgctaattttttaacacacaaatggatcaaaagtatcctacctatctagtaaatgtgctgatttatgaaattgcacgttatttaaatagctaatgtaaaaagtgacacattttaacatagtcacgtaaatgcccaatgaatgtctagtttgaagacatgtactgaaatatgttcgtcagatagactcatgcctttgaagagctatcattttgagataaaatatcccctaccagtggaaatgtgtaagatgagtggcagacccagtgccagagtcagaaagtgccctgcataagcatgcaatgaacagagcaaccgttcttgtaggcctgagtactaagatcacggctttcctgtttgtaaactgttattacgttgagttcatttccctgcaatactttcagcttaaggtctacggtggaatacagaaatcattcttaacaagtccacctatgttttgttatgatctgatacatacaaatccctaggtacatagtgcctgggtgggcctggattctgcacgtgtggaagacgcagctgttagaggaggcaccctctttgattgggccatgccaggctgtcaccaacgatttggcatccagaggccactggagcatatgagaagcagtcaaggtgccctgaatgttccagagaacattgtggaacactggaagctcaggacggccaaactgtgttgccatactcactgcagcagaggggaaagtgtaaaattacaagagaaggaggcccgtgttcaaggttgggggcagtcagctttccaactgggactcctcatggcccagccctgggctgattcctatcttcgtgttgaatgcagcatctctgctcaccccaagacagtccagtccctgacacactgagagtaagtttacagagcccaggtttccaccttgtaaaataaggatgctaataaggaaaataaataaataaataagatggaatttaattacttattttgaaaactggtgacttcacagcattatacgaatataaaagacgaaataataggaagggtctcagcattgctaatgtcaaatcagcccctctctcaatcttccaggggctaagaggctattatttttagatgcctctatttccccaaaatcagtatatttgttttctattaagactaaatatttttttcagcggcgtacggtcgctcacacctgtaatcccagcaatttgggaagctgaggcgggtggatcacttgaggtcaggagttcaagaccagcctggtctacatggtgacaccccgtctctactaaaaatacagaaaaaaaaaaaatcagccgggcgtggtgttgagtgcctgtagtcccagctactcgggaggctgaggcaggagaatcacctgaacccacgaggcagagattgcagtgagctgcactctagcctgggtgacacagcaagattctgtctcaaaaaaatataaataaaaataaaataacaagtgttcttcttcctttatagaacagttttaatgcccatataaatgtttgctcaaattgaaacaaacattatctctaaggtcccttaaaattctgaagaatttcaccaagtctccactctgttaaaacatattgatttactgcttgtagtattaaaaataagttgctttaaaacaatctgggacattgttggattctgttcagagaaaaaataatatggaactttaacatgtgcttatggcagagacttaaaatgacttttagggaatactgatgctctttcagtcataggaaaggacaacccactaggatgcaatggttttaactgacacaggtaagcattaagtagcatttgggccaggcacggtggctgatgcctataatcccagcactttgggaggccaaggcaggcagatcacctgaggtcaggaagagaccagcctgatcaacatggtgaaaccccgtcgctactaaaaatacaaaaaatcagcctgggtggtggcacatgcctgtaatcccagctacttgggagactcaggtaggagaatcgcctgaacccaggaggctaatgtaggagaatcgcttgaacccaggatgtggaggttgcagtgagccgagattgcatcactgcactccagcctgggcaacaagagtgaaactccgtctcaaaaaaaaaaaaaaaaaagcattcaggaagtttattctagttagtgtacattaaggcaccataaatgaacactcagagaaatatatttcactctcaccatatagtaaaataggcaggtattattattattttccaaaatcacagtttcagatgacttgctgagactatttcataggcagttttatacttttattctctcaggccatggcagcactggcatgatatcatgcatttgttgttaataaaatacaaaacagtccctattacaagtggtagatactaccatgggtatttttaattcccctgcgtttatctcctaaaaagccaatacctttttttaaaaaaagacctaagacagtgcaaacttcgtcctagtcataggtgatttaaaacaaatagaaaagtgactgctggcaggatgcacgacatgtaattaaaaacataggttttaaggtactgccacacacatcctaacgtatttaaattgcacgtcattcttctaacgatgattttggcaggaagggacaattttacatgatgtaaaatttgactctgaggacccagaaaacagcgcacttttggaggccacgcttgccctagacgtcggtcaatgtcccccggttgtcaaatcgctcacgtggttttctggaccaaatgaaagacaatgcaaaccgaggtgccttcattcattctgcataatagcaaacaacacaggaaacattcgtatattgcctcagattatttcggcagatacaagtcctgaaatccagcctgagaaactttattttggaaaagggtccatcaaccatggttaaacctggtcacaaaagatgacttgcaaatagtttatttgaggctgtctttaggaattcaggcagtatgaggtagacactgtcaactgacgcgccctacagttcactgcaagcttaagattctgtgagtaagattcccgccttttatctatcggaaaaatgaaaactctcataaaacagtctagtcttttaacctttataaaaaagaggaagtgtaaataaaaacataataaacaatttttgagtaatgtctagaaaagaaagatacacagatttttagtaggaaagaagataaagaaactccaggatgaatattatgggggaggatggtaattgggagggatattaaaaaaaaaaacgaaatgtttctgcatttgttattgggtctatggatctgcctgatgaaacacacggggttggcatagctgctgggtttctccctccatggtttactcagatattagagccctgtgttgaggggacccagacctaatgttggactgtgatgtaaacagaaatacacggttactgggcaaagccactgaaagcccaggttttatttgttataagagtgaaagttaattatctagtaatgaaaatacatgacattcacgttttggtttactcaaacatgccctgtaaaccaagtttgtgagtcatctctgagttcacagaaggtgcacacacagcacgtaagtgcccagctatgcaaactcatgtgtgtttatgccccaggacccataacagatctaagcccacctttgcccatctgtagagaaacacttcctatctctttactcaagaaaacatgttgagtaaatcaagatgaagcctggtgccaactgtgtttattaggaataatgataataaataatattaataagccatgaatattctaactctacctaaaagtttgcctttgttattagaaaataagaaaaaaacagtagtccagcaaagtatgtttgcagaaaagaaaaacaaaatttttccgctagacagagagctattaattgtataaacatatattaaagatcaatcaactttatggttaccatcaattatccctccaaaatgttgatatatgcatgatactatgttagttgattagtttttggaaaatggcaaagacccctagcaaagacccttctactgatgttctaaacccttatttatcatggaatgcatttgaacggaaagagtgttgagaattaatttttcatttgtattctaattaatacttttgacattagaaatcttgataaattatgaagattaaacaggcacacaaaggataattttatcttgttgccatatattaaggtaaagtggattcaaagagcacagctttttaacatattaatattttttgtggtacgtaatacatagccttgaatcatttctaagccattgaaaatctgtactcttttgcatattttttttttctaaaaagcagagagcatagtgtagtgcttaaaagcagagactcgccaggtgtggtggctcacgcctgaaatcccagcactttgggaggccaaggcaggtagaacacgaggtcaggagatcgagaccatcctggctaacatggtgaaaccccatctctactaaaaaatacaaaaaatgagccgggcgtggtggcaggtgcctgtggtcccagctactcaggaggctgaggcaagagaatggcgtgaacctgggaggtggagcttgcagtgagctgagatcgagtcactgccctccagcctgggcaacaaactccgtctccaaaaaaaaaaaaaaaaaaaaaagcagagactctgggtctggtctagttttacttacatctaagccctatcactgaagttaggggccagttaacttctaacagcctcagtttcctcaccaatgaagcagccactacttgacagaatggttatgacatttaatgattaacgctcattaatgtgaattgcttagaataatcagagcctaacactattagagtatttcgtaagttaaccaagtaaaataatacaatcaggaatacaaattaaaattttacatacacatataagcttttttttttttaactgaaagagactctgatgatctattcccatgtttataacgatgtggaatggaagctcaaaggggttaaagaataatattagtgttgtaatgagactgaaatctttgactatataaccagatagatttttcattatgaattaacaaacattttacagaaaatcatctgaaatcacatgaatggatataactaattaaacagtactatgcggccattataaaatgagagcatgtcctctgcagggacatggatggagctgggggccattacccttcgcaaactgatgcaggaacagaaaaccaaataccacatgatctgacttctaagagggagctaaattgtgagaacacatgggtacacataggtgaacgacacaaactgcggctcagtggagagtggggggggcggggaagggagaggatcaggacaaatggatactagacttagtacttgagtgatgaagtcatctgtgcaacaaacccccatgacaccagtttacctatgtaactaagatacacatggattaaaataaaataaaagttgaaaaaaattcaacaaggccaggcgaggtagctcatgcctgtaatcccagcactttgggaggccgaggcaggtggatcacgacgtcaggagattgagaccatcccggctaacatggtgaaaccccatctgtactaaaaacacaaaaaattagcagggcatggtggcaggcacctgtagtcccagctactcgggaggctgaggcaggagaatggcgtgaacccgggaggcagagcctgcagtgagcagagatcgcgccactgcactccagcctgggcaacagagcaagactctgtctcagaaaaaacaaaaaacaaaacaaaacaaaacaaaaaacacaaaaaacaaactaaaaaaaattgaacaagatagaactaaaagcattgttcttacttgtctgcaagatactggtgaagtggaggtcactaaaacatgtgtctcatctgaactacaactgaaaatgcttgtacttcatccatgaatcactgttcttcagctgtttaagctttctatgttgaaagaaaactacaagatacattgaaagaaaatgaaaagccatatgtaaaattcatcagattgatttcagttctttgtgcctttaccaaatatatatactctccttccactgaaaaaagggaaggtcattccaaaaaaaaaaaaaaaaaatggtggttcagttcatcctgtggttaaggttgaattgacttcatctcctatcgaatgatttacaatatgagtcagcaaaatcaacagtcagtttccagacctcagcaacatcaaaatttgacaacaattcaaagatgaggaaagaaagtgagcattagcacaattcagctcccttaaaccaactgcacccacaggcaaaacacccgtagaggaacacgtccctaaggatttcactcgaaatatgcaagcttcccgctgttgccaattctcctgcaacaaaagtatttgtgttttcatctcaatagccattacagacaaacagaaaaccaaaaacgtgggaaggagaaggatcatctgcattgcaaatatgacgcgtcttcactccagtgcaccaataggcatgttataaaggctcaacagatggctttaaaaatcaaagttaaaacagcaaagatgattgaatgttaacaaaatatagttcgttaggattataaattagatgactgtctagataataattttaatagtttcataaagtatgcaattacattgtcccatcaagcttcaggaggagctataatcagcagttcttggatgtcttagagactctttctcttgctctctttggctaagttgtgcctggaacatcaagaggccaccatcagaattataccttcctctgtgtggctctccgtgaatctcggtagcactgatgttgaccaccacataaactaaagcccgtttaagacaataccccctgacctttcagcaacaggggcttttatctacatcagcaccagctagtgggtattttactcttcatcagctttgccctataatgagaacaggttgggccacagcagagggcatatttgctcagggatcagagtgagaaaaaccttaaatctgcacttaaatcttaaatctgtattgctcaccaacatgtcgggtatgaggaattgtctatgtatttgcactttagtgacttctatcatttccattttcaagaatttccatttgtttcaggctcaaacacaacctcctcactcattacttgtggtaaacgctattaagcccaagatcactcatgttcctgtattctgtccttctaggaacttgattccataagtcacacctttaaggacatactcactttacctaagagtattttctgtacgtggtgctacccttcctattttcataatatttgagtgttttgcaaatcaaatgcaatcatatctttgtaactcaggaactgatcttggaatatcttaagttaatgtcattatgtatttatcttatttgaaatacatcttttgagcagtgacatgtgccttaaatttactttgaattctctgagctttcaggaaagacatctgtaaaagataagttgcccagtaccatgcatttaacctcagctctttggagtcataagcagggctgaaagcaaagttgtagctgccacaaacgtaaaaccttaacgacagggtattgtgaaaatacgttgcatcacacgtgtattaaaataccatgcccataatgaaaaccttgctttcaaagaacgtcctccaataaaaaaaatactcaatatatactgccagtttaaatgtactgagtatcaaaatgaatattcctgggcttccaagtctgtttgcttctctgttcacatccaggtacccatgccaggtcatgttttccctggatggaatgatggacattagggaaggtgacgatggcttcagtcttgctgatattacccaaggactggctgaagaggtctgagtcacaagaggctgtgggaaaacaaatgaaagaggcagaggatgagggtcccaccgggccctctgaggagccaatgagtgtgctgtcaagggaggcccagtgtttagtatttacccaaacacggcaaaccacagctcaacaaagataaaaatcggcatttcaaggcgcaggaaccacgtctccacaggagaatgtttaacaagtgattttggctggcaagttatggaatcggacagggatgacatcgaaggatgctatggcgagaagagcaggaaaacagaatacagttcagccgtgtttcccattcattcttcagcaccgagaagcctcagcagaactggccacctccacgaaggaaagcggcaggagaaagtacaatgtttaatggtgggaggtggggctgcaggtaatttatattctttcctaagtaaatgttctatgattactatatatccccttcataatgtttttgatatttaaggcatgatattaaaattatagtaactttcatatacaaaaaatatattaacaatttcaatctactgtaaatgttatggtaggcatacgttcaacaaagaatgcagaatgataaaaatgaccaagaaaacaattaaaatattgccctatcaagtctgtacatgtcatacctgacactactaaatttctttcgtccagcaatcaacactgctgcttttaacaccaaatgaggagtgaatttagaaattataatgaaggaataatataaaatgttcccaagtcattcctataggatgggatttagaagcttcaggagaaaaccacagacctaatttgccatgttgatattgctcacattggcatcagtcatgaaacaatggacactccaaatagcttgtaaaatatctaacaataaatggtgacaaaggcctgaattacaatagcgccctgtcacttttctaataaatagtgattatcatgtaaataatgccaggaagcatctcaacaactatttttattataatgttggcaacagcaaataaaaagtacgccattttcttttgtttcccctttgacattaatttgctaacagagtaatcatacatctcccacattttcttgcaaggaaaataaaaacatttaataaaatggggaaaaggatcatacaacacaaagccatttgccaaagttcttcaaattatgcttaacagatttcattatttaaataaacattttttttaacacatataaaacattcacaaccttcatgagactctttggtcactatgagttctgcaaagaaaaaaaaaagtttgtttcaggatctcccactgtattatacccattttcattggtcagccacataattagaactgttagttctaatttaatgggagatcacagtagaagaggtgattagtccccgggtgaaaatgaatatgagaatggactatctagctttctttcatctgggaattttccatctcttcacattgtaacttttttcactatctacaatttaaaaattacaaagcagtattcagctgttacgcctagaattctgcccatgaaattggaaacagaaaccagatgaaacattttaaaggaaaaattctactttgatgacagttctatccagaacatgtgtgtacactgacttgtcaatggaaaataaactaaaaccttgggtgcatacattcgatttcaggcagattttttaatttgttttttaagagacagggtcttgctctttcacccaggcagttccacaatcataatattaataggcagaaaaggcaaattctatagaacaggataagttaacaaatcaccctaacaaattggatcttctataacattttttaaaattataaaatctgtttgacccaccgatgcaagactgtgtcatgatttaaaaaagacgagtgtggcagtacagccttaatgtgctcctcgtgagtctcaccctctgttgttcacatctctgtatgatcccctgctcttgactgtgagaaagacttgtgatgtgcgtctgaccaatagtatatggtagaggtgagcgttgtcactgtcatgactgtgtgatattatataaggctgcatcttgcctggatggagttatcgatgctccttctaggcatgatgaagcagaggctgtgttgaagaattccacgcagggagaaattgtggaaatggcccccagacagcaaaacgtcggggctctccgtgctcatgccaggaggtagtggattctgcacacaacctgaatgagcttggatgcacagtcctgccctcaagcctgtagatgaggaggcagtggaattaacgccttgatcatagcatgcgagacttacggcagaggactcagcacagtcccaccccgagaaaactatgagataaaaaatgccaggccgggcgcggtggctcacgcctgtaatcccaacactttggggcaccgaggtgagcggatcatgaggtcatgcgatcgagaccatcctggctaacacagtgaaacctcgtctctactgaaaatacaaaaaattagccgggcgtggtgacgggcgcctgtagtcccagctgctggggagactgaggcaggagaatggcttgaacccgggaagtggagcttgcagggagccgagatcgcgccactgcactccagcctgggcgacggagcaagactccgtttcaaaaataaataaataaataaataataaaaataaacgtctgctgtgtcaagccactcttttgtggtcattgagtttacagagcgctcatttgttctatcgctgccgtacattactacaaatagagcggcttaagagaatacagtcttacttttagttctgtaggtctgaaattcaatacaggcctcactagacaaaaatcaaggcgttttcaggctacagtcctttctgaagcctcttagggaaaatctgtccaatgccgattcaggtgcttttagaatccagtttgttacatttatggggcccacattcccatttccttgctggctgtaaactgtgagtcattcatttttagcctcaaaagactaccacattctctggggtcatagccttctttgtgaatcttcaaggccagcaatgctgggtccagtcctcattgaatctttgtgacccattcttctgcctctttctactgcttttaagagttcacatagctagaataggtccaccagggtaattaggatggtctctatctcaagaccctttatcttatctgtaaacccctttttcccataaagcaacctattcacaggctccagggattaaggaatgaacacactgggggtgatatttagcctgcacatgccttcatagaaaacatatagtgaaagttccgccatcttcattaaattcccacatttctaagagtttgttcatgttaaaatttgtttgttctttgctccaattttagtcatttgagcctcaccgcccctcacaatatctattctacgctttctattttttaatgtgaaaatatttccttttctgttaaatttaacaattattcactgagagcttgtgttctatgggaaatgaaacatcaagatgaagacaatgcaaagtgtgtcctcaagcagttcccagacaaactacaacaaggttatcacctgttctcctacggtcaaaaaatgtgtataaaagtcctagcattttccagtaagagcatcatgaattctgagttattcacagataatttcgtataaccagatagattttcaaattgagaagtattaggcattaagtattatgatgggtaatgttatacaacaacctgacttggccataggatgcccagatatttggtcagacattattgtgggtgtgtctgtggtggtgtttttacataagatgaacatttcatttggtagaatgagtaaagcagatttccttctgtaatgtaggtgggccccgtttcatcacttgaaggcctcagtagatggaaaactgactctctgtcaagtaagacagagttcccttgcctgatggtcttccaactaaaacactggttctatttctttggagagccctggctaataaaaatcatcttccagctggacatggtggctcatgcctgaaatcccagcattttgggaggccgaggcaggtggatcatttgaggccaggagtttgaggccagcttggccaacatagtgaagctctgtctctactaaaaatacaaaaattagctgggcatggtggtgcgttcttgtaatcccagctacttgggaggctgatatgggaggattgcttgaacccaggaggcagaggttgcagtgagccaagataatgctaccacactccagcctgggcaacagagtaagactccatctaaaagttaagaagaaaaaaagcttcatccatttcatctattcattcatttagtaattctgtacacattgtcttctattcattggcttgactctgggaataaagtaatgaataaaacatgctatctttccttaagagttgggggcacagactgcagcaatgaagaagtatttatgctcagcgattatcaaagcgcaaagcgagggaagtctgggagtctgagttaaggtaagttttacgggagaaggttctttgagttgagtcttaaatgatgatcagcagtcccgaagcatgatcaggggagtcattccaagcagagagtccaaggtagcaaatacaaagaggtgcggagcaccacatcccattaagttatcctcaactcattattacagaagcacagaaggtaaaccccagagaagtggcagcaggggctggcaagcccgacaagagtacgtcatggtggacctgtgtgctaagccaggagcctgaactttgtcctacactgtgatggacagagacttttcagaattttcagattggcaatatagataagccatacctgtggtggttaggtaaaatatggatttgggggatgagaaagaaatcactagaggatgagaaagaaatcactaggatggatttgggggatgagaaagaaagtgtctagaaatatgacactttcaggaacgtgcacaaggaatttttcagcgcctttgattttaacgtaatgagtctttaagcatatagatcgatggataatgtcccattatcaacatagcttgccttttccagatggggctggtaaaaccccaaggactacatggatactaagtgtattttaatataattggttttctttgtaatctatactttctatgtgaattttgaaatactattctaagagttcatcgactttactagattaacagaggtcatggcacaaaaagttaaagtaccatctcaggagagacagcgcaacaatatcacgtatttccccttccttttaatttaattaaaactatttttactttccttccacgcaggttttttttgtatttccgtgtgtgtatttatctttttttaagacagtactgttgctcatttcctcctgtaatcctttgcaaatgagcaaagttcactttcaatcccctatgtacagtgagctctcatcctctgcagtctggcaaaacccctgaggtagtagagccagcgcccagctcaccctgagcttctgctgtccgtaaagttctcatatatttgtatgagactgcagaacgtatccagcacagcactggggatgatcctactttcagaaacattaaaaaatacaataccaaatatcctcttgaggttagacctagcctatagtgtgaacacgctaaattcatacatcttctgctatggtcattgatatgcaggcagtgtatgggtgctttttcatagtttgaggtctgtatctgaagtctacctctaaagcacatagatgctttaataaagatgcatagtgtggtggagtgaaaagaatggatttggtgctggcattagctgtcaagtcatgtaagtctattgcatctcagtttcctgagaaactccaattaaaaaggcaaataggaatatggtgtaaaatgtcaattttcatttaaatataagcgatcatcagtattgaatcctctcggctaccaaaggagctaccggacaacagacaaaccaatttatctttgattcctcctcaacgccttgcattttgctttgcataaataaagacttcaacccaagctcagtgtatgaggctggacaggcaaggcagtccagatttaatattgttaatccagtgccatttctcagggatcagatgctttgatcctcttaaaatattttcaaaaactgaagactcaaggataacatgctgtttagatagaaaatcggatgacttttgtaggtttccactagataacagcagcaacaaaactcttcctttacaagggcttaccatgacaatatttttaggcccttagtggaagacaagtcatacattttgtggtgaagtacggttacaaggagtttcaaccaatgtagaaaaaaagacctgaatgaaataaataatggtgactattaaaagttcaagggccctggacttgttgaaaattatgttgaggtgccataaaatcctgaatgattagctctatcaacaaatcatcctctttatatttttatgtaataagttatttgagattataacaactgaatgagatttccttcctttaacattatagtctgaaattgcaaaagctcctttttaactacctggacaaaatccagttaaatgttatgttatgaaattctggccagcatttcaaaacaattcctctattcaatacactgatgataattaccttttttcagaggataatttttttgttaattatgcttagagtgtcacttagatatggtatgctgtgtttagagtctgcttagcaaagcatgattttttaaaagaaatacaactttaaaaagcagaaaaaaattaatgaaaatttgatttaaaagaataaccccacagccgtctactcaacactcttatggtttaagtgacaaagttgaatctcagagataatcacttaggtaaaaaatgagaaattatttagaaatgtatattaatataaatgcctgctgtgctatccttatataattataaatcttggcgggcctggaggctcatgcctgaaatcccagcactttgtaggctgaggtgggaggatttcttgagactaagagttcaagaccaccctgggcaaggtaggaagaccgcacctctacaaaacataacaattaaaaaactagccagacatggttgtgtgtatctgtagtcccaactactctggcgactgagatgggaggatttgttaatggagacggaggcttcagtgaactattgttaggccactgcactctcgcctgagtgacaaagtgaaaccctgtctcaaaataatgatgataataataataacacatctttaagaaacgctaagctagtttaaagtatatgcattcatgtcttttctaatctccataactaaatgtcagaaagttgtcttattagtttactttttctccacagcgccgttcatatcagtgtggaaggcatcatgagatactacagagacgaattcaaacaccattcactactttctacctagataaccttgggccaatgtcttacctttcagagaatcagtgactttgcatatcaattacagatacctttgtagaattaaaatgactactgtaaggattaagtactgttgtgtatgcagaggaggtgatccaatacatggcacaaagaaaatactggtgagtatggttgtaagtaaaaaaattcagggccgggcgcagtggctcacgcctgtaatcccagcactttgggaggccgaggcgggcggatcacgaggtcaggagatcgagaccatcttgggtaacacggtgaaaccccatctctactaaaaatacaaaaaattagccgggggtggcgctgggcgcctgtagtcccagctactcaggaggctgaggcaggagaatggcatgaacacgggaggcggagcttgcagtgagccgacatagcgccactgccgtccggcctaggtaagagatccagactctgtctccacaaaaaaaaaaaaaaaaaaaaaaaaaaaaaaaaaaaatcagaaaacgatatgcaacaactgtagaagaaaattgaaatataaaatacaaataagcctttatttacccttgaccaaagttttcatttctataatttactcaagtgttatacctatgtgagaaaatgaagagctaggaaaaatagtttgaaaaacatgatgattggatacatggactcttgagagtctatgaagggaggtttatgtacctaacctcctgcacgactgctgttcaaattcttcagtgctccttatagaaggatcttaattgtgtctaattaacagtgatgaccattatacatggaaattttggggggggggggcgctgcattcatttgccatgctcaatagcatttattcaagccaaccacaaaaaccctgagacagaaaacaaaaatgaatcctacttgcattttgatgattatactctggatgagaagaaacgaggacattggaatctcccagtcctgctgtgggttggctcttaatgcttgcctctcagtttaagagtaaattttgtttttttgttagtttttttttctagagaaaacatctttcaatcagccatttctaggacgggtgggatgaccagctgtgttagtattattactcttataatgacgcaacaaaatgagatgtgactatttgatgaattatgccttatcttcacaattcagttaagattttattcatgttactgattatgctttaaaaaaatgaagcatctgcctatttgcttttcaagagctcacttacaatatggcattttaatgtcttcatgtatcattctgcacacttttttcttctaacagttcattcttaagctttttcacaagaatggaagaatgtagaggtcgtggaaatgtacaaaatgtttcattacgtaagttttaactaagttttaaactaggtcttcaataacaaatttgcacttttatacttaaaaatttaaaactctatttgtcaggacatcagcctcgacaaattactcctgtattcattcaaaaaaggttactttcctgcaatctctttgagtatcatggtggatattgtaaatttcctctcgaatacaaccaaccctgtagctacactcataaaactttcagtgaaagagggagaaccacactaatcaaacaagtactcaaatatttacttaataactaagtgttacaaagggagaaaatgatagtgatagaacagagaataaaactgaggattcaaacgtcagaaaatacctagaaaaagagggcagtgaagctgaaacttgaaacatcaaatgcaggtacctgagaaatagagggtgtcctggagaaggggcatggactgtgtggacacctggagtgaggagagatgttggccttatctctttttgcagttgtgggaggagaacgattacctccaccaaagatgtctgcatcgtaattcccagaacctgtgactatgtttccttacctgctgagaggatttgacaggtgtgagagttaaggattttgagcaagtgagatgacttgcagttatctgtgtgggttccctgttgtcataacatttcttaaaagctgaaaaccttttctggctcaggtcagagggacatgtcatttaaaaaatcgtcagtgagatgcaaccttgctggctttgaagatggagaaagaaggccacaagctcaggaatgttggcagcctgcagaagactgccctgactccttcagaaaagaacacaggcccctcaacaccacggggtcggctcagggagacccatctgcaggttagaagccaacatcagccttccaacctgtggaaatatgaggtgagatctttgtggtttctatgccactacatttgtggtaatatctcacagcagccagaaaaaaatccaatgtgcttttcttctttctataatgaagaaaacatgtttattctcgatgagcaaacggaagactttctgtgaatccaagtaccttctgttattaaacagctgggtgtgaatttggaagtcagtgtagctgggagacttagaatcaaagagcagctgtggcactcaaaatatgtatggctgggggtggacactacacacattggaagttggttcctctcctggccatttgtaagtagggatcacacacacacaaacatacacacacatacacatctgcacacatatgtacacgcacatatacatatagacatttgcatatatatgtacatatacataagctaatttgaggatggattaaaactaaaacttggtcaggagtcatggctcatacctgtaatcccagcacttttggaaggctgaggtaggtggatcccttgagccaaggagtttgaggccagcctgggaaatatggcgaaacctcatctctacaaaaaatacaaaaattagccaggtgtggtggtgcacgcctgtggtcccagctactcggaagactgaggcatcagaatcacttgagcccagtgggcagaagttgcggtgagctgagattgtgccactgtactccagcctgggtgacagaacaagactctgtctcaaaacacaaaacaaaacctaaaacttaaaggatctgtcagttttcaagtcctgaaattcattgactgtgcccatgtggtgctgtgtgcctgagatggaatttcaaagtggtttttcacaccagaacatcctcttttttctaatacccatttatgcaatgctaggaaaaaaaaaaaacctcaatttggaagtttttggttttctttctcagaatcagaatagttttttaaaaatgtcctatttccacttctaggtgagcaaactgacaacatcatttgatcatctgttctacaaattaggaaagatagaaacccaacccataagctaattccaaaaccacttttccttcatgaacacctgagattttgtcagcactttctagattgtaaaataaaccagattcaatttccataatttatttcctcacctttcaaagtgtagaagaaattatgacaccttttctatactgagaggaagattcaatctgacaaaaataattgcataaaagtgtgtaaggagacagtaggcaacaagcctaaattattttataaaaattattattagtagtattttgagacacagtttcactctgtcacccaggctggaatgcagcagtcagatcatagctcactgcagcctcaacctcccagcctcaatcaatcctcctgcctcagcctcctgagtagctgagaccacaggcacaggtcagcacacacagctaacttttatttaatttttttttacaaagacagggtatcactatattccccaggctggtcctgaactcctgtcctcaaagatcctcccatctcagcttcccaaagtgctgggattacaaatgtgagccactgaatctggcctataaaaattgttttcttattataataagaataatttacctccaattttctttctcatgtattcaagcaagagtaatttacctctatttttttcataacaatgccacagagtttactgtaaacatcaaatgctttaaaaagaaacatgatttaacataaacacatttatctcaactctgttgaatgaaattgttcttagagagaaaactgggtgaagaaacatctgatttaaataatagcattgcacatttctctttggtagaactctatttcaaatatcacctacattatatcatatttttgctgctcatatagtttttacaatagttccttgaaaaagattattgttatttactcagatattctaaaataagtatttaatgattgagataaatgtcacaagggaaaaagtgtgaacaattttttagccttggcatgtgcctcatctctttttagtatcaccaaactgatatttatttcatgatgcgcccatttatatacttacaaaagcaatttagttctacaaacaagccactcgaggtaactatctttatttcattttatggatgatgaaactgacattgaaagttgacggaactcactgaagtgacacagcatataaatgatggggtaggatgaagccctgacaatttccacccaggagccacacagagtgagaaagcctctcattgtaacggctgttgtggctcatttgggaaatttttacaaagtttcttcctaccaaataatagaggtttatttcagctcacttcctaggccactgtgagatgaacagctgtttgggccatagaagaaatagatgcctgtgttagatatttgtgggggtaaaaatggaaaattctcccccattaacatatgagtacaaataaacatcaaaaaacagaaaatgaacttcctattatgcactgtgcagaaaatcagtaccgagtcctcctgcagccacgtttttctgactcccaagttacttgctaccttctttttcacacgtttccattctctctacttcaggaattttctttctctttcttcagaaactacatagttcctccccatccatgccataaatcttccctggatccattcttcccaattcaaaggacagaaagtgagtaaataggataaacaacgcagggaaaaggatagggagggtattttaccttttccctggctattattcagaatatatggaaatacatgctgaaaaatgaggatttctttttctttttttaaatactttaagttctagagtacatgtgcacaaggggcaggtttgttacatatgtatacatgtgccatgttggtgtgctgcacccattaacttgtcatttacattaggtatatctcctgatgctatccctttcccctccccccaacccaccacaggccccggtatgtcatattccccaccctgtctccaactgttcagttcccacctatgactgagaacatgcggtgtttggttttctgtccttgtgatagtttgctcagaataatggtttccagcttcgtccatgtccctacaaaggacatgaactcatccttttttatggctgcctagtattccatggtgtatatgtgccacattttcttaatccagtctatcattgatggacatctgggttggttccaagctttgctactgtgaacagtgatgcaataaacgtatgtgtgcatgtgtctttacagcagcatgatctaaaatcctttgggtatataccctgtaatgggatggctgggtcaaatagtatttctagaggatttcagaatatttccaatgaaaccatatcatttctttaaatggtagttgattatataaagattgttctaatatttatgacttttgagtgattattttgtgggctcctagaagcaaattgttttaatacaatattatttttccatagttcagaaactaaatattttataatttagagttgggcaaattgccctcctctttgaatggataaaatgcctatttcatatagatgtggataaaattataaatctataaaaatgttttagtagataagatcacatattcctctttaaatgtgtatacctatttttctatttacatttgcaagaggtgtattatgaatgccagaaaattaaagtgttttctcattttctaaatagtcttaaaaataggacagttggtaaaaataggataatttataggtatagtaataagtataagattacaagttgacgtagataggaaatgaatgtgaaaagttgtataacatgcaaatatagccagcattcccattatttcaagtgacagaatgaaactgtacaattatggctggtctaaaccatgttaacgttaacttttagtggctaggactcgtaattatctgactagcaacaaattagcttaatagtttagataaattcacacactcatggaagattttaataagcaaatcatattttgtcttcaaccaactattttacagtcatttaattgaaccatatctaaaattttaaatagccgattaaaatgtcttattcatttaaaattaatatttcttaaactgaagttttagtttcaaatgtccatcaatagaaaataatgttaagaaaatgaatgaaactgaaatattaggtttaatattcaattcagtaagactggcaacattttcattatgaagagggggttgtttatgtattcctacataaattagtgtgcattcacatgtacatttcaaaagaaacatttttctgatgagtgtattaatagcaaaataacagtagatactgtaacatttcgataatctactaggatagcaaaccattagaactggcaatagcaaaagttacaataattatgttgaaacagatgcaacctcagccctggtgatgtcagtgataattggttccatataggtggagaaattagtcctcatggagcaacaaacataactatatttatattaaatagtctatttcttccatgcctaagaatttatctttaggcaatattcattatagcatgaaatagttaagcagagaaaagtttaaaacctaaaagtccaacagtaggagaatatgtaaatatatgagggtaattcacttttgttcagatatgtgtttactatctatttaatgcaatatcaggacaagcaatttcatacacatgatgattttcttaataaaacatatccaaacatattgtggaggctaaggtgttagaaatgaaaatagactcagctatggaacacagatatttcttcttgctttgaaaggtaactgctcctgttataattgccttctcggtcaaatacacagaggacaagaaacaagaagaattagaaaaaaagactggagaagaaataaaagcaaatcaggtcttatttgaatccttcctggagtaagagggaagcatttccccaaggaattgagttactggcctattataattaccatgttatgaaaactctattatggtttttcaaaatttctttggctataaaaaattgataattgatgtttctattcatctgcgttctgtagtttattaatctgtgatataccataagaacagattatatttttaaacttcaatatcagattgacttgactcattctattttctttttcctactgaaattaatgttaagaaaatgaatatagagtcataaaactaaggccgtgatatgcagtagaatgacataaaaccaattatgcaaaacatcatgatgagtcaagaaatgattaaaaatatagcagaattaaggcaataaaaagcatggaatatggagaatatattgtcgtggaaattttgtattacagaaatcagaagaagaacatctagaaaactgtccggttttacagttgtttaatatctggttggaaaattgaggtagcaataagtatccattcaaaataccagggagtgtgagattttcttaaatttctttttatatatgccctgtagacataacagataaaaacttgaccctttgcagtacgcaatttagagctgaaaaacctaccagtgaaagctgctttctgcttatgccgtgaaccataatgaatccaattgtattctctcctgtctctgacttcttgcttcttgaatttttctttttttgtcctctcttcacccttgctcgctgatgatttacagtgttaacacatcttcatgatttctatctaaaaccaaaatctgccctagagcccaaggttctttccagatgtaggtggctttatcgctcaccttttcaacacttttaaaaagacacttgcccagatttctaaacgaaaaagaggcagccagctggcctctttccttcatttcacagcttgctcttcagtggttcccatctatgagacatcttccctcaaactcacagggacagaaagaattccaaaggacacatagattcccatccttctgatgccgaagactctccagggttcctgtggaattgtatgaggtgtgaactcctcatcaagccaagtgaggacattgtcacatctgctagttcccgaacacttcccttaacctcactcccatggcccctcctctctgggaaacaggagccgcgtgagattccttgctgccatgctgcctcttctggcatttgtccacctgcctttccttttccctgtccccgtgatgcaggaaagacaagcccccgaattggggcttagcctgggagggttgttggcttcacccaggaaggaaatcaagggcaagccagtggtgtcacacagcaacttttattgactgaagcagcaccagatgtcctgctcctagcacagcaggactacaccataggccatgtgcccagagtggcagctcagaggctgttctacactcatatttatatccactttcaattacatgcaaaataaggagcggttaatgcagaaatttctagaatgtaggtggtaacttctgtgttgacaggtggtctccatggaaagcggtgaccacgtctgggtgttgctatgacaatggtaaactggcatggcacactggaggaggtgtcttatgaaaggctgcttctgccccagatctgttttagctagttctctatttggtccagtgtctaagccctgcttcctgagtcaagtcccacctcctacctcaccagccctgtaccaggagagctcctgatcattttcctccttcctgggcaaagcatttctcctgtcactgtgtgtcaaatctgatgctgcctcagcccatctgtgggagctccttcactccctccccaagccagcatgctgggcatgactttctcacaggaggggcagaggactgctctttgtttgtttctttgatgctttcattttcatcctctactgttagattccatgtcaagtgtgggattgtgctgtgtcaagtaagttgtatgataccaactttgagacattcaaatccaactttttcttctcaggattttatagtggaaactggtgggttatataaatctcagtcattttaaacaaaaaagatcaagtttctaactttgaactgcaaacagacaataattcaggaaaattttcttctcttatatcttagtgtgaaattggttcatctttgacttttaagaaagcacaaataggaaacacaatatctgaccaattttctaaaatgtttagagcaaaacaatagctaattaaataatatctcattaattatacaattagccaagaaaaaaaaacacttatctgaagaaagccaattttccacttcattttgctcatttaattgtaatgttaaacactaaaaatcacaaaatcttcaacatactgaaatatgaaagatcttttgaattcaatgagtaaatacgagcatatctacaaggtctcaagactatcagtcttggaaagaatcatgtatctcgggaaagaaatgtttcacagcagtgttgtcttcttggtccctcagaccatattttctataagaaatggttgacttaatgaaaaactcgattgtctggagttctgctttaaacttctctaaatgaaaaaatctcttcaggcaattactacaaacagaaagaaccacaatgaaataaaagtttcaaaaatattttaaaatacaaacacatttccttccttaagaaattcatgttcacatatcattgtacattacattttgggaattttcttgctgttatatattcctgaaatgtgtgttctaatcactaaataatttatccaggaaaaacatccttgtacatgtatttcagggaaagtcatttgcctttttttttttagctggcataaattaagcacctcagatagggggaaaagaaactgaaagaaatccaaagattgatcccttttctttggttcttttctttaatctgctatcattatatccaactgttaaatttctttacatttcttttattccctgtttttctttgaagtaatgcaattcatttaaaattattttacctaaatcagcatcactgaattttgtctacaaacatatagcagtttacgcatgacaaatgagaagattttagctcattttgaaaatttcactgggtgtttgaatgtatttattttcagttttatcttttgtatacttttgagcattccaagaaatgtttactcaaattagatagaagttttgctgaaacggcaaaagtcatctccaagttgctccataagaacagtaaatatcccatcgtactaaaatctgtaaatatggcagtatccttagctgaaatgcagactttaggcaagttgaacatgaagcaacctgactttgcaagtggggagttgacaaagagccctgcaaatgtcaacctccttcacaaactattttcttcaaactgtttttacatacttctggactttagatgataatttttcagtaggagtctttgagggtgagaaaacactaacttgctttaataacccaacatcatatctacagaaaacattcttccaacatcatcaatgtactattaggaagaaagggtaataaagtcaactgtattcctatcttagagacatttttagcagtatgtcttctgttataaaatagcagttgaaacttgcatttgtgcagctgtaatgcaataaaaggaccttaataattccttttcaactgtaagaaagaatatgccttgtcaacggaacgtaaaagtcatgatttcaaagaccatgtaggagaagaagtgtcctttattatgataaaaaagactctgtcacttccctatttatatatatatatatatatattattttctctccatgttgttttaacttattataccttagctaattttgcatcctttaactgactgactcagataaatactattctacaaacttagtcaaaactagatacctaccacccaaatatgtatctacaggtaacttgaagaaaatcccaccaattaaaaggctttacacatagagaatctcactaagatgaaagccatacttttcatgttttgacattaacgtcccaggtagttcagaaaatcatgaaaaatgtacttaacatttgtcctttcagactggcagatggaagcgatcctaaagcttatttagattagacattataaaattttgaaatttgtagcctttttttttctaaaataaagaatagttgatcaaggcctgacattgtcagtaggtggtagttatctaaacaatgatcctgtctactactgccaccatgttatcagtaaagtacaatttttaaaaatctaagaacagaaataattagttatatgtaaccacatacatgaatatgaaacattgtgaaaagtttacaacagcggccttattctttttttttttttttttttttttttacaagctattgaacaatctcattgcttttaccagccagttcatggactggcatttgggaaacacccttctagtccagctttccatcctacaggaagatgaggacaacagtttagaggctgagctggaaagaagacacttcttctcattcccaactagctttccttccctcatacccactgaagacctaacacctagcgttggcttccaagtcatgttgcctctcagtctttgttttcttatttttaaaactgagttactaatttaagacccactctaaggtcactttgagctaatgtctaagatggaagaatatagatgcttcacccagtggagcatgcttagactcaaagacaacatctggaaaatttcttactaggatataaaccaaatggggagagacatagttgagaatgtgaatcatatttcactaatgggtacttgttgtctatgaaccagctgggtggctccattctgtcagcaagtgaggcggggtcctgtcaggtctaatgagcagctctgctcacaccacacctctctgctccagacatgcaattcagagagtttctcaagggccgtgcacaaaaaaaggctattctttgaaatttacatgcttcaatccatcctaatcactgctggtagtgcttatggtaatagctaatatgtgagaacaggaacagttgcccggatactggccagttactagaatgaaaaacacttgctaaataaaatttggtggtgcgttaatgtagaaatgacagacacacaacgtctagaaataaaacacttttgctctcccacttgcaacgtgaaagaaaaatcaaatgtcagctttctgtttttaatgaattttaaaatgcagagtagggtgattgttgctcagcaactgagatgaaagcagccatgggccctccctggtgggaagccgtgggctcctgtgtgatttcctgaaagggtgggaatggggtagaacatggctgagatggggttccctgccagctgtggtgagggtggaacgcaaactaacttgcattgagaaagataagaaaagagacagttattgaaccccagtgtttaggctgagaatcagatgaggtgaaggtgaggtcctacagatactaatgaatgaatggagggatgactcattaattagacactagcatacgactatgtaaccacagtgcatttaacacatggtgtctttcaaggcacacaaacagaaaggggcaaagttctgacgatgtaagtaacaatggacaaaaaggaaaatgcaaaatgatcaataaatatctgacctactgaattatccagcatcttactccctcaatttcattccagtttttttgtttgttttgttttggcttagttcttggatctctactttgtattttaatttagcacatctttacataggatacggctcaatagatggaaattaaatgaatggactaaaatggaagtaagccttgaaatgtttgagacttttacaagaaaattttaccttattaaaattagtagtaatagtattagttttattatttgagaaaaggtctcactctgtcactgaggctggagtgcagtggtgcgatcttggctcactgcaacctctgcctcctggattcaatcgattcaaatgcctcaggcttctaagtagctgagactgcaggcatgcaccaccacacttggctaatgtttgtatttttggtagtgaaagggtcttcctctgttgcccaggttggtctcaaacccctgagctcatgcagtctgtctgacttggcctcccaaagtgctggaattacaggcatgagccactgtgcctggcccaccttattagaattttgaacagaaacactgagtatgtatttgcatgcacgtgtatgtgtgtgtgtatgagtatgagtgtgtttggtgtgtgtgtagctaacgtggatataggcaagagttcatcacagagaactacatattcccatatttgacatatttcctctaaatgctgtgatgcacatttcaaatgtagtataactttaagagaagctcaaaaatacgaacaaatttgaaataaaaaaactatgaccaccaggtttagatagcgtttttttaaaaaaatgtatattcttttttaagttttacaacttgtttttgttttcagctcacttttaatgagcacaaacgaagctcacttcacgtgagatacaggcacagcttactctgtcaggattactgagaaagtcaagttcaattctgcctcagttttaatgatttcttccaagctggctcagagaaagccatggaaccaacgaaatacaaacaatgcttctattccggacaagtgaataggtctcagttctcagggtgccaacctagggagaggggacgcatcccaaacaggggctgatagggaccttgtgtccacggcataaaggcttaaccagctgcgacctctaggtagaaattcttgatcagagatgtgcttttctcctgttcatagccaaatgctgtacttttcataatattcatctcctccctccccaccacccaatagttacatttggcttttagatgtccacagatggcacttcctttcttgcaaaaattttagatagaacatgaataacagattcaggcaaagataccatgtctgaatcattagtaacacaaaagactcaatgcttcctgaatattttacactgagaaaagaatttgggggccggggttttatgaatacatagagagttttttttttttcttccagagaccaggatcctttacattgttctgataatcatagatcaggcattttttccctaaaatttatacatgaaatatgcaaaaacatgtttactttgaacataaatttggatcatacaagaattgaaaataattttaaatgaggttttctaaaaacacagactttaatatgcagattctttaaaactcaaatgtacatgtgaatcttcatgagtaatacttcctgtcactttttctttaaaacattgttttcttggtggaatatctattctctccttttctggcactaacatttcaaagaacacagtgcatggaaaaggcagggtttatgtgattaattctatgatgttaagaataaagcagggacaaaaaaattaaacaagaacaaagagaacgtggattcatgcaggactgaacatgccagtttcttttgttggcatttttatccagacttaaactcagagagtggtgcccatttcagccacaaatagccagtcctctaacttcctgacagctgcacacccacgccagcctatgggaagaaagggaggtcactatgctatttcttggcatgcagtcctcttctcaatctggctgccacctgccttttttatgtaatcccattttttcacaggacaggaccagcctatgacacttgtggctttgtcaacattgcgatggccttcttccttccctgttcctgcacatgccctttttttctgcctggaatcctttcactctacgagacctgaccttctccctgtggttgcctagtcaattctatctgtcacctcagtaactgcagggatgctttcagttcccttgatctcatcacttttaacatggtgcacacaccatcagaatagtgtgtactattgtgtgcatggtaaaattaatacttatttgaagttcctaagtaagtaagtaaagcttgttaaattagtaattagtaaaattttactcattaatagaattagtgcttattcagtacccccacgggactaagaattctcaagatcaaagaacccggcctgagtctgctgccactgccaacggagccctccagatggaaggtgctgaggacaccgtgaagtgtgaatgctgggcctcacagccctgtgttctttcgtaaatgactgagtgaagggaagcttctcatgtttcatgtaagcaccagtcatctaggaggagggggtataaacgaatggagatgttttaagacctttaaaattaccattctctttacagaaaagagaaagtctccagatgaaattacacacagaattccaacacaagaaagaggtaaacatgaggatggggtgtcagacccacaccagcttgacagtctcccttttttccttcttttcttgcccagttttgatttccagcatccctttcaaaagccaacagctccaacaaaccttttttcaaaatggctgtcctaggataggtccccacggttaagacttctctaactagaattgtcttgtgtctcttaaaggataagtctttgatgctaatgcattaaatcaggtagtgtcctgtgtctgttatacaatatagtagataggggctgacattttagttggtgtagtgctagtctacatagtactttgtagaaaagcccagaaataactactgaatacttttcatgccgctgcttatcatgcaaagttatagctagcaacaattactcttcttgatataaaaatgcttctatctagatatgggatttagaatttgcagaagtctttcatataagccaagtgtccatgcaagcactgtgaatcccctgtgtgccaggtgctgccttggactctaacaatcaactatattttctctaatattagggaacttcatttcatgaaatataactctaatatagtttgacacattttataatggtgatataagacacgttataccatagctatacacagtgaattaaacacaggtaagggtcacatgactcgtccctggcatcaaggggagggagaaggtggtggtggaagtgtcttcttgaataaggaaggctttacgcagcaaaggtgtgagcttgaagggaaaccatttggtgaacaggcaagttatcttttgagaaactgttgaaaaagttgactcagttgacctcatcagaaaaaaaaaaaaattaggagctaattttgttgtctgaatttaaagttttaggaaatacaactgtatgacttctatactctacggtgttataggatactggaacatttagggcaggattgttgggctaagagaccacagagtatgaggtcgatcaccctctcaagtaagattcaaatgcaaaaagaaaatgtgaaaaggtgagccagaaaggaaacataagaggaggtggtttcagatgagactatgcaaagaagaagaacaagattcaggagcaaagaaatgtgcagaggctccaggtaatgccatggtagttggtgggaaacagtgaagaagaaatatccaacctcacaaaaagaaaacctatgctttactgatgggtttctggcagtggcttattaacccactgatgcctgaggttgcaattttttgaatttttgcaatcggacattggcgatgaccttgaacagcagggtataagtaactcctacatgctgaacgttctagtaatggaacactagttataaattcctaatcactcttgttggcactttgctcatttcattttatgagtatcccagggatgtagcaatttatctgaattgcgtgtgacaatagcaatacatccaagtttgactttcctatactgtgaattcttagcctattcattaatgcagaatattcaaactgttgattttgtttggtcatttctaatgattttctttaaacttttctctatctcaactcgaaaatgacctttatattatatacctacttttattctgccatgcttcatattttccatgaaagtctcaacctccacttgctgtatgatctttttctaataaataatatttgcatttatgcctctaaactcacatttgaatttgtttctgagtcaagttgtctatgttctctgtaataatgattaattttacagttgcttaatttcaataaaatcatatactgtttcataccgacagtgatttcagtattagtgggacagtggttaggctctaaagcttggatacatctcttcaaatagaggcaaccattacagtgatggtgactggtttcaatacaaacctggctgttttcatcagtctcttgatttggtcctgtaacaatatacagacttaacttctgttttctcagtgtcaatccttttattctgacaattatttcccctatacttttcctgagacatcacctcctattttcatagcaaaaatcaaatatatgatctttccattttggatctgaacccttggggtcattctctgagcaatgctattttttccaacgtatgtctaatcaaatactcccggtgtacagcaattacacaaattatcctcaagtcacactttgtgtcatttcccactaaaatggtcatacgttagaggtacaccgtctactctatcacttttcctgttcctctaacacccagggtaaatgatcagacccagcctcctttcatctgtgccctttttgtagcacctggtgttgtgttcccatctcccctcccgtgttctgcagaatttctgctgtaaaattattttttcaccctcttttaccactccatctgctaaatatagttaccactttacaaatatgtgattatttctttcagttcaaatgcaggtcttttcttctctctcagtaatttcattcactttcgtaacttgagctggaattgggcacatccccctggcacagagtaagtgctcaataaatatttataaaattaattacagagcctccatggtaattgggctctgatcataattcatacccgaacctctctcttgaactctagtcctgaatttccttccgtctcttgggtgttcccaacatttctcgtgaacaccgcaaacgtgacttaaacatttatgcttatgttaaaaaaaaaacttaaaaattattggtctcaatttctacggttggctccaacccaaaaaacactatatcactttaagcaaatctttgttcactaatgaagagtgagatcatttggataatactgctacacaagtcaagagtttaaatattattttggggactgtcttcacaatgtaacttggtttgaatgacttcttttcctgaaaataatatttttaatgtcaccagatagccattatgtattaatgtcttacttagtagagctaattatctgtaagttacttttattgtagtggggagtgcatagaaagacaaaatctcgaattaataccaggtggaaacgatgtacttgtaatatgatggagagaatcactcaagataattttttaaaaattttttaatgctttttttttgaaatggagtctcactctgtcacccaggctggagtgcagtggtgcgatctaggctgactacaacctctgcctctcaggtttaagcaattctcgtgcctcagcctcccgagtacctgtgattacaggcacgtgccaccatgcccagctgattttttgtattttcagtagagacagggttttgccatgtcggccaagctcgtcttgaactcctgacgtcaggtgatgtgctcgccttcgcctctcagagtgccgggattagaggcgtgagccaccatgcccagtctcaagataacttagagatacttgtcagtgaggccttcctgacaaggttatttgactggaaatttgaagcgtgagaaggaggttagcatgtacaacagcaggaaagaggaccacaccatgaggaggacccacagaggcctctagacaacggttagtgtttagcagtatgcgacgtccatgggatggcattagaggtcagggcagtgagaagacctcatgcattaattttaaaacatcactttgtgtaagaaatatctaatcctagtgcaagagtggaaacatggagacattactaaacaattttaggttttgtgtgaaataattgtggcttttcctagagtgataagggtccatgtgagaggaaggaccagtggtatattttggaggtggaatcaacacaatttgaagatggcttagcaaaagaaggaaagggaagatcaagaacatttcccaggtgcatgcattgagcaattcactagctgggatgagaaagacagagaaacagggtggagaatatggggccacccaagaaatccttataacgcaccgaacgcagctcaggtaagacaccatggggctgagtgagaactacaagaggaaaagtagcttggggtaacaagtaagaagatttgggactggatgtgggaggaataagtaggcttcctgatagaacatgtgtgtgcacagttcacaccacacggttgagtgcgcaggcgcccagaggagcccttggggtgctctcctctgccatgccatgtgcccgcaggaggaggccagtgattgtccagcttttcccatgagcgaaaaacccaaactttagtttggggaaatcacttcatttaaacaagagaggaatacaacggacaagacagagaatagaaatgtaaagagcggaggaatatcactgaagctccatccgtgattctgcatttcaatctggctttagtctctgccccataaatatttcaaatacaacatatataaaatgaaatgtatgaaatgtatcaacacctgctctggagaattttcagttaaacatggcatattgaatacactcatggacttaccacttcttgctcacaaaatgtttcaaaggcacaaagaagcccatctctacaaggaaagtgagaaaaaaaaaaaaaaacaacacattgacagcagcaaaacttgagaagctactgggttaacagacaactggaactgacttagcagaattgataaagctgaaatttaaatgggtaatttgggaattcgtgaaacaagccaatttgcagcacagaatcccaggaaggctcaagagcaggaggcctcagatgtgtgtcaaaacatgtgaaaacagtgctccaaaaaaaagacctctgagaatagtgaataagacaatttcacatcccctgacaccatcccctacttgacaggagaggcactgccattcccacattccagcaatagactggaggctttctctccagagatgctcaattagactatgggatgctgggctagcctacattgagattaaaagaaaatatacattctgaaaggtggacctccaaatctccttttcctacttggctctgagaattcttacaggaattcttattacactcaggaaggatattagagaattcttagcagaggaaattcaccagaccagagaaaatgcctagagaagctaaggcaaggaaccagtaacaacactgtccagcacatccatctgcaatggaggaagctgtccacccaacggtctgtccctacaccacataaacctgtacattttagttctctagagtatgagaagacatcaaaggccatcaatgacttagaaaagccattagtggaagaaagatcaaaccaacaaaaaaaaaaaacagaagcaagtagaagagaaccttcacagagccttaccaccatctcaaaaccccttctgtgtctacactcacaagctctaccagataattgaatcaagattcctgtaacacgcagaaagttatgatgggtcagctaatcttttcccagttatgattttcccaggtattgcttttaatttttaggcaatttggaaaacttgggggatacagtaggtatcagtgttttgcctcagtcttattctgtaaacagaataagaagcttccatcttattctgtaaacagaataagaagcttccatcttattctgtaaagtgaggtctttgtgcattgtgtagtacctggtccgtcatatgttctcagtaagtcagtcaataatatagttgttaatattattattgttaaataatcaagaaaacataaaaaccacagaagtacagaaaaaggttaaaggctattactttaaaaatctgattgtccgaagcctggctgctcccacaaatcaagaactgtcatttaaatttctgaatcaatgtgacggcagatgccaaattcagtaacacaactattcagttatgcctctatctggttcgcttctgtaggtgataaaaagtggtcaaacactctttctgcccagatggaggttatagtttagctcaccgagtcatcattaagggctggttgagctgacctgaggattttgccagactaagagtcgctgaaaataccatgaggacaattaatttgttttgatcactagacataaccacaaaactatgggcaagtgaaagttatgcaaagcgtttataatccaagtcctaaaaagacatttcttaaaaaaaaaataatttgggctttgagaagctgaagttagattaaagcaaataaatagacaaaaacataataataagaagaactgacaacaggcttcctacattggacattggagagctgcctaaacagctggttccctcccgccctgccctgagcatctgtagtagcaagtggctcagtaagaccttggggaaaggagggcaacgccacccagaggagcctccgggagttaataaaagtcacttctgcaccccgagaaaagccacaaatgaaatctttgcttcttgaacatttatctttttctatcaactgacattctgagcatccagactttttgcctcgaaattcacctgcacactcgtggggactctgaagaacactgttgtctcagaacaatttaaactcctacctgtagtccatccatcaagtaaattcagctgccgccaaggtaagcaggaaagggcgtcatcgccagggatacgtgacgaataggctgactgctggcccagaccatgccatggctgggaaggataattggtagagatgattgcacagggcgtaatctaccacaccactgctcgttaataaccaccaggagagctggcctgcaaggcaggacctgtgtcacctgaatgttcatcaaagcaggttgattgaccatgggaaagaatagattagcagccaggactcagcgagttaaaccccagtctgtctgtgctcttggaaaaatcatttgacttccagagcctgaatatttttttgttatctgaaaaatgaggaatttgggtcagattctcagaatatttctagcaaaggtgacctagtctgatgcaaattaaaaagccccttggccaataacaaccagtgaaactgttttctttttttgttgagactgataatgaacatgtaaaggtccctaaaagtcctgcatggaaaattaaaatgcttatcactatttctcttccagacggttaataacatccaggggtcctttgtgcttgaacatactagtccaaccacttttgagagcctttctagtaaaattctttaaacccaaactcgtatcccgggtacgttattttaacaaaacatgcatacgtaaccctactcaaacagggctaaaggctgatggaactgacctgaggattttgccaggctaagagtaactgaacataccatgaggacacttaactttgtttcgcttactacacataatcacaaaactatagacaagtgaaagttatgcaaagcgtttgtgatccaagtcctaaaaaggcctttttcagaaaaaaaaaataatttgaaaatgcttgcacacgtttttccataattgtggtaaaatatacaaaacattaagatattttaaccagtccaagagcacattttggcagccttaggtacatgtacgatgttgcgcaacagcacatattttgatgccaattcaacttcagaaagtcatatttaaatacacctaggaaatcttttaaagcttattctcagaggccaggttggggaatagttgctctgacccatctacactctcagttcagtgtctactaaatgccctcttcgcctaagttacccggctaggaactcaagggaagaggaagtcccacggtgcttcagtggtgcctccggagttccaccactttgcaaaggttatgacttcagactgaattttcatccatagtgaagagggagataagtggatagaattccccactgctcaatttcagatgcatggagatgaattactaatatagcttcttttttcctccctagcttttggtgcattctccccatagtattaacctgtagtactcaaaactcttaaaatgttaaaatgtgtgttcataatattcctcatcatgggaggatatatagggcgctgtggctcacgcctgtcatcccagcactttgggataccaaggcaggtggatcatttgaggtcaggagtccaaaggccagccttcccaatattgtgaaaccccatcactaataaaattaaaaaaaattagttgggcgtggtgccgtgcacctgaaatcccagctattggggaggctgaggcaagacaatcgcttgaaccctagaggcagaggttgcagtgagctgacatcacaccactgcactccagcctggggaacagagtgagactccacctcaaaaaaagaaaaatcctgaaattcattttatttgttcatgtcagggcaacttcattgtactatttcaggacacatggcaactcagcgcacacctccataaaccagagacggctagtgaaaggagaatcaatgacaaaccatcattttcttcaaaatagaaaaaaatattatttaatcatgttttaaactttcttttctgaatcatcgagacttgatgttattttaatttccacctaaaatatgtaattaacaatatacatcgtgtttctcatgaatttctagttcgtaagcctctagataagaacattttcatacattattctgatgagtatttgtttagaaataacaataaaatacaaaatgcttcaagtttatataaagcaactcatcacttttttttttttttttattcctttttgcctctattttttcttcttccttagcatggctgttaagagcctaaatacatcacatttttatttgggaggaaatatgctgttgtccattttcctgtctgatctgcatcataaccagagaaattaaaagcaggaaagtggtgatgccttaggaaactgtctcaccaggcaaggatgttatcctgacaaattgccacaacatggcggcttctgagtaaaggtttcaatggggccaatctattcaaatctattcagagtgaaattaatattttattgcatgacattcttagatgtaaagtggcacaatatgatcagcctaaatgaaagttttaactgtgcatatatttggattcttctattaagattgtaattaattataattgtctaataatttcttatttggtagaatttatttgaatgtgaatttcatgttgagttatttgatagattcaagttcaagaggtatgttaaaataaattttcccatgaatatttagttttacctactcaagtaagctggaaggttagagctgacaggcggacacacacacacacacacacacacacacacacacacacacgccaacacacatacacacttgctagcatgagagtttcatttttctgttacttggcatcttactcttagcaacttaaaggagatcattttactaaccactctttaccttgaaaggatcccagcaaaaacaaaaagtaaaatagtgtattaacaccttcaaaagtatttgggtatttggataaaatagttgttgacattcaaaaaagaattagagaccatcaaatactctacttaaaaatgtatttatctgacataccattttgcatatacaattacaaccctctctgaaaagatgcagaaataaaacataacatgcagaattaattcagcacacaaaaacagcaaagaattaaaatacttgcaatttagaaattttacaggactttgcagtaacagaacctataatgagtcaaaacaattagccttgatcctaaaaaatcatggataccataagttgaaaaaactaataacttattaaaagggctgtatttttctgcattgatattctataacatcaattacttcattaaacaaaataattacagtataatcatagaaattagtaaatgtattcctttaaaaattttacgtcctctttaaaaaagaaaaaaaaatgagtttttaataatcagttaacctggcactgagctttaaattgaatttaagaaaaaaacaaaaactctgccccattagtgcaagagtaaagttgggttgttgaaatgcaaatgcaaatgcatgtagtctccccctgtctttagtttgggaataagaaatacatatttgaacgtaaaggattttttgttgttgttgtcactttctgtttttatttcataaggctgcttaacagttttactttagtttggagaagcacagttctgaaaactaaagggggtaaatcccgtcattatctctgcaggtgagatgggtctgtatcaactctaagactgaacgactctgaaggtgaaataataaatgacgcatgcctgaggtcttttctgggaaggaaatcgcccccaagagaagggttttttagcccagaaagcactcaggctgcctctttgcctgccctcatggttgctgagggacgtttaagtcaaactgaaagtactgcatgacccgatgagaatcattaacctcattagcaacatggacgagcaagatggcgaccacatatcccctcggtctgccttgggggctgtcgtggcctctcccaccactcaccacccctgcctgtcctaataagaggtctattgtctaacattttaagaaccctattctatccacttataagaaccctgttgtcttccattataagaaccctatggtcaaagcctagtgtatgacattcagaacaagaaaagtttctgaggagtcctgtgcccttgaggctggaggagcgcattaaatccacacattatagacctaactgagaagcaggggtgccaggaagcataattattcagaagagaagtcccacagcccccgacctcaggattccctgcacattcagtcagacactcggccttcttcctaccaatcattgccagtgatcctcctggcagacacagcctccatcctacattaaaccccacacctggagacacaccctccaccccacattaactcccacacctggagacacaccctccatcctgcattcaatcccaaaccaggagacacaccctccatcctacagtcaaccccacaccaggagacatactctccatcctgcattaaaccccacaccaggagacacagcctccatcctacattcaaccccacacttggagacacaccctccaccccacattaaatcccacacctagacacacaccctccatcctgcattcaatcccacaccaggagacacgccctccatcctacattaaaccccacacctggagacataccctccaccccacattaaatcccacaccaggaagcacgccctctaacttgcattaaaccccacaccaggagacacactctctatccttcattcaaccccgtaacaggagacataccctccatcctgcattaaatgccacagaaggaaacaccccctccaccctgcatgcaatcccacatccaggtttccttggctgctgtatcattcccttcactgtaaaaatatttgccttcctgtcatcctttccagtcacaggccctggtgctgctggccctggcagtaaaactctttgaaataggtgttttattctctgtctctaattcctccctcccattttcctttccagttttcctctgaaaccgctcatgtcaaggttatctatgccccatattttgctgaatttaagcagcagcacctacactcatctcaggtcacctgaaagcagcaccacacagcttccactgtatcctcccccaactgtctctggtcttccagtcaaccctgtatcttggctcttctacaacccactggctgtacttttagtatccttggcaattctcttctctgtcagatcttttttttttttttttcctaccctcacttcccaagtaactttttccagtctcacccatttgcagatgactatcgattgttttattttattcatttattatttcttttttcttgagatggagtctacctctgtcacccaggctggagtgcagtggtgggatcttagctcaatgcaacctctgcctcctgggttcaaaagattctcctgcttctgcatcccaagtagctgggacttcatgtgcaccactgtgcccagctaatttttgtatttttagtagagaccggctttccccaagttggccaggctggtcttgaactcctgactgcctcggtctccaaaagtgctgggattacaggagtgagccactgagccaagccaggacccctgattttaaagcgcgaacctggacttttccatgaaattgagacacatatatccgactgtcttctcaaccacctgggatatcagactaagctttcccaaacctgattcctgatgcactcccaagtgtgcttttccacacagtcttcccagcttgctagagaataactccctttttctatttgggcaggacaaaaacccggagtcaacttgtattcctccttttctgtcaaataccaaatcagcacattggccaatttggctagtcctactcaaaagacgctgagatgctgagcaatcctccccacctcattcttcagtggcttgagccaccattatctatcacctgaatgagtccaatgtgcttctttcttatccacttttgtgccatcatcaacaaagcagccctaagattctcttagatcacaagctagatcatacctaccacaatcactcattatcttttcaacaaccttacagaagacccacaatcaccaacaagcacttaccaaagaaagaacattttgtcttcatataattctactgtagcttttttcctcttatttctcacacttacccagcattccccatcctcagcaccttacaggacctgtttccactgcatgaaggctcttccccagatgccctcatagttcactcctcttctccagctgcttaaaggccatcttcttagtgaagttcgttctcaccatctgatgtacagcctcagccccttcctcttgcttgacccaccccatcctctgccgtcctgcttctacatagcatatcacaatgcgacccactaagtgtttcatcactcactccttccttttttccctcacaaacgtatgaatcccaagagggccgggattttatcgctttggtctgtgttctgccccagtgttgaaatctgtgtatcgctttgagtgatactcaataatatttgttgattgagtgaatatcttacattctaatatcaagagacttttacgtcctaaagccgacattataacacttaagtctgtaataaatgcatatgattttgctattcaacattttaaacataagaacatcttacgtgcgtgcgtgcactcaggtgtgtatacaagcttattagactacaagccttataaacctttttctaagattaaatcatctcagaatgtgatgacatattgcagtgctgggtatgtttgaattgatattctgagccaaattatcttaagatctagagtttccctctaatcttaataaatgtttgtgttgctctacaatagatttatatcgttgagtatcttatattctagatttatattaaaacatttaatcctcaattaatctatccaattaatccatccattgcataaagcaaatcaagccgagtaaactctggtgacctacctgaggtcagacaactaataaataaatgatcttgtatataatccaaggtctaacctgtgacttaacatatttattaaattatatcccaatcaataactattaaactctgctcaaagtagatataatggttactgtcctttcccacatacagagtttttaggccagttgctcaattatattggacaataaagtccaatcataaaacacatccttaatgttcatggctgttatgtatcaagatgtttttaaacccccaaatttgtgactaccaagtagctcataattttctccataaatattataaatttttactgcctaatagtaattttcctagacctttaatgactataaatataaaaccgattacaagctattgaaataaattctatcagtttttttttgactttcaagtaatttttacctctcatacttcagcagcttttgcagtgtcacaatgtattttttgtggttaggaacaatcgattatagattctttaacggcactaacttgagtcaccaccaaattcaatattatatgctgtgattttttaatctcctgtttttttctacttggaaaacatgtgcttagattatttcatttgcaacatcagtactagtattttgtttcatcacacacacattcacagagcaaaaactatccaacttgctaccgtgggaaaattggggaaagcgtttttacaagggttatcctaaattaagcatttctccaccaaggatatatgttgaactacagaagagtattacgaaaactaacaggatattgatatagtgaaatgtttaaaatacacatcaattgcgcattgagtctaaatgaaaggcattgtcttatccctctttgaggttactgccgccatcatggaaggaagccatctgttaccagaggcagtgatgctaagaaaagcgtgtgaggctcagagtcatgggtccaacctcacatatgacttcaataaatcacctagcattgctggataattttcctcctctgagagaataggagcatatttgtctcacaaagttgttacaaaaattacgataaaagtgataggtgtagagatcagacattagacagtgaactctctcagggccagctctctcacgcccttcaattaggagacataagaaaggtctgtaatttttttttggtgttaaaggctaagcaatgacaacagtttgcatgtaactattattgttataaatctgcatacaatcccccaacaaatgttgagtcagatatcttctttactgcaggctctgtctgataagtaggctattaactacaagctgtgggcttatgactacagttaataagccaagtcttaagaatgtgactggtagtgatggaccatggaaaaagtaaataacactgttggccatgccacagcctcagtccccatactcagggttctacctaacaaaactgccagtataggaaaagcacccagaatatctgtacatgtatatgataaaggatcaaacacatcaactcctaatacttgtgttttactaaaatttctgaatctcatacataaaatatgtgttttccttcttccttttctacctcctcctttctttcttttgcaaaaggctaatcattttgtaaagcaaagccatcgacataggacgtaagtatgaaacaatatgttggcctgatactatgaggtgttagaagagcgaagtagtaattattgtagtacttgatcacattcatgcttctgatactttcaagattttcactttactattagtttccttttctaaacttcaaaatccaagtgtattgagaaacacttgtcctttatttatttgtttttatttatttttaagacagagtctcgctctgtcagtcaccaggctgtagtgcagtggcacgatcttggctcactgcaacctccgcctcccaggttcaagtaattctcctgtctcagcctccctagtacctgggattacaggcacccgccattaagcctgactaatttttgtattcttagtagagacggggtttccccacgttggccagcttggtcttgaactcctgacctcaggtgatctgcccacctcagattcccaaagtgctgggattacaggcatgagcaactgcgcccagccacacatgtcctttaaattacacactacctatgaagaataattgacttggcttttctccactcaaaaatgagaaatgtgaatgactcttgtgatcctaaccacagtgtcatgtcttgctgcaaattagatgaagggtatttcatcactaaatcttactttcttaactaaaactctcacctaaactgaaggagacattttataaaagtgtcatgtcaagcatgatttaacagtcgtaagattgccttaattcactgctatctggttaaaaccctaattgacgtttggaaatgaattgaatgtcaggtgcctcgaaatctaaaagacaaacattactttatttatttatttatatatttattttaggggcaacaatcttgaataagtgtaaaaggaggaaaaggatattgaaattcacaagaattctttgttccaaaaagttttctgcagtcaagcataatttggttattcataagaaaaggaggaaacaggaagaggatagacgtggtgtcatgtctacatgcacctgcagatcaaaaccacaaggatatgttgctctaggtttattaaagctcattgttctgtgcactggcactgaactgcacagttggaaaatgctatcacttatccacaacgttccagcttcaagaacaatgacatgcattttaatagaagcaacaacattcatattgaaaacatatcattttcttcaattttttctttttctttttgaagttaacactgttgtgacagggaagatcagcttctttgtatgcagaagtgcccactctccgccagccacatctcaaatttgaatgttaaaaacctctcttcattgacatattaaaagtacctacattagtttttctcagtgactaagtactatgttctgaaagtgttttccacaaaattcatgtgttgaaaacctgaccccgaatgtgatggtatttggagatgggacctttggaaatgctttgattaggaagaaggagctttcatgaacgggattagtgcccttataaaagaggacgcagagagctctctcacaccttccactgtctgaggacacagggagaaggccctgtctatgaaccaggaaatgatccccaaccaggacaccttgatcttggactgcccagatgctccagatctgtgagaagcaaatttctgtgctttataagctatccaatgtatggaattttggtacagcagccccaacagactaagatattaataaaataaagatgtaagatctctgttgaaatgcacaaataatatctgagaagaagtagagtatctttaggatatttcatgaaatttcatttgagttggttaattattatttggccatatataaagaatctaatcctgagaatttcaagcggaagccatatccagtacttggatgaaccaatgtcaccctaaaatgccttaatgaggtgagactaatgcatggagagcttaaggtaaaacggcggggggtgggggaacatgtgatcccttctgcctgagaggttctggcatctggttaagagtctaccatcagccagtgaaacagataagtcaaccattaacccctgcctaagtactaacctacacaagtacatcaagtgctacaggagttaaatgaaatggaagattattcttcataggactgagcacagattcccaggagttaactcttgacttagaccaagaaagatgaacagaaaagacatctgtaagcgaaggctgccaccagactaaagcaggaggttgtgaatgaacaagacttacacgaagtgatctatgggacccatccatagagctggcgattgcagacacaagtttagaaatgggccgaggctcctgaagcagcctctctgcaggagtggaagatgtgtggcagccaccggcattcctgaaccacctcagtctgctcttccatggaaactacctttgctaccaagacgtccatttctctgtgtggccatttgagacctgcttatccttgaggtctgaattcagcagtctacactagatatcactcctaaatgttcctatcccatcttttggccgttcctttagtacaattctgcgctgcttttttaattgagtgtttgtatttacactttattcaccattttattctaggacatggaagattgcacctgacgaatagatggcaggtgctaaataaacacttgttaatgaatgaatggtgtggtgtacggccacacggtgtcgctgctgccgctgaaaactggagtcgtggctgctcccagaacaaaagatctgggctaacttgcccccagataatcatgagaaactggtggttggagagataagaacagtctctgcactgtgggcgccttcttgctctgtccccacgtagcttttcctcggtgtgtgaacaaaaaacagaaatagacctctgtgttgtctgttgtaactgatgtgctaatcttgattctaagggcggggtgttcatgacctcatggaatctcaattttatcccaaaagctctaaataccatcgtattggtgggagttaagtcttcaacattcgaatttaaggggacgcattccatccataggagtccctttccaggggacttcaagaatagaaaaattatgttgctttaatcctagaaaaaagacttcctccgtctccacccacagtgtgtgtgattcatctttcagaggcatctctctcctgtccaaactcaagaatggaccaagggtgcaaaaaagaaaacgaacaacatcatttttgttagatttcgtaggctacatcataaaactcacatacaaaaatgcactggaaaaaaagaaattttaaaatttatatagccattcatactcattaatcaaaagacgtgttttgttttttttttgtttgtttgttttttgtttttactcagggtacttagcacacctaatgctctaaaggctatgtagtatgccatgtccacaagtacctgctgagtgtgatttggaaacctaattcacatgctttttagaaaacaaatcttctaagtaatggtacatacatgaatctactcaaagtgctccgaatattttcttgtgcttttataaagaattccatctagtcttttctctcagggatctcatgacactggcctgctcaacttactgaggacctgaaatgcatcgacccttttaaaatgggtcagcctgttgccatgttttcctgaagaattttatttattcttgtgatatgtaagttctcacatgcaagtgtaatgaggaaaaaatgtgtcccccatctggacccctagtctttttctttttttctttgaaacatttgtttttgtaacttgagaacactcagaggagaggagacatcctgccatcctttgattctaactgaggaatagcggaaccggctgacacatcccgtagctgagccgcagcttccgccaacaaaccatttgtgtttaccgtgaaattaacctagttgccaaaatgctaagctacctagcaagtgattcgtgataatcactgtgagcaaagaggttaatggatattgttttttttgtttgttttttttttttttttttttttttttttttgtaatttcattttttccaggtttcctgtaggcccagcacagggcttcaaacggtgggataaaaacaccgtatgttatcagtaaggtcttcgatcaggaactgaaatgccacggacaacacatgatgtacgtctgcgggaattcatagatctataatccatcgcatcacctaccttcctgaggggctttatttgtaattggcacactgatcggaattcttacagaaactagaacgcaggaaacagtatagtatagtagtttagtgcatgagtcacacaaaccaagatttcatccccactcggagaaaggggtgaagacgagacgaagcacccactctagccagtcaagaatttttctcctacaccccgggtaacactgtgacatttaacaacaaacacaactggctgtattcatgggccagagtaggaatctgagatgatttgctcaaaaaagttagcgagatttcatgtgacttagaaaaattcaacgtgatagaaagttttcaatactaaatgagctgacaaatttaagcttaggttctaaacctacctcttaaaagaattcagccaaaatcaatgttaaaataatgaattgcatgcttatttaaactcttcaagctttggtcccttcatctgtaaaatggcaataatcactgtgccttcgaagactgctggattaaaatggcttatctcaatacattttacaaggtgggcaattactaaatagtagcccaaattattaagtctatgttgctttccaaatatagaagtcactgaacaaaatggaacagaagcatcagtgacaggccaggcaatggtataaattcaatttccaggcctctcagctaaaattgtaatcagaaacaagttcaagttcagtttcctcaggaagcagttacactgaggaccaactattttctcacacacacaagatcttaaatcgcgctccattgcttcatggatatatgtgttgccatggacagataacaacctccttatgattacgcctacaattttattcttcactcactatcctccatcaagaactagctactttgcacggaagccctaaagaaattcttactgattgaaactcatcaagctcccttcgcctttccatatttgcaccaactttgcaaatcaattgtttaattttttccgaagtagacgtcctgccctttggtcctgaagagattcagagtgagggtgtttatattaagaaacaaatattgagagggaatgttaactccttgaacagtaaataaactaatccttcaacagaaaacattatttctgagactcagtttccgtttatataaaatgaggtattgatacacacccaggcagttttttgtgaatatttaatatgtataccctaaacggtaagagctttgaagtgaggaataaggtaatatggctaaacggtcttcactcttgaacatgatgctatactgcagtcaatactacttttttttttttgtttttgagttggagtcttgctctgtcaaccaagctggagcacaatagtgtcatcacaacttactgcagcctcaacctcctgcctcaccctttctagtagctgagactggaggtgtgcaccaccatgcccagctaattttactttttgtagagacatggttttgctatgttgaccaggctagtctcaaattcttgggctcaagtgatccttcttcctcagcacctcaaagtgctgagattgtagacatgggccacagtacctggcccaaaaataatttttaaaaagggaagctttatattgtattatttttttctggacaatgccttatgttccttaaacagaagtctatctaaataataaaatgtgaagctttcctctcactggcggagaagcagagtctccaggagttgtctcctgggttggctcagggtgacagaggcatgcacaggcctactgggcgggacgaaccacatcatgtgctttccagcacgttgcttagtttttctaccctaggaggcctcaagagattgtaaacgttttaagattgagacacaattttttcagtcatgtctgcccctggcctaaaaatgtctggtaagtccagtcctggaatcccaaaggacatcttagaatgccaagtacgtcgatattaacacactcccaccctataaaatgggctgagggtcttctatgtgccagaccctgtgattctttcactagggactagagacatgaatgaatgtgcttcctccttctcagcttggtcctcctcagcatgtgcgcgagggtggtcctccagctcccagcaaggactggggcagcccaaagcacatctgctaactccgccctgagcacacatggtataccctagagtcacaaatcaatactgtgattccctcatggacaaagatgggagcacactgccttagggtaaggaggcacattaagaggtgactagaggcacaggccccatggtcagacaggcttgaggttgattctgctggtgattagttagacaatgtgtccatattacttaactctaaaggacttcagtcttctcacttaaaaaacaggaagaatgaaaccaatgaggtcattcctgtgtcttgaagccaacaaccctggactatccttggccctcaatacctgttagctgtttggggcaggtcaatattatccttctcttgcttccaattaaagttttcattgccattacattcccagttgggtaaagaagacttaggcagtaacttttgtaaatgctttggcccacactcaaagtcatactaataagtacatttttaaaaatcgatagcaaatgcaatttttttagcaaatgcttttttgagtttctaggttaaatttattaatagttctacatatgattttctaccctgttcttctgtagagagtagacagcccagagtcccattttcctgcttcccatcactatggctacaggattaggttcgaaaatctgcttttgctgaaatatcacacatccctgaacaaaaataacttcaaatgtttaaacttatgtcacatagtattttcttaagggagattatgtgggttaaaacaatttactccccaattaaaatcattacgttctccaccagagttgaatgaactatcttcttacattagagatacagttgagtctcacgtttcacatcctgccaaactcagaattccattacagtggatgctgaggttggatgtactctgttgcatcaacttcttctttttgtgtgggcaacaccagtgctaaggagaagattcctctgcccttcaaccttggtggaactgccaatgaagctgttttctcatttggccatggttgggatctatctaactgtgattcatcttaactcgtctttctcctggaggctgggtcctggagccatcagtgcaaggagagatgtagcaccctcagatcagctgccccaccccagtctggtcctcagagctggttttggtggttccaaagcagttccagcatgttatgtgccaccccataaccctccagtaaatcccctagccacctgcctctcttagaaggcatttccacctagagaacccaaactgctgcagccatgctcggggtcacagagcattgcattatgttgggtggcagaacatcgcattatgttgttttgggaaaactggttgctttattgtggaaaggtgggtggtggtttcttaatgatgacaatggtctatctttcacgttagttccattctcacagaaaaggtcaagatatttacacaatttctgcctgaatgtgtctacactattttggaatatagtgaaaaacaaagtatccttatcctttgcagcattagcaatttgcataagtaaaatagagttgaattagtaagtcataacaaaaaataatgcacttttaaatccaaacctcttttaccagtgatttcttaaaaatacataaggcgtgttctgtgttttcaagaagtcccacatatttcttgacaagaaaatcatgcatttttattactcaattaagctttaaataaagcttcttaaatactaaaccaaatgttgattgttatttttctatctaaaagtaaaataaacattatttaatcccagatttccaaataaacaaggccactgaggttcccataactgtgattttgacaaccggctgcagagcgtagcttgtgctaacctgtttcatgaggggctggcagccttttcactgggaaacctctgattgctttgacccttatcaccttgtacaagttaaacttctggtgttgctgcatctttgctaaaaaggaaactcctgcattctggctatgccccattttgcaggcatcacagttgagcacctttgcctgctctgatccctgtagacttcaagattcacttgtgaacttatttccacatctcagataacaatctaaaataagatgaaatgacacaaagcctgcagcaagaatctggaaactaacctgattgtgtagtgtcctcttagaagcctgtgcctcctgcctttttattttatcttttagctcaaaatgaactcctttcacactgaggatggctatccaatctcattcccagtgcctttcaacaagtactccccttatacactcctggctcccatcccctaatgtaaatgtaccacaatttaaaaaatgcagttgatgccaatgttgctcttccttttttctgtgccctttgaatttaattttttcttataataaaagtgacagccaaaaatatccatactatctatttttttatttggtgtctatgtgagggcgtagcatggggtagcattttttaaaatattgagttatgtattcattcaggcgcatgttactgtaaagaaaatagtttaaaattatttttccattaccaacttctgacaattataccttctaaataccctttaagtctgttcaattatttccagccaacgtctcagtgaaaacccatctgactgactagtgttatttcttagtcttttaatgaagctacccctatggatttgatcgctgaattacttatcctctacatagaatcctctaaacctgtgtttcaatgaaccctagcttcactgatggccctacagcttgtcttcttaaacaaatgaaatcctgatcgtgaactctccagtcaaacaaagtccatgacttgtagcacactagaatagaatttgacacccttcatatacaccacagggccctaaataatctcaccacaattcattccctttacctgctgtaaccccctggaacatatttcacgcctttgcctatttttccttcagttctcaccttcgagtagcaggtcctcagggaaacccttcccacttaagtacttgctaaccccatgttaaacttcctcatagcactttattatctcagtcactacatctccaactgcagaagtcgcttcatgcagtgaggatgtgtctttgaatgtctgtgcccccaggagggcagggtctctagtgcaccactctatgtccatgcttagcacaaaagatggacacagcggaccctaaatacccggaacacaagtttagaggatttctatgtagaggagaaataattcaatgatcaaaatcattacaaatggtatttcttccatccagataagaaatgggatttggagtgattttttttttctttttttttttttgagacggagtctcgctctgtcgcccaggctggagtgcagtggcgtgatctcagatgtctgctcactacaagctccacctcctgggttcacgccattctcctgtctcagcctcccaagtatggggtgatttttaagtgcaaaaaaagagagaaagatggaggcagaatgcaaggcataaagacaacatcgtgaagctattttatactgtcctaccaattgaccagattcagtataagttttcaaacggattaacatgccaacagtgctttaaagtaaatgagaccaattcatctgccccttgttttaataccttttgactttgtgaaatgaaaaagggtaaattaacctttatcaccaggcagaatttttgcatcatcatgaattctcagaatgctctaagaattatatgtctttcttagcatatatccaccaaattagacatccttctcagaatggtatattaaaaactttaaataaaagaattgtgatttttgatggaaattagataagaaatttgccaatctttataaacatcatcttctgtgaatgctttacagtgaagggcagactggaaaattcatagtagtgtaattacaagtgattagtaaacatgaaaatttgcaacctccctaagtaatcaaagagctgtaaatgagagaagaaaacacttcccccacccagcaaatgagaaaaggataaaatgtatcataatacttcaagctataataggactattgttgtgagcataaattagcagagacttcctgagagcaattttcatatttattaagtatcttaaaaatgttcttaactagtctttccccttctagtaagttgtcttgaaaaaactcagaaatgttaatgaatgtatctacaaataaaccagactactgctagttcatgaggcatctttgtgtgtttggaaatagattccctccttccaggttcacagaccccaatccagggctcactctgctgtgagtggagcccactctgcccagttgagtggctctcctgcagggcacaatctgaacatccctggatggaaagatggtaatttattcatttataaagttggaggaaaccttcattcaccaacgacatgtgactattagtgaagtcactaggtaaattagattaaagcatcaggatgaaatattaaagtcattaaaatgtatgttctaaaactttttctgacccagaaaaaaagatcaatatataacattgcatgaaaagtcaaagtttaaaattttatgtgtagtgaaggcactaacttgttaaaatgcaaaggaaacagactagaatggcagaggttttatctgagtacacgggtcaggggtagttttttcctttcttgccatgaggtcttagaatccggaacatgttcactgtggaaaatcagacaaattgagcagttggaaaaaggagaggagggagagtgcttgcatggaagcctctgctctgggctgaggaggacatggcagagcgattggctattaggagagtcaggaaaggggagatcaccagctcaggtattttcttacctagtctcatgaactaggtctgaatttcatggtaaaggctcttggctaaatctgaaattgctgtactaaagctttgaaaacctatgcaatgccgagaggggcccaaaaaacagcttgacttggagagaatgactcatcctctactgaccactttgctccttgttcccctgtaactgacactcttcccagattcggcttctagccagtatgtctactcaaaacagaaactttctaattttaaacagcaggcttatctttgtaaccagagaaatggggaaattacccctaagcaagcatatgagtaaataagttatgcaaggagagatgtctccatgactatttccttaaccaccgaaaacacagaaaattattacagtttcttaaaacacatgtgtgatattgcaacttaatttttgattaaatttccatctcatggtatcgtacatccataatctgagtccacaaaaaagaacactcattttgccgtgtcatcattctagtattcaacgaggaaagaaagaaaagcaaatcatgacaaggtcatctttacaatgaaacaaagatgtataagaaaacagagtagggactgtgttattgccttgatttgtggttcctgttttctcccataaacacattaggttagcagagagtttgcttcccaaagtgacttcctccaactacaatcatcagtagcaggtgggaacgggttacagtggcagaatttcagtccctgccatggagtgggaagctgcattttaacctggctgcaggctctttgtttttatgttaaagtgcaggtagtcctgttgtggacagctctgtgcatctgaagatgactactgggtgctgtgcggatgagtttcgcgcagcacaagtagatttgtgctacaggcagctctgcaagtttctggtagaaccgtttaggcttagctgagctagaccaagcagcagcaacagtaacagctaggcttgaaacgttccacagagcacaggggcactgagagcaggcccccgggtcttcgggaaacactatgcagtcttgtctccatgcctgaaactttgcctggagctccaagaactgggattttaataggtagaaagacctagaaacggatgtttttatgttaatagatcttcataaaactagtagaaaagcaggcctgtatatttttgtcaaataattttttaaaaagccaaagttataaatgtatgattttggataacctaaaaatagtttgaagagtgttagcaagtcaaataaaattttctttcttttttcttatcaggtttaatgggaaaatactgcgtaaatatcaactattgtagatctgtctcccagaaaaacagtgcactgaacatgacaaatttcttcaaaactgatccaagttattacatgacagatttaaattgtgttattttcacacatcattcctctatgtctagaaaactcagttacctcaatggaataatttttttacagtgaagagttttgctacttaaagaaaaagagaagggatattttatacgtatgtataaaatatgtgtatatatgtatgtatatgttctgacctccttctggtgtcattgtaacaagatcccctagggatattaaactcctgatagatataatggagataacaacatttaaatcttccaatttgtcatcaccattgcttgaaaacaaataaactttaaaataaccaaaagcctggagtggaagtaaatcgacaaacatcaaaaagaatcacatacacatttaaactataaaaccaccattcattagaaaatgtgtattatagctattttgccaacctgtctggaatgaataacgaccctcaagattttcaatattcacttcacacagaatgttccatggaaatgcctgggttcagaatctcattccccatcttattagtggcatgctgtcaaacaagtaacttaccactggttttctgaactctaaatcggatgaaatcaagcacctgcattacgcaatgaattatataactctacatatgttaacacaacaaacactgcataaaagtatgtacttgggcttgtgaggctgcagagggttggggtgggaggaaagattgcaagtacccagcctgccttttctgacagcctgatccacactctgatgatgcaaagggaggaggaggcaggttaggtggtgctcaacacaatcacgagacacccaactcagcaaacaaaaactcttcatgaagagcctaaggttggatgtttcccaatccatggtctctccatgctgggatgctaaacatgaggtgtgtagaggaaatgtgagttcacaatcgatcagctggtcaacaggttcctctggtcaacaatgtcataatcaaaccaaggaaatcttgaattcagataaccaatctaccccatatgaatgacaatttaaattatcctatgtgaggtaattttttcaagtgctctaagatatacacttcttggtgactaagtcaggccgtatcacccaactctgttttcatatttcctattttcttaacaaaattaggcaaaaaattattgacaagtgtgcacaatcacatcattacataatcacataatctttgaacataggacatctcacagggtatacttttcatacatggtgctttagctaaggcgttttctcaactcattaaaatgacttttccttctaaacaatacaatctatcagggccgtggacagggatggtctcatgaacatgcaacctaggtcagttatttgttgttgttgtttgatttttaacttttaagtttagtggtagaagtgcaggtttgttacttaagtaaacttatgtcatgggagtttgttgtacagattatttgatcacccagatattaagcctagtacccattattttcctgatcccctctttcttccaatattccatcctccaaaaggccccagtgtgtgttgttcccccagtgtgttcatgagctctcatcatttagatcttacttatacatgataacttgtgctatttggttttctgttcctgggttagtttgcttagcatattggcctccacctccatccacgtccttgcaaaggacacggtcagtccttagaagagtagttcttgataaaatattctgcagctgctgttgtgaagttcttaataagttgtagagaaagggcactccattttcttcgtatggtacctcaattatcaattggtcttgttacagagataagagtttttaaagaaaattgtaagacccttgtgaaaattactttttttacttaagatgtttcatgagggttttctttaaaataattatttgcaattctcctgtagaatttgatatgatgggtctagctttgttcagcagaaatgaatttctgcaaatgctgaggcaagcaaaagaaacaaaaaacaacttaacccatttttccttaatttttcattgttttttaatttatcattggaataatgattgtatttatttaaataaagaaaacaggatcaagaagattttttaagacatttgaaatgtaaagaaatgtagtataggacatttgacttgtaaataaatgttcatagaatttagagctgaacactcaaataatctacaaagtgactttttaaacactttttccgtgcataaatgtttcttcaaaaaatctttgtaagagagaatgtagataatattgaaaactatggaaacactttagacgaagtagaaatttattgtattatttataaaacactcagcgccccatatgtgctaaatatcattcaaaaccttaaaatataaagtgaagaagacatccaagggctaccccatgggttgtacggtctagtgaagaaaacgccaataaaaggaaaggaaatcacaccgtcctcaatattgctttcttttccgcatcttttttatgctctataacacagtttgcatagcatttctctagaacaattcctggaacagcgagaaagggaccctcaagtaactattgagtacaatgaccaaagacaaaatcacttagataatcaatgggtggtcaattgtcttctctaccacactgccctgtcataccacatagagtgctgctgggtgtggacatctcttacgagtaaggtagagtcagttgtagaattggttgcatctccagcttgcagttctcctgctgtgtcactcagacactgaagagcagcctcatgaaaaatgctttctatctcaatatttatgcaggctcatgttttctttcggtgtagaaatttactttttcttattagtacccgaagaatcaaaggcttttaagaattccgcataataccaccattcttgttaaatggccctgcattacataattacaaggagaagagcagaggtagatttcaagtaagttatcaccattcaacatgtgaaattaattttgtaatgtatgagcttctgcatttttattttggtacacatactataacgcccttttgaaaatgtatcatcaactgctgatttggaagcctacaactttaaaatagaatctgaaaaaagtactgtgggagccaaagcaagtgcttaagttcactttgtgacattattaataaattctatcacatcgttatagaaatacaatgtacaaatttttcttgagggataaattttcacccagatattaatgtgatgtaggtacattaatcaaatattcataattttttgtcttcttttggaaattgcttcaaccaaccttcagtttaagttggctctccataattgtatatagatttttcatttagagaagttatttatgatcatttgaatgaatggaaattgttaaggaactttcttctgaaattatttttgtgtatatttccagtttattttttttaaacaaatgggctattttgtaattagaagaaaaaaattgctttgaaacttgaagccctggaaatttcatgacatgacatgacatgccatttccaacagcagacagttggcaggactagtccaggaacattcaagtcttaatttctagtccactattctttatacaaacaatctgaatttatatactaatcaatcaatgcatgaaagtttctcccagccaaacacgcttttaccatctcatcccttggtgagtgctggtttgctggtgaaactatcatggcgcttataaaagaagagagcccgtccacttgaacataagatcctaattaaaagtaaaaaggtcagtcgttacttacgaatacttttgaactattcattaatatgtcaacttctaacaggaggattttaggttttgccatagacacattctatttctctttggctaactctctcacctccttcaaatctgtgttcaaatatgaacttctcgaaaagaccttttctgatcacttcattttacaccattaaggaccacccaccatcagcctcctgtcctgccctagacattaccaacacttgtatcctgctcttctttttgggtgatctctatcaactgacattacattacacttattaagcgcatggtttactgtcagttttcctcctctgaatggaaaaatctttgcctaatttggtgactgatgtatcccaatagccaaaaacaattgctaactctcaaaagtcactcaacagttttctgttggaaaaaaaaatccatttagaccatattgagaatgcctatttaatgcatgtagatgcataataccataatgctacttttaatatcataattcaaaacataaacaaacactagaccatgtatttaatgaacttacaacagtgcctggcatatgctactcaatgaatttactattaatcttccttgctgttaggcactcatgatcaccactacagacttctcaacctttccccagttacaccaaactttcgtgggaaaatataatcttaacatatattaagagaatgatagactacttgaagcttgatagtgtcaccaggagattaggaggaatttatggtaacatacatagaaaagggcaaacatttctcttttattatcttgtcttttacttctaaagttatggaaggtaggatgaagatgacctggcaaagccacttgtttctaagaggatggaataaagcggtgttcagtctacggatgtttcatgtagcatattccacagaaaacaacttttgcaaagtaaactaatagtgttagtgaaaaaggatcctataatcacaaccatggagacagtgcgtgatgtaaacagggttaaacattttatttaatgcggaaggatgtagagagctcctctactgacgtgcactgtgactctcagggagacctgaggagcggatctaaccatcttagcttgaagctgtgtattgagagaatggtgttaagaaatgttttctctgctcaacacagtgtggaacgtggctctaggcttgagagctgccagctctcttctcctaccgctgttgtagcgaaataaagctggaagacttggcctcagcagaagtagctcagtactggagaacaaagtctattaatgggggaattaatggggcacttggggaaatgaagaacacagtgtcagtttagaaattcttctaaatggtgctgtggtttgaatgtgtcccctgacccccggaattcttgagttggcaactaaatccccaatgaggcagtgctagaagctgggagctcctgggaagtgtttaggttatgagggctttgcacttatgaatgaattaatgcccatataaagaggagctgggacctactgggaagtgtttaggtcataagggctctgtacccatgaataaattgatgccccaataaagagggctctcagagtgggctacccctctttgcccttctgccatgggatgactcagcaagaaagcccctgatcaactaccagtgacttcattttgagcttctcagcctctagaactgtgaaccaatacatttcttttctttacaaagtacctggtctgtagtattttgttacaacaacacaaatgtactaagacaacctgcaagaacaaaaagcctctctagtgatataaatagcccagctcagcttaggagtcctggtggaattttccatagctgtgcaagctatgaagacagaatgtgtgtcccctaatgtgactctgtgcatagtgtccccaagataagatgctggttgaggatccaatattgtagccactgctccctggggaacatgcgtaatacatgagtgatatttgggtccacgtgacttggtattctgagtggtgtaatgactcttggtggaattatatgtatatcgcccatgaagtcaaccctcaaaagtttagaatggaaagctaattttcttttaataaactcatgtacgattataattgataggtctaccaaaatagtacagcagttccttccacactgtattagatactattgtaattatcagttataattttatgtctcagcaaatattgccttttcagaagtcccttccttgagcaaatctaaagaaagtttgcaaagaaaaactgtaaatatgtataaatatgccagtaactcaaaaattacttttctctgttgaaaggcttaattgtactggttgaaatgttttttagaatatgtcaacaccttgtcactatttacagggtattcctactaccctgatgaaaagagcacctcttaaacaataaggtcttagtcacggctgagctcttttcttcagatgacacgtttccctgaatgttactaggtgaattgattagacactgatatttcctaaatcacagttaatgacaagcatatttttagatactggacacaaattcaagccagtaatctgcaggtgcttgtgaaatgttgtagtcacattttccctgccaaatttctgaaggctacctataaatcatttttttaaaagagaaaagtataaaggtatacaaggccaatgaagaaaggaatataatagaaagtgaacaagtttacaataaataaaacctataacagctaacaatatatgtttccctcaccaatcacatgggtatatggaaggctttttaaaaaaaatgttaaaaagtactgtattacaagaatgtcatagtatttgcattatgccacatttaataaaatgtaatttaagagtttggaaggttttatttaaaagctttgatgtcctcctataaagttcttgtattttgagcaataacatgagacaagacccaaaaggcaattaaggcccctacaccatgcagtgttgtaggagcacatattagaagacaaaggacaagatagttatatcaaaataaatagcctaaatgatctctaagcaatttaatcagggcagtatcccacaggtgactctatcccaacccaaaagtaaatgagacaggtttcatgtctggatattacacactggcagctgaatcatgacacttttctcatttaatagtctgggattggtggggagcaaagaccttggacagttaaatgtatgtgtacctagtcctgatgagacgtcacagttgtgacatctcacaagtgtgtgtgagagtgatgcagggatggagagatggaggaggaaagatggagaaggacagatggaggaggagagatggaagaggagagatgcaggaggagagatggaggagagagagggtggaggaagaggggaagggaggggaggggaggggaggataatgtgggaatgggaagggagggaaagagagtagaggggaagaaagatgttcaatggaggtaaggagaaaacagagctaattacaagcatagagaacttacgtatttttgagttgtgtttacttgaatttctttaagcacagaagatcattcccagaaattaaactgaaactgatgaacaaagaaacagtacaggtggtagagaactactgaaacacacaatttcagttttgttctgttctttcaggatatatagaaagctggggtggggagatggataaaaaagcttaaaacaagacaaaggtaaacaggcatagacgttttcctttccgttcctggcttcagccttctgcccatctttcctgtgagttgtcttctgtcatgcacactccaacatttgtgcaacacatatctctacaatgaagaatatgtcatgctagcttttctgtccaatagacgctgaagttatgtattgtctttttccagtgatcaaaacaaaaactgagacttgggaagaaataaactcgaggggacctgaatgagaacttgagttacactctaatacatttccagggcttttgagaagccagaggcatgtcctgtttcctcaaacaccataaaatgctccttagaatttgaccctatgacagaaactgctacttacctacacaatgtctactctcagaaatcttcattcattatagaacccaaatatagtctccagaagtaacacccagtttaaaaatggaacaggcttttatgtggagttaaccagtgaaatgctaacaatatctcattggttgtattggttgtacaggaattatgagagcgcttttagatgggactgcagtggcagacatacaccactgacatttatgcctcttctgtacactttctccatgccaaggatgcaccagtgatgactggagttgcagcagccttcttgggaccatgagtgaaaggcaaagagaatttcaggtgccttgttcatgaccaacttaagtggctggacccatggcagcagaacacaccaacttttagactgcacttttcatgacagcccagtaagcctatgagttttaaagccaatgtcggattatcggtaccagcagctgaacaaaatttttcatgtgccaacgtcttacgatgagactacaagctcttagaggaaaaagattctggcaaaatctaggattatctgtggaactggatggatattgaatgagtattttctaaaacgataaactcattaggaaacattctatctggtctattctcctcttctacgatcccgccccattcctagttatcattcatggcccagataaaatgacatctccaaaaagcttgatgttaagaccctgaggctaaattagacattctctcttcaatattcatgttttgtctcttttttcccctactatagaacttatcactgtatattataattacgcatttaaatgcatttttttcattgagtccataatctcaaatttatatatttttttcccacaccagaacatagcggaacaccatatcaggacctaataaacatttgttgtttaagttcttactatgcaccagacactaggttaagcccctgggatagagaaagaagaaaaggatgatgttatttaatcttggagaacatttgatctggtatacttcaaagcagtaaaatgagatgagaaagtatctgtcaagtaaaagactggagggaaggggccagatctacttaatagacacacaatcgtttgcaacatacattgattctgcaatataaaatttgccaactaagtaatgcttaactacacacatcaattttctggttgttcaattatatacttgaaaaaaaaaacagctgatgaaaattttgcctgtatttatgtgaaagacaaataatcaacaccattattatcctattgctaaggaggtaacaatacatttcctgctggtcttatctacaaagagacactacgttcgttatttccttccatctttttttttttttttttttttttttttgagatggagtcttgctctagtgcccaggctggagtgcagtggtgcgatctcggctcactgcaagctctgcctccagggttcatgccattctcccgcctcagcctcccaagtagctgggactactggtgcccaccaccacgcctggctaatttttttgtgtttttagtagagacagggtttcaccgtgttagccagggtggtctccatctcctgacctggtgatccacccgccttggcctcccaaagtgatgggactgcaggtgtgagccaccacgccaagcctttccttttatctttagctttccctctcttcaccaaataaaatcagcgaacacctgtgccagttacttccctaaaaacacagaatcaggaattcgattattgataacattcgttctatggagagtctgcttgtatagggaagtacagtaatgggctgcatgacgatgtctcagtcaacaacgaatgccacattcagcagtccccttagattatagtggagctgaacaatgatcactaagcgacattgcagctgtcataatgttgtagtgcaattacttttttatacaaataaatttcacgtagcctaaacgtatgctgtttatgaagactacagtagtgtacagtcatgtcctaagccttcacattcactcaccactcacttgctgactcaccctggacaacttccaggcctgcaagatttatctgtggtaactgccgtagacaggtgtaccattcttacgtttcactccatatttttaccgtaccttttccatgtgtaggtatggttatgtatcttcagatctgcaaagtcttaccattgtgttacagttgcctacagtctgcaggaccctaacaaggtgacaggctgcaccccagagcctaggtgtgccacaggctgtaccatctaggtggtcatatgcacattctgtgttgttcacacaaacaaagatgaaatttcccgatgaggcatttctcagaatacattcccatcactaatcaacacatgactggagtggactccataaccatcgactttaacagagcactaaatccagaagatcactcagagttattttcatccaatcccctcgtaccatagaggagttgatcaagcaattctcagccttttttattattttgctcaaatggtttaacccctcggtctctctacttcttcctttgagagtatcagtttttagcattaaaagagatgatacatagagctttatcccatgctggaaagagcatgatgggtgccaactaatttttataagcagcgcatgcagtccctatggatttgactaaaattttatccagtgaatattttctttatcatactcttcatttatcaaagacctcctatattggtgaactccaggaggggagctgttaatatctgcagtcattgttcttgagcccagagcccagagaaaggtgactgagcaaaaaaattaaagaggacgcaatatgcaaacagtaaaaattgctgttttctcacttactttgaaataatataaaaatgattctataaagacttgttcattatagatctcatttgaaatgtgcaatagcagtggattaaccggttaaaagtcgcaatcacttttgtttttatcttctagatagaattttttctaagacacagaaatctttgcataaagttgattatacttgatttttatcagcaacaacctcgcactgcatcatttattttggactttgctaatatgtattacgtgaagagttaaggtagttgaattatcttaggcactgtgagttatttctacaaaatctaagcatagacttaaacaaaagttctaaaattaatatatgtttaaagaaaaccccagctccattccatggcctcctctggggcactggctggccttggccttgcctatcttttaagtttacttcacagactttcctttctaacctccctgctaatggtaaacccatgagggcagaggtagcctttgttgtgttcttgactttctccccacagcctaacgtggtgtccaataaagctttggtgaaaatacgactacgtgcagggtagagagggttatctcataaatacagcatggaaagaacaccactttttagatgcaacgattgcatatttcctgtaagttgtaggcaaacgtaggtgaatcccagactactttgctcccctgcaaaatgctttctgagcagtactaatcactatgtagcctgccagagctttttatgccaatttccacttcatttgtttgtgatttgtccttactcaaagtaagtgcatttgtgctcaaaccaaccttctctctctgctttgagtcccttaacagaggtttcacgatgcttatgatgcagagtgaaatgtacaacaattttgcagaaagaccagctctgaatttctagctcctacttttggcctcaaatgaatacattgctctgattactacacccctctgaatttctcttttctcctctgaaaatagcacagaattgtgaagattaaaagaggtgatatagagacatgaattaaccgagtactggtaaagggaggttctcagtgagtgtataaagaaataaacagttataaacatggcaatcaaatgacatcaccatttacttttatctttaaaaccccatgggaaggggtttaccctcactttagagaaaaccaccttgagaatcagtgagacccatgaaagggggcgccccaagtcacagatggctaatgtgactgcaggaagaatcccagcagatgggccgggcgtggtgtgggggaaggaaggcgccaggcacagttacgggcagtgaggtacagggcagtgccctgctctcaagcagcttgcaacagggccaagcagtcagggcctggcataaagtcgagttatgagcaaagaacagctatccctccaagagtcaccatcgcataaagggggagaatcgctactggacgatgtggttcagaatgagtttgcagaatttattttccttccgctttccctccgtgggctgctgacctctaatcacaggctggaggtattcaatctggaagaagtatgtaacttccaaatgatgcaagctactgggatcaagccatctaggaaaagtgcctgtgtcatcattttaaaattgacagtctcttcttagaactttttaataccacactcgccatactctatatgagtcatactcaccacatttgttacctagggcaaattactaaaagtttgaccttgagttataaattatggtactacatttttaagcatgagagttttattgaaagagactaatactattctgccatgtattttaattttattataccagtctttctgtaccctttctgttatggcttattattttacaatacagttttaaatgataactatttttaaccatccattcaagggttgaataattttctcctttagaaaattatatattaccatttttcttcatctcatgtataatcatggatttgcacttttctctctctttaggcttattaagaattccttccttaatagttttaagaatgcatatatttctattaattttcatatttcctagccctttttcaatacagttttgaataaagtcctttcaattacatttttaaaataagaaatagagatttataaaattctctccctgcgggataggaaaatttggtgaaaagtttgtcctactgtttcaggaaatacatcacattggttacagcataggtctcagggtgcagcagtcttaggtatggattctaacgtcagtgtcactgggtaccaaatacctctctgcttccgctttcccgtttgttaggccaaggataaaacagcatccgcctcgtaggaatgccactagcatttaatgtgcatgaggttgcatgcatagggaatacagaaagtaagcagtcattattcagctacagcgtactgattattctgttgcctctgttgtgaccaggctaacaacaacaaccaccactttaaaaataatagcctttttcaaaatcattagaatctttgtctgctcaagctgccataaaagaatatcatagaataagtggattaaacaacagacatttatttctcacagctgtggaagggggaagcaatcctcccacctcagcctccctagtaactgggactacaggcccgtgctaccattcccggctatttttttctatttttagtagagatgaggtctcaccatgttgttcaggctggtctcaaactcctggcctcaagcaatcttcctggcttggccttccaaagttctgagattaaaggcatgagccagcacaccctaccccttcctatcttaaaggcctgtcgctgtgagctattatggtaaggagaaagggagaaagagagtgagggaggagagggagaaagagagggagggaggggagggagaaagagaaggagggaaggagggagggaaggagggaggggaggatggaaggagggagggaaggaggggaggatggaaggagggagggaggggaggatggaaggagggagagagggaggggaggatggaaggacggagggagggagggacggaggggaggatggaagaatgaagggagggagggagggaagagtggaacaatggagggagggagggagggaagaatggaaggaaggagggatggagggaacccttgttctcataggggcactcattctaacatgagggccccacctaccctcagaacttcatctaaaagtaatcaccttccagaggacttacctccaaataccatcacactgggatgaggggtggaacacagcaatgtatgaggacacagacatttagtccttaacatttagaatgtgtaaccagctgaatatttagaggcaactctaagggcacagcagcagaaagatcaggagccccactcctcatggacaacggctgcaaaagtctcatctctacctggccgtgccatgtgttttaaactttgctttgttctaagactatgttatagacaaacttatttcatcgacttaatacactaaggtgtataaatgtctaactaagactttaaaagatttcctgcagaagagacgtttgttggaaatgttgaactttaaaggaaaaattgtgcaaagaccctgctttgagtttgaacgctgatgattttgatgtagcatttacctctgaaaggtcgtactttaaatatcagagctaattaggcctacctccaaactatctcacacacgaagctaagggccatgcactctagaagtcactttccagcccacaacggctttcaaatcgcagagagaatgcgggacacagacaatcttttcctaaacaagcaacccccctccctggctggcatttgaaatgaacagtgtcttaagactgttttcctccctcttcaggaaaatcacagcctgagaacaggaaagcgagcggatctcaagaaaggagaggacaggaggagctcccaaactagcttcattcatttcataattataccaggacccatcccagcgctatgaaaatgccttaagctttaggcttaaaaattaaattttcatacataaagtttatggcccatccttcaacaaagttcgagtttttaaaaaatgtctttttttttttgatttacaaagtaatactctgttaccgatcaacgattgttttaaaaataaacttcaaaactttacaaatatagtcggagtccttacccaaaacaatgccattcttcccctactggcagtactgggtcctgaaatttctattcatcatgtacacatttcaataattttgccacaaatatatacacatacacatgtatttcataaaccctaagaagaagagattaaaaatttaaaatattcatgtaaataatataaagctattatttggcacattactcataatattgttttggaattcatccaccttaaaatattgcagcttaagttaatttattttttgctaccgcatagtctcttctgttgtataatactacaaaattatatccattttgctaacaaatgtaattgtttctagtttttcactattgataacagacctataaagcacatcagttaacatgtcttcttgtgcacacttttttttttttaacacatacttgaaagggaagtgttgtcttagagatcacaaacatccattttactagaaattgctagactcttcaacaaattgctaagtcaatgcacctgatctacagtggctaagtcccatcaggtggcatccttgcaagtattgattattatcaggtgttgcctatctaattggggtgaacactacctctttgctatttcaacttgcattccgcttattactagtgaaattaatgtttgtatttgttcattgaacatcaatttcctcttttatgatgtgtctgtttttatttgcctgatttcccactgagttgctattgatttgtaggagttatttgtatacttcgggtttttgttaacactaaaaattatacttttattaatatactagtatgtactttactgagtgtgggttggggatgttagtgaacattgttcacctgaagtaaatacaaggcaaacaatgttaaagaacactagtcaaatggcaagcacatagccagaatacctggattttattgactcctggagaaaagtttgtaatattgtttctgaaaacacatatttgtggtttttagaattttgatattattcataagtccttgtaattgattttcatataatttcagtttttgcgagaggttaatccaaaattcccatgtcgttggtttattaatatcttcttataatattatcatacttggtttaaacaatttaggctaagttatataggacatacaacttgagcactgtcacctctcctggaaaattattatgtatattatgacactctttgtctccaataattgttttttgttagaaagacaaatcttaatctttgtcgtgtttgatattatgataggaacaccacggttattttagttagtatttacctggtgtatttttctactctacctttactctcattgacttgcctcttttgtaaacaacgtatcattcaattaaaatacaaagttcaacgtagacatcacttactatgctttaacggtgaatttaggattccggataccttgttttgtgctatatataatttttctatgtgtcatttacacatgtctgtgtttgttagactcttttttctcccttctactggcttgaaagttgtctattctgctaaataatcatgattaagttaaaagctactagagaaaggaggaccagccattcctgaatcttgtgtagtagactcaaaaagaacgcctgttttcttctctttcctttttgtttctaagtgaaataacccaggcatagaaagaaaaatactgtgtaatctcacttagatgtggaatctaagaacatcttctcagaaatagagattagaatcagaatggtagttgccaggggctggggagaggggaaatggggaataattgtcaaagtttacaaacttccagttcgaagatgcatcagccctgggatctaatgtacagcatggttactttagctagtaatactgttattatatacttgaaatttgctaaggtaagagtagatctttttatttattttattttacctatttatttattttatagagatgaggtcttgctatgttgcgcaggctagtgttgaactcctaggctcaggcaatcctgccacctcggcctcccaaaatgctgggactacaggcatgagtcacctcttctggctgagagcagatcttaaatgcccccatcacacacagaaaaatgttttctatgtgaagtgatgaatatgttaattagtttgataatggtaatcatttctcaatatatcacattatataccttatatgtataaagattttgttcattataccctaatgaaactagacaaaatgtgttaaaaagtagatgtggaacttaatccaaatataaataaatgcatgaatgatatggcaatgtaacaaaacagaaaaaaaattaaaacctgaagtctgtcatttcctgggaatgagtgaaattctgagactgcttaatctttagtactccttccttattattgtcccatattttagatttaccttgattttttttaacctctaaagttagtcactattactgttacttctctttcctatagagaattgttagagttctaattctgctatttgtagattctcattcagagtcatttgcttttgactctcttgggtgaatttcagcctgtggactcacacttgacttggatctgagagtgaaactccggggcatggtggaggatgccctccctctgttgagcttcttcctttcttgctgccaggcgtccacaggcactagccctgcctctttttttcatttctgcaatctgggattcccaggacacataagcaggctgaaaggaatcccaaaccagaataaaggcaggtttgtggttagaaatttaagaacatcctttcatgttccccgcgcagtgcaggcaaagacagatattatatttcccttgctatttccttttgctggtgggctgatttttaagtttgaactcagcctttatgaggatcatgcatttgaaatgctcgggacacacacggaggaaactcagctccaactccttatcttcaggaccctggagcttcaaacagccatcgccacccagttagcctggggctgaaagagtaaaacgtgcccaaccaggaccctcagcctccagcctcaagttatcactcaggtcccaaaatccacttcccttttggccctgaggtttttctttacttccttgcaaactcagctatggagaggaaggaagtatgttccaccagatacccagagacaatgagaattttctaagccttggctttaatcaaaactgtcttttaagccaataaaaacagcatttgcaactcaaaactgccatcacagaagtcatcatttaaattaatgatgaaccataagaacattagttcagccaaggaaactgagtctccaagtagaatcacattttatacgcctttagctcagtcactaattctgtcttggccaaatagtctaatgaatgttagaacagaattgtattctctatgagaacacttttaatgagatatattaattttcatttaaaagcagtattatttcttgtgggtgatatcacttattttttcaaaaatgtattacgtaaaagcaatgttctgactagctgtgtattctagtgccgtgtattctagtattcgagggctaaaggctaggctgttgggtaatgatctaaaaaaatctgtaagctgaaaggttagatttcttaaacaaaaatgtacggtacagatttactcctcccaccaaaaggggcctctgtgacttctttcccctggagttatggtgaacaaactgcaacagaataaaaataaaaaacctgctttgaccacatttctattacattcaggtaaacaaaaacatcgtatgggactgcttttagatttgtgacatagttgttccttccaaactagtccaaatcctgaagctctgtctgtggcagttaatttacttctctggcacttgatattagctactttgatgtctttcttggaaagtcataatcaacaatcatgagtcaattttcactgaccttcaacaatccaggaaattgtcaaataggaaaccatatcatcttagcaataactctatgaccaatataattttgaattatttatatcaccttaatttaaggaagcatcttactggcaacaataataaaatgctggatttttatgtatgtgttctagctgaaataataaaaatgaaaatctttactccaattgtgactggctcacctaaattatacatattttctaaaccaatttttgatagcactcaaaaacattaacttatttgtgttttgaccagaatgctcagaacaattatagacacaatagtcctgcagttttctaaatacagtgtttttctatctatataatgcaatttgtcatagcagaagaatcatagcctcaggagacaacatgtcttagaagtaaatcagatcgttcttattgactagctccatgaacttgggcaagtttgttaactacctgagcctcatctataaaatgaggatgataacatcaaactatcaagaataaatggagtgacatttgtaggtaaagaatacaacacctactactcagctcttgggcactatgcagaagctgttatgtggtgatgatgatgattaccaacgtgactacaattaattattagaatttcctcgtcttaggaataattttaagaatagactcaaacattgctatagtaacacattattgtacgtagaatttcaaaaagcatgacattcaattttcaggaaaaatactcattcagaataagagctcctgtctttccactttttagaagataatacaagaaacatccacagaggttgcacatgtatctaaggatctagtttaataaaacaaattactggtacacaaatttgcagatcacaattctctcatcgttctagtttacaagctaatgtgtaccccccctgaagctgagaagctccgttacttaaagccctgtttttaagggttagcaagcattttattatggaagactggttcctcggcgttctagggtagatagcagtaagggtttctcacctgctgtcccacccaggtacatgacagccatattcaccgaggtggtcatccccagaataaggggaacagggccttaaaacaaacactgattaactgcccaggggtagggaacatcctcagtaacatctagaacgttctttggccatttttgcgccataaacttggacaagttaattcttcttgttgtgcctcatcaataaactaaggataatttcaatcctagatgagtaaattaagtgccctaggtaggacgatgaacagagaaaacatgtaggaattgggtttaagtcccatttctaaacttctacttgaatcaaatatttcgaacaggataaaatatgcagctgaattagcaacaattaagaagcacttatcaatatgtcaagtatataaatttaagttaatgttgctgaggtcagatttgccttgatacaaaggctgctccttatatagaatcatcatattcagagctcttcaaattaagttgaaaaactgtcctctaacttaatttgacctcgactattattagtaaaaataaatagtggaacctgtttcaaaagtagcaaagtgtaacagtatttaaaaattatttagttacaaattgtattcatatattttatgctatattttatggaatagcaaacaaggataattactaaaaatagtgagattaaaaacatatacgttagggaaaaattctatcagcattttggtgaatgatctgtctctgcacagtatcatttgacatgttacaattagtaaacagttaatgcaccatattcagagttcttcaaagccagttgaaaaagtgtcctctaacttaatttgacctcgactgttattggtaaaaataaatattggaacctgtttcaaaaatagcaaaatttaatagtacaatttaaaaattatttatttacaaattctattcatatactcctatgttttatgctatattttatggaatacaaaacaaggataattattaaaaataatgagattaaaaacaaatatattagggaaaaattctgtcagcattttgataaatgatctggctctgaacagtattatttgacatgttacgattaggaaacagttaatgcaacataaaatgtttgaaaactttaaatagagcaagtcagtgctcaagtttccctaatgtgatgttgacttttataaactctcaccatttacctatcaacttggttaccctaaaagccagctatttctataggtccatggtgtccccacagataaagattcccacacaaatccaaaataaaatgtgaagaaatagatttccccccattgcccaggagacggggaaccatggcccccactgtattccatgcctactttgtgtgcgtttgggctgtgtaagtcatcccaaaccggcccaccgcactcaggctcgcccggcatattagctgatactgatcacctgcccaccgcacatagactcaccaggcatattagctgatattgatcatttggaactgacttaaaaccacctttttacttcagctactcatctaccaccaaaaacccagtgttattcaccaagttggaggttttttacgttattttttctaagtggaatggtaacacatttccatacaactcatttaaaaatttaataccaaagaaaattttataaatttttgttttctatgtaagagaaactgtccaggtcttagaaacagttgattttggagaaaaacaaacacaactttttaatattttcaagaatatatttgaaaatattaatatagttcattttatgtgtaataatgtgatttcattataatatgttaggttatattgatgattggttagatagaagccaaggataaaatttataactctgtcaaagtattcactaaattttaaaaagtagaacaatttcatactcatgcctcatatccttccttcagaaaaacaattttaaacaagtacaccatacaggtatgtccccactaatggcgtaaagtgacctgtcctgcagttgaacatttttatttgtcatctatgaacattgatataacttgaaaaatacattatcaaagaattatacttagttttatacattatacaaaaattctaattttttgtctaataaaaatttgatgatctataaatcctcaaaatagtagcacagagaatctagatgaaaacttaaatagtggattgtgatgacttttcatttactgcaaaaataaaaatatgattcaatatttgaaaacatattaattcaacgtgttaagatggaagaagaaacaaactgattaataaaaaccaaatgacatttagtaaaatatctattattgaataaaattaacaattttggaacttaagaagataaaaatcacttttgtgatttttacaaaacaaaagcataaaacctagtaatgtaacagaaaccattcctgttaaagagacaagaatagagtgtctgtttacttcaatgttatttttttttgaaagtgctttctaatgcaattagttgggagaattaaataagtataattatttgaaacagtgaagataatattcattaattccaaaaaatgcacaacaaaagaatccattaacaacagttattaaagaaaagtgagttcaatgaagttgctacttagaaaatatatcatgttttaatatgtattagctataaccatttagaaaatataatttaaaaattataaaatagcaattaggatgaaaaagtaacaataagagtttaaaagggagtcttaggattaactatgaactctgaaagatctatgtgaagaaaatgataagcttctacagcagagtaaaaatagtttaaataatatataatgaatataaatgaatattaatattaaagtcttcatatctaaacgcagtaagtattgatcccagctacactgcaactccaattgtaatagaaatagcaatggtcactgacacaataagtgacacattcttggttggtagaaaaaaatggacatttatattaaatattaataattaaatacatatctttgcatacttcgtgtttaggctttggcttcactccctccttagtgtcttacatgactttacatcctcaccaaagttctgaagatattccaaattgtaaggtgccactcttagcatcagaatgcatattttatattgaacaatggtatgaaaaggtacattgcaggtgtgcaaaatataaagtgtatataatttagcttgaattattgtcatagccatatacttgtgattaaattttttttaaacactgtaatgactgaaataaaataggactcacttattcatgcctcatatatattcaaactacatttttggatctattttctagagtcagtacaagtgagatggtggaggggagcagataggaataagacatatatacgaggtcattcttgaaaagtgtgttcacaatttcaaaatcctcgcaatccacaaattgaaacattgttacaaaaaacctaatccaagaatattgacactgttaaacatatgtccaaatccaaaatgtattttcacaacaacttaatttggactctgtatcaactcaccataaaggattatcatcctgtttaaagaaaataattgtaaggtgagcaaaagatggcattcaaatactaattgagtttctatatttgaacaaaatgatgactacagctacatataaaaccattatgacctgaatattaattagattctttttgactaatgttttcctcttggatcaatacacttagttaattctctcaagaggaagtaattattgtagcagtgaccaattgttgtttatagctcacagcaagtctgaggtactgaaaggtagtatcgctgcttacgtttctaagtattttgtagtatttagagaaacaagtagtagtcaaaatgattttttaaattttatttcacttacttgaaagattagagatgaatatcctcatttccaaagacttatttttgcaagagtagctatgggattacagtcaagttcacagaaaacctaaaaatctctgtaaattccaagtacatacaaaataaggaagatatatgtgtatctcaattttttttgaagtaacataaccaaatacccccacttaattctattaaattgctaaaaaaaaaacccacaaatatctgaataacatcgacatcacaaaggacattataaaatggttaatagcccccaagtaatcttaatatgggagagattttcataaaacaaatccctttccacatagaatgtttattcataatgcatcatatactcatcaagatgcttgctatttggagaattacaattactttctcattctgctgtatccttttattttttcaatatatgaaacattttcttaatttcctgattgcaaagtaaaatacacaatgaggtgcattttccaaggtatcatcttcgtctttttgttgtttttgtttttgagacggagtctcactttgtcgcccaggctggagtgcagtggtgtgatcttggctcactgaaatctctgtctcctgggtttaaaccatggtcctgcctcagccctcctagtagctgggactacagacccgagccaccacacccggctaatttttgtatatttagcagagatgaggtttcaccatgttgcccaggctggtcttgaacctccaactcttgatctcaggtgatccacccgcactggcctcccccaaagtgctgggattacaggtgtgagccactgtgcctggctccattttcatcttcattgtgctttgaaccacactcctaaggctgtgtagcttttgatattgagaattttctctctgaagtttaatcaagtatttttatcagagctcatgtattctttgacttttttgaatatgggaagcatgtttttatctaactaaaagccctcaatatatcgcattcatctggtagcttttttcctttttctccaatcttttgaaagcatccttcacatacagtttaacctcattttttatacgtatattgtaaatatcacacatgactttatcaggttgcctgatccaaaataaaattttttgtttctttgcagtttatcaattaaccagcatctgttgaattcttaatatttacattctacttaaaacactgcaaaattacatcttcataaaaaagcatgaaaattatatacaggtgatacccaatgaagtctcagaattacaagtagtgccaatctatccttcccctacaaaatgtcttgaagttattgcatcattactggagtttatattacagaattccattacagatggaggaagaagggcgttcaagccaacagttgggggaaaccacgacctctctgaggcacagcaaaatgttgacctgagcttggggccatatataagatgagcttcaactctgcagtgtattgttgttttatgattaatgatgaaatattgaaaagcttctgaggagagaaacatgatcagatcaatatttcagcaatctctttctgagactttggttgtgatagggaggctggaatgtggacgagagacttgaaggaggcaagcggttagaaaggagttgacatagccgcgtgtttcctacggtgcaaatcacaccaggcatttctttctcatgtctcttacaaatagttctcatttttaattaattcactacagttaccttcttcccagtctttatactggttttatgctttattaacaaaccacgattcacactctgtttccacttcatctcctgttctccttcgtctccatccatgatctccctcggccacacttgccttggctcttctactttctgaaaccatctattttcaaagatcacagagaagccgcagagcttttcttctccccatgtggcatatctccaggcttttctgagtctcctctcttctgatatccagctgtgactagtacagcttgaaccccattatgtttgatgactacacattttatagcccgacttcctgttcaacctgattttgactctgatagaattaaacctgcccctcaaatgaagatcgcgtgtctgccaatgtagctcctttcttctactaaaaccgtctgatccttattttcatttgtaatgtgaaaatagaaatattgtgtttgaggacagtgctactcatcacctgcacggcaccccccagggggctgtggcttccttcctcctagaaagttccctgccgcccaccacactccgtgacttccccacttactcactgatgcttgaaatccccctctgaggacctcattccttcaacaaacaactcaaggtgctgatcgctgtgaaaaatgagacacccctagagagagagggagcactttaaactgtcaccgcgttcactctttactgagattgcattttaaattgttatgagagcaggtcctagtgggaagagagttaaagaaagatttcctagaagagctggtgcagaaagttcagaatgttgaagctttcaaagtccactccttttattatttcctcattctgcctggagcttactctgaattattgtcactacagatatcatttgcattacatatgttttcatttatggatagatgtaaacatatatatacttgcaatgcgatatacacgaatcagggcgtagtggacactcaggaccatgaagctgtaggggttggtgccctaacagcaggcaaccatcaacccacagaggttggtgaaatcgttcattagtaagaaacactggcagtgcttggaaaatgtcaaaataaataaataaaagtttaaaaaatacgtagctttgcctgatgccctgtttgaaatgttgtaggagactctcctcattaactgaagaaaaactcactgcaatgcaatacatttttcatagagaaaaaactgcatcaaaatcaggagatctaaaatgaacaccaccaacaaaataccaccattacaattacatttcaaaagagagaaaaaaaaaaggcaaagaaaatctcaggtgcctgagaattagctcttttgcagcagctttaaagaaaggaaaagaaaagaaatggtaaaatacatccactttaaggtatacatcactatatgtatattaatcctaactcactactaaatcccaggcctgtatatgattaatatacttatacatataaaacaaaaatggatgcagcttccacattatgaattactcctccagctgcaagcttacatgtgattacttggtcctggcagcgctatttgaaaggcacagtgcattccacgatgcatacagtcctcccttggtgtccacaggggattggttcgaggatccccatacatagcaaaatacctgccctacagatctcatgtatgggcaaagtcagccctccctatatagatggatttcacatccccgtgaatactctattttccatccatgtttggttgaaaaaaattgcatgtaagtagacctgtgtagttcaaacctgcactgttcaactatcaactgtacacccacacctgtcaggggtgtgtgtgtgtggctggacacatggagtcttactagattaatctcagcatgctggtacagctagttttcctgtatgaccttaataggtatagtactttatggcttagtactatagtactttatgcccttaataggttcttcgaatctgggactttaagaaaacttataaatagaaaaacatttttttccttgccaatgtcataacaaaactacattgaacaaaagcatgttattccactaattgctgtacatcctttcacctgaagtctcagtttccaagacctatagacaatgaggattacatatatcatactacataggaaaaactatctaaaaccaggattctatgagtatataggcacagataactatacacgatcacagtatttcaaaaaatacatagaaaccacatgcataacaagtgatttgcttcaaacttgtaataccagttatttacttgcagtataccttttttgaaggcagggcttttatgtgcctgtttttgttgaattaggtgagaaataattgcattcttcctaacactccaaaccgactgtagatgaacataaaatatatttggaagactgtacattttcattctgtaattcttgactgtacatttttcattctgtaattcttgaatgaactctcagtaaaggaggttagtatgagatgacctttactctaactcaccactatatacctttgcttgtatcagtcttgatgaataagtctcgacacacagataaaacgatagataaaatttgttaagttgtagctttagcttctcatagaaatcaaataagaagtattttgtaagaaaggaaattagttcacaatatttttaattacaaaggaaggaaaaccacatgcttaaaacagctattgcgtcatgtacctgacatttctaactattatcatttaaaaatggggatcattatgttgccatcatttgatttttgaggaagaagtataaaaaatataaacaaatgaaagccaaagagccaaatgatagagggaaaattaccatttactcttacctttatcttttaaaagagatttggataactcatttgtaagaagaatatacacttgaatgacagtctttctcataaaatataacttataaaaaggcaatgagcatatttgtattagttcacaaatgaatgtgagtatatgtatataatttttccagttttatgtcaaaagtcatgaaagtgctattccattcatatttacgggtaattcgagaaatggatgggtttctggatttcatatcagataaccggtgcaaccctgctcaggtcaattatacttttttatcttcaactctggggtttcagaagcaaattataataaatgcctaataaacttattttgagagttaagtagcaaataagaatagaggacattctattaacttcaattttcagttaagcaatgaatatattttaatataaatatttatcatttgtcgttcatttgaaattcaaattaaatgaggttttctgtattttatctagaaactctaatagagagcagtaatctgtagcaaatagtttataacctggatatggtattcgaatattcagttaaaaggatttgtagctagaccatctgggtcaaaacactgacagctcagcaagatgatttagcctctgtaagcttctgtctgcgtgtatgtctggtgaaacctgtactggtcacttctccaaatggttgtgaaggtgaaatgatataacatacttgctgtgcttaacatggtgttaagtgttcagtaagtgttgactctcaccattatcactggattacttttctatggaggctgttgaagtgtcctgggagtattcagaacgacatttgtattgctatcagtgataaccgcatgcattttttcagcatattctatgtcacttaaaataaatgcagagttgaagtaagaaactgtgactttattgtaatatataactcatttactatatggaacatattaaataacccctcctccattatcttagaagtgactctaatactcactaatgtatttttttgcaaagttaaattagacatcaaagcagaaccagagaagaaaatagtttataaagtccaggcctctgaaataatcagcattttattaacactatacttcttctagctgctactatcaggcttataacgtgaagtatcacccaactggcatacgtggggaggaaaaacacatgactttttttacgtttcacttttctaaactatgagcacaaaattaagattttaaacactatcaacgtgctcaaaatgtctctggtgcccaagagttgcaaacgcattattgattaatcgtcagcacagtcgtaatggcattaattgaaacatccaagcaaataactgtttctttaatatttgtttagtccacaaattatagtaagaggtctgtgtttatagggaaggccttctgttctttaaattatatctattctattaatagattaatctatgaaatttctattaaatatcgaacaaaaatctataggtctccattaaatttacttaaaataaaattaaatgtttcttagaagtgcatcaggtgcaaagtcaacataatacatagcatttcttgtgtctaaactgccttgtgatcaggagatacgggattattagaattttttatcacttggaaaaatattgccaccctcaacaaaatttatgactgctttgctttgaaaactattgtactgcttttattttttcccagactcaagtacccaaaaggtttgctcacagatattccagaaggaaatgttgtgtcttggccacattcatattttcttgagagccatcaacaaacatgcttgtagctgagcagagtgtgtggtatagaatgacaggtataaatagttaatacatttttccattggtatcccttaaactacttgctccaagaaattcttctaacaatgagattagtgatataagaaaaacaaatgaaagcccttggccttataaagataaccaatgatagtcaataaaagagtagcttttacggcatagttacattttctggggttttttctttctagtttttaagataaattattgtctagtttgtttttattgatttttttacaaataaatatgggcgaaatgaaagcaatatgacttctcttttatgttttattaagaacagaaactgtaaggtcagaaggtataaagcttctgtgttgtgtatttgttggaagaaactcagtgccaagattaaaggaatcatctttaatgttttaaaggaaaggacaaaggagaataaatacattgatttgtgtgcatgatactatggcctttatttaaaattttacgtgtagatcacagatctcgtagagggagtgataggaaaacaaacaactgtgctgcttttgtaactgttacacattggtgaacttccaaaacttctgagtgttcctaaaattggcatagataaaaggtaatattgtaatttttaacctcagcatacaaaaattcatgtgcacatcttcctaaaaatgcaaataatgcaaaaattgtatacgttttgcaaagcttgttttagtgataatactcagtgtgattccattcacaatgagtataactttacacacacctgtgcaaaacactttagtcacagaataaaaactctaaaatgctataactttggcatgactaatgatctatactaatgaaagtgatattgttatattttatatgttattccacaaggcatgaattataattggatgaacaataaattaacttgcacaaaaacaggattgtttaaatgatactttgtgtaaaaaggaaaccatgaatagttaaaaagtcaggaaacagcagatgctggagagactgtggagaaataggaatgcttttacaatgttggtgggagtgtaaattagttcaaccgttgtggaagacagtgtgacgattccttaaggatctagaacttgaaataccatttgacccagcaatcccattagtgggtatatacccaaagggttataaatcattatgctataaagacacatgcacacatatgcttattgcagcactgttcacaatagcaaagacctggaactaacgcaaatgcccatcaacgatagactgaattttaaaaaaaatgtggcacatatacaccacggaatactatgcagccataaaaaaggatcagttaatgtcctttgcagggacatggatgaaactagaaaccgtcattgtcagcaaactatcacaagaacagaaaactaaacaccacatgttttcactcataagtgggagttgaacaatgaggactcatggacgcttggaggggaacatcacacaccagggcctgtcaggagaaatacctaatacagatgacgggttagtgggtgcagcaaaccaccatggcacatgtttaactacgtaacaaacctgcacgttctgcacatgtaccccagaactttaagtataataaaaataaatttaataaaaaaagtgatacacataattttaagtgaagtagtgattcaaagtcttattttccttctggtcattgattcaggaaacgaagtctttagttccagtgggatcccaattttaataaataaaaggaaatgtatatgtgttttgatgtttctgtgtagaaggaaaaccctcaggggaaagaaaaatagaacagtggttttccctgagaactaaatctcttttcagaaatacaataaatgttcaatttccttaatcagaaaataagttaaaaacatttaaatacatagttaaaatatgtaatagagtactggaattcatttcaaagtagcctgtgtatgttttcgtataccaacaaatgaaaacaaactacatattttaaaaagataaactccaggttaagtttaaattcagagaaaggtcaaaaaaattaccaggatgccatcagactatccattttacaatgttgtgtgttttataaaattgcatgtaacttttctgccaattaaaaatagttccttcataaacccttactatatagagccatagtttaatccaacactatacatacatatttatatgtcatctacagataacatatatatatatatatatacacacagacacatacatactgctgttaatctttaagaatttcttatgaagttgggttgtattctgaataaataagcttaaaaatccactgaagggaacgggactgacttcccttggatttctgacctttcactcctctttcgtgcctcatctctgaatctgaaggtgtctggcttgacccagcccccatttccccatcaactaatagctgtccgtcagctttcagtcaacctcctcaccacatacttaaatgtaccgtcttaaaaaagcatattctcattgtttcctggtgccatgtttttcttttatatctagagagttttcttgaaattatagacatggatagagctgcatgtctatactcatgaaaacagcaagttcactatgaggtgtctcatacttccctttctcacaaggatatgcagaaacaacctgtttgtatcatgtactgatttaaacacaagcgacagaatttaagaaactccttaaagtgttaacataattagaccttacccattccctaaatgtatttttatttttgttttttctgagacggagtctcactctgttgcccaggctggagtgcagtcgtataatctcggttcactgcaaggtctgcctccctggttcacaccattctcctgcctcagcctcccgagtagatgggactacaggcgcccaccaccatccccggctaatttttttgtatttttagtggagacaggatttcaccatgctggccaggctggtcttgaactcctaacctcgtgattcgccgccttgccctcccaaagtgctgggattacaagcatgagccacggcgcccaaccccctttccctaactttaaatacaataattaaaatgctacatttataaaatcctttatggttctctttctccttatgctcatataacttccaccaaagagaagaatctattcttgaatttcagactacattcacaatttatatataattccagtgctcaatagagccaagcttggtaagtgttcagtgaagtatagtgattaaaattcagtttaattttcaatggatggagtgtaaagttcaaggaggttaaaaacacagcggtagtgctggtaatctacaaaatggctaatatgtgacttaaaattcataaggaaactgaaactataaaattatcagctatacagaatatgaatacatattgagccacatgatacaattacatctgatgctgctatagctatataaaatataattttttaacatgaaagcagcattttaatattaggttgacacaaaagtaattgtgagttttaccattaaagtaaggtactaaaatactaaacatataacaaaacgttagataacatatgcctatttttagaaaatgattaaataaattcatgaatggaaactcaaattttagctacgaattcaacataaagtgtagctttttattaacataccgaacagtctatagccacttaaatggctaacaaaaccagcttgtaacttgctgccactatcatctctgtttgacttggtataagatctgaacaaagagccaagtgtgattatgtggaatgctttcatttgtgtttataaatttggctcttggagtatttataggaaaaacactttaaattacattctcaattgcagtatgtatgtaataaagggagactgctaggataacttctctgaaagtaacaagcctcatttaaaaatacttgcccttccctgtattaacattatgtccatatatgaaataagattgctatattgttataactatttactgacagttgttaaagttgagctatggacacattactttccataaacatcactctactgtttttatgtttgaacattttcctaatttttttttaaaaaacaccaaccgtattagcaaacttctgagcatctccgtttagacgtgcaaaggaaattattccccatgccaagcttcgtctgtctctgtaaacgcagtatacacactaacacacacacacaattaagcagtcgatggcacaagtgtgcaagccacattttgaaacacttatatttagtgtaaaaagccaactgcttcaaacaagtcatgaagaaacacacagtcacacacaagactagacagatacaggtggcaaacggacatctcaacagaatgtcaagtatcttcctggattctgaatcaccattaaatgtgaatttttggcagtattgtccttggataagattccaagtcccagtagcccatttaatagcgttttttcatgagcaggaatactgactttattactcaatgtcaatacagtgtggttagtgcaactttagcaatgtatcctctaatacactgattctgcagacacggttttattgccctaaacaaatagactcaatgaaaggataaatgcttaactttggatgtggtaactcattcgagtatcttaaccctgttcaacttataattagccaactttgaatgtgcattttcttctatttgtcattcattgcaattttcaatgcagcatttctaatgaagaaaaaaaataaaactctacgtaagatatggaggaggccaggagtgttggattatgtctttttgatgataaaaagactgagtgcttgcctgcagcagctcactgtcagtaaaaatgaatctgaagcagatgccaactgcgtcaaaagcttgtgttctatacattttttattaagcaaagatacaaatcacaagaaaagtacataggggcaagaacatcaaaggatactggtgtttcaaacagaaacacaggggcctatctgctgcttccttcccagcctagaacacagtgaactcatagctagaacgctgagcgttaactaacgcgttgaaaataaataactctgttttgtatgctctcttcattacaccgtacacttcaaatgtaaatattctgaattatttagaagtacgcttaaaagaagattttaccatggcctatttcttaagcaagcataggccaatcaaaggttactttctctctttaggcatatagttagctttgtatattgcagtatttgatattagcacgtttttataatgtagtatataataagctttgaaagagagtggatatgttaccacgttctgaaaaaataatttctaataaataataattgaatagacacgacatgttttcttcagttgtctagaatctgacaattaaattttagtaccgaaatgtgcgaccggataccaatctgagcacttgcatacatcactgtttcagtatatcctccacatttcacagaaaaattaaaatatacaagcaaattgtttacagtgcccacatttgcatatcaacactgttagaacttgagactgcagctatgctgggaaaaatgggtactgtttgaaggtaaacctatgttgataataactttgtaaataaattttaaggcttgtgtgaatcagctcacaaaatgctaaccttgtctagatgagcacagctctatagcaataccgtgtaagccataaatataattgtactttcctagtacccatatttttaaaaacatgttactatatataaaatattatttgaacgtatgttaaaattttcaaaaatgtataaattataagacttttatcttcatttcttctacttcctgtaaacatacagcattagaaatacttttttggtaattagttgtcatggaagttgcaattgcaaaagtagatatacatatccacgttttttccaaacacacttgaaagtttcccagtaatagaataaagtagtggtttttaaatgtattaaaattaagtgagttttaaaattctgttccttggtctctctggcttcatgtgttcaccttccaaggcagaggctgccccagaggtgtaccaggatggtatgaggcctctgctggcccctaggtggcactcagccctcgggagcacctgacccactgatggttttcaggtcaaatgtaaataaaatggacctggaaatataaaagtggaaaatactttgctaccttaagtatgatctcagggaattaaaataacctctcgacagcattatgggaaaatagaaggtagagatatgaaaacctgatagtaactgcgagaacaggtggtcccaggcccacagagtaagatgacggcataaggtctttgcataaaccagtggtttttcaccaaaaaacagctttaaattatcatgtctaaagctatgaaattaacacttcagaaggaaacaatttgagactggcacactccaaccttctgtttcaaatttctgaagttttactgaaatatcttatgcattgaagctcacattaaaggtcctttaaaatgttgtgacaaatgagactgttctttttctgttttttgaatctaagaagtatgtatagccaaaagttaaagcttttaacttttatgttgggctttcttacttgacatataattctatatagtaacatctgtatgtgataacatatacatacaagtcattttttgtataaacattaaacggaatcaatgtaatgtctctacttgttttcaaaatacataaaggaataaagtgataactgtattaaaacttaatcttattacattgtaaaacactgattttctagagctgcctcataaacacacctaacatgcattaaaaaaatgttttgcaaatgacaaggcaaaggcttataaaggttaagtgacgttttgatgacatagatgctggtgaatgtgcctgttagggcttgatcaggtttaccaattgcaaatgcattcaactatagcaaggtgaattcatgttctcttgagatgtgattagcctttgttataaacactttccctgggttgtagcacattgtagcatccaagggaaaacattcttttattaatccaagagtatttttaattatgtaaactttaaagttatacaatattgctcaaatacgatttcaaaataacttctgaagtcacgttttgatcaatagtgattttttgtgaaaataaacagaaacataaaatcttacaactgcatgcaaaggtgaatataatccatgtgaacctgtcattttacagatagaactgatgaagctcaggaacactggagcacgcccaagggtcaagatcataacacagatcttctggccactggacaagagggctctcttcttcattttctcggactcattagcacatcaacatcccaaggatgtcctcttctccaagcaaggtcctattgccagaggacggaatggtgccatttttgcttatttaatttagtatgacatcgttatctccctctaagctttgcgtttgtaaagcaactaatgtgtaatgtgtttttctatgcagcaccataaaattatcttaaatgaattgatcttagaagattacagtcagggagaaaggtagttagtatattgtatgcattcaccttttcagttttatttatttgaataccagttaggaactgagttggctgtgacagcatcctaacaactcatttataatcggaacaattttaattacttgtagcaatagtatgtttaaatggtagtattttgagagctttttatagtaattacacttcataatggagtcgggtatatatcagattcaacaagcatcattcagaatctgacaaacgttcattttctaaagatcataattatattttacattaatggttgaacttaccacagttcattgctgtataaacattttaatgtcaaatctgaccctacacttttcagtctcatatattcttactatttctactgcacattagtcattctgcctgcattgtatccctttgattatattttcatttaaaaaaaatgcctgatagttagaaacagactgtttttaaggtcaacatcctgttttttagcagactttagaaattactaccagtaatcatggataaaaacactcaattgttggttttgtgaaggtacgttgagagtcttttttacaacatttaaaaattatatatgaatatgatttttctaaatttaaagtatccactatccttttgcaaacagtttagatgaagacttttaatgcacattttccatctgtgacatttgattttgtttattgatttgtagcttcagttctccttcactgctgccctgtataaatgcgaacatctttgccatctgaaaagggtatgtgtgccatgaagtgaattaattctaagaacacattcttttcatctgggtacaggatttccaaatgcaaattatctcttgcatttttactcccactttgtaccaatatattttgcttttgtccaatcattttatagaactaaggacaatcattttatagaactcaagttatatatgtcgtatagttaaaagtcttcaacatgtaatttaggaaacccaggtccttggggacacgaaactttcccaagaaatgtgggtagagatggacaaaacccaacagacacacctcagttttccacattcacttaggtttttgagaagcacacactttttattctttttaactcctcaaggaatgcatgagtgttttatcatattaaaattctggacatgaaccaaaaggagaataaaaaaaaaaatccgctttacccacctataaaatcctactctgccccagaagcatggctaacagtttcatgtgctgacctccaggtctttctccatgtcttatacatacattttcatcctagaatgtttgcaaatctggacacaccattattaacaataagtttggccaggggtggtggctcacacttgtaatcgtagcactttgggaggccgaggaaggtgaatcacttgaggtcaggaattcgaaaccaggctggccatcattgtgaaacctggtctctactaaaaatacaaaaattagctaggcatggtggctcacacctgtaatcctagcattttgggaggccgagaagggtggatcacctgaggtcaggagttccagactaggctggccaacatggtgaaaccctatctctactaaaaatacaaaaattagctgggcgtggtggcacgtgcctgtaatgttagctgctcgcgaggctgagacacaagaattgcttgaacccaggaggcggaggttgccgtgagccgagatcctgccaatgcactccagcctgggggacaagagagaaactacaaccccccccacccaccctccccaaaaagagaaaggttgttcttcaggagagacaaacactgcgggagggtacctccactccgtgttccctccccgtcaccatgtggctttctgtttccacatgttgcttttgcgcaccatgccttcccatatggtataggttcttgcgcgacacacttgcatatgccagccccaacgtttattgggcagtctaagcaaaatatttacattctcgtcaggcaaagatggtaaaactcacagcaactgttctccaagggtggactcaggactcctggaggatccccacaacactcttgacagatataaaacactaaaatttggatttctacgactcccaggagggtaactccatgtgtcagatgatagccttcttctaaccacttgcctggctctttccaaaaaccacacatattttacaaacttcaatatatgtggccgtgttcaaaaacaaaacaaaacaaagaaacaaaaacaaaaaaaaactagtttaaaaaacacttttctgtctcctcctttcctgaattcagtttcaggatgcaccagttaattacctgtaagaccttgggcaaagtaacctcacctcacctcgcctcaccatgcctcggttcctttatttgtaaaatggggataataatggtgtccacaccataaaactgttgtaagcataacacaatagtcagaatgatgcctagtgtgtaggaaagttttgctattattatgaatgctaatgagaaaagtccttttaacttacagatattttggttgtccacaagttttactccatgaattttatgtttttgtatgtcaaggagtgtgttaaaattcaaactgcttgtatacaatccggtttcatcatacagcaggccgactgtagccttaaatgccatttcgttcttgcttaaataatcaaattactctctgaagccatgtgcagtcctttactttatatttcatttagaactcccatctgaaactgcagcctttctattctagagggaaatgaatttgtggccatgaatcttgaaccacatttctcataagaaacacctagacaagggtattagttcagaattatgaaataatacagaaaaaaagtgggcttttccaaatataaagaggatgaagacagatctcttgttttcggatatcagggctttctctccatggatgagggcaggtttcgctaatgctgattttggaccaggcagctgggaaatttgatttcctgagcattgccctaaatggaatagcacagatggttggtctttgcttttcttgaatggcagtggtgtaggaagaatggagctttccagaactagtaaaacagtcagggccacaggcttctcatcctgttaggaacttcagaggtcaaaatagctttgttaagacatgcaggctctgcttcttctccaggtgtccctctaatttcacagaagatcatgtgtccttggctattttaatcaggaacaaaatctacttgtggtctcttccagcctggaaagtaatccaactgaagtattttaaataccatctgcacaaaccttttaagtggctatgatatatccgcaatgctataattacacgtatgcagtgagtcacctttacctctgacagcaagcaggtttgtaaaaagctctctctgccttggcttagtggaatttgtagttacatccctaagtccgaaatacagctggagaaatacacattattctttatgtgaccgttcacgttaacgatatgcgcacataacgtttttacgttctttctggtaccataaacaaaagtcaagaggagctccagttttcttttctcccgactgcaaactctgtaattccttcttgccaagctccattgcgtctctccgccatgctctccatgtctcacttgcttctacttagtgctatctgtcctcaggggccgttgttcttgtcactttggaacattcttttatttttaaaaaacaacgtttttccttctatgttagttcaaaactacagtccttcaccaagggcttcagttaacatgagacagagaaaaatcatggagagtatgtttagtcggttgcaatatgaattacccattgtgcctcttcattttaataagacggttgtggcacaggaaggaagacactcttctgagataatatggtctcatcattaagaacatgggcatgatcacgaggacacccaaaaccagcacctgatagcctcatctattaggtttgggaacaccacttgacctcgaagaaaggtttatcctccaagaaaggggatagcaatcatactgattttgtagggccacagtggaaatcaaacaagagaatgtatgcagctcacacggtagactccccagcatctgatgcttgataaatattagttttctttcccatcgcctgtttggctgagaatgtttcctagaaaaccaaaagttgatctttcagttgctgttgctgtttgttattaggagatgtgcactaattacacttgaggccacttcattccattgtggccaaggagttgattcaaatgaatcagttttgttattggataggagtcaataacaattccatagaggcagctgaaggaggctgacatccacgccaagtaaagaaaaagggctaagtttcacttgaaaaataagaaacttcatttagagaatgattgtacactaaggcttagtaacttgagagaacaaaaaagagtttcaatctacttcacacaaaacaaacaagggttcttcaacacctagtctgttaatgtggaactatgtggacagattctgtgtaatttagaactaaacagtttaattttactcacatagctaattagatatcttgcctctatttcctggcaagttctaaaagattccccctcacattccttgaatataattagtatttttgtgtaactctttattttcagataaatcaagcacatctggagaagttactttaatgatactttttaagaaagcacacaatctagaggaacaatgtaatggaacaacatcccatgatttccaccagaaggtttctttctaactaccctttcttacgtccaatattgagtaatattagaaatgacaagcccaggaaacttactttacattctaagacttaatatttacaccacacatgttgcagcttcccattatcgttatagataacaaagacgggggactaatgtctgcaagcttttattaccttccagggaccaggttaagtactttacataaccttaattaaatgctggctgcagtctcgtcataggtggtattattattattattattattattattactactactttgtaagtgtatgaaagagagggttagcaagttacacaacatcacacaaatagccactgaaagtggacccggtcggttgagcgagttggactcatactatctctcctccaacctctctgtggcccactgaatgcatttagtgggagaagtgcctcccctgttcctaggtgaaaacaagggcagtctcaggacatcccaggttgctcttaagccatcacatatctatggtcatgtttagttgcaaaacttttctccagatagcaaatcccaagacaatatgataataaaattaaggtttgatttaaagttaaacttctgccttttttagctgcaaccatcaaaagacagaaagctaaaacaaggaggatataaaacttctttacttttactgagccttagttttacttattttgctagccatgctttctgttcctgcagcattaaagtttgactgagaaaagaaaacactagagagtagaacacttttcttttttactggtactgcagtggatggattcgtccactcagggcctggcagtgctgggtgccttcatgagtttctgacatgcccccactgggaacagtaagctccctttcctaaggtactatttttggggccaccctgaagggctcccttcacccttcaattttcttaagcaaaccttaatgattccagagaggctatcttacaagaatgacctacaaatatctcaggcttgttcacacaaactcaggaaattcaattcaatgctgtagccatttctcctgtactgctgacgatgaggctatgggtaatcccactctgcctttaggtttacccagtagtagcagataccacatcctgtccttatgacttgtccttctaagtgaatggatgcaagttcagctctacgcatgcagctggagttcctgccactgggttcaaggtgaaggatgttgccaccaactctgccgccctccccaataaaattccttttcaacatttgtaacctcgttgtagagtcttctagtggatttttaagcaaatctatgattccaagatctctcagatggtcaacctcccaactctaagatctgatacctgtcaggtctacgtagcagccaacattgagcaaaatcaagtcccattacgtcagtaaagcactaatataggataccagtatgctatgaattattttaagagtaaatattagttacttaacaactacttttaaagtcctcattccatatataacattaaattacactaatagtgtggcagctgtaaaaatggtgatacgtgcataaaaataatttaaaaacacagcaccatctttcaagctatctgttcaagcaatgactgtcataatgagcataaaaacagtgcacatatggatgaaaataaaattatatttggtgtaacagcaaaagaaaaattttacaaaatgaattaactagttacagttcttctaacacccgttctaagacagtgtatattatataacagtttatcggacaaatactctttaccagtttctagatacctgtcggtcatttctcatattgttattcaactgttttccctggaagcctctttaggctaatttgcctacataatttcacccattatatatgagattgctatcacgtaactcccatacatttaaaatacatttaacttttcttataggtaagatagattaacatcgatcaattagttaaagtagagggagccagggcctgtgtttctcctattttttgcacaaacactctaaatgactccatcaagtccagtagtagccagatttggaccacataaactgagttctgtccactgtcagtatgagcaagatgtaacactttcagatctgacacgtgtctcccactcagaattcatcacattttgtccaggtctggcagtgacgatggtgccgtggatgatggtggggatctgctggacggagtagagcagctgtccatggtcctgagtaacatgtgctcaagacatgagcaaaactttcagctttgctttcttcagctactgagattttgctactgggtaatgcattgtgaataaaacatctccaccgtactggaagcaccatagttaaaaggaggtatccacctttgtctgccatgtgttcacaaactaatctaatgtctggctcagagtagatattcaaagtgtatttgctacaaacaagaaatgaaaacaggaatgaatcaaatggtacctctgagtgcaagtgagtaattagaatcattattgacctcttcttgagaggagactcattatttcattcagcttgtatatttaaggaatgtgttatgtgctaagcactctgtgcactgcaactgttaaggtttaaccagaaccaacaactgcaaattcagcacggtcttttttatagtggcatacagatgtgcaacaaaaccaaacggaatcaaatacaaacaggcagggagtggtgaggaaatgcttcccaggtaaagcagagttgcgtggacttttgaaagaatcagtcaaaggaaacacacttgtatgtgtgtctgcaaaaacccatgtgtttaggcccgagggtgatgtttgttagaagaaaagcatggttttcacatatgtctacagatgtgaaatttcagatggtcgtgtttgaatttctacacagtaatgctctatgacatctgaatggagggagagaagcccaaagacgtaggaagtggtaaacacagatcagaaaggtctctaacatgagatttgaacttccatgctgttctatgggcaattttaaacaagggtcagggacactgcatctttcatagcatgagaaaaaaaggacagatgatgtttctctgagttatgggggaaaacaaagatgaagaagggccattcatagcttttctgtctcccatgcttcatacaatttaccaaggacaggtagatgctgtatttaggaaagattccttgtgagaagtatattcataattatgatccaggtttaagtagcagcttcaactacaaaataatgagcatatgacattgataatgttcattaactttatctccctatctgtagtttcatttaggatttctattctgtaagtctgattttttggtaagcttttactttcaagaaatcacaatttgtaattaaaataattcaaagcaaaatgaaaatatccatctgtttcttgtgactcatcatcctttacaatgtcagctctctgtaattccgccagttcacaacttcaactcaactgctttaattcatttctttctaaaatttagaggggcaaaatttcatctccctaaattgtatttgttaaatgtatatgtaatgatgtcaaaataagatcttctttgtaccctagtgtaaaatattatgggaataataatggaatttcctgttttattttgtgtaatacaaacacaacttctaaatgtttctatgacaggaatctgagtcttaatatggtttggggattatctatattctctttagtgttgcataattatacattattggtattttaattttaaaaacaaaaataatatgcttatgatatgtgcaaatattaagtaataaagaaaatattcaaaaggataaatatggattaaaagtcaagatatttaaaagctagggataatgatcataatactttcctttaaattgataaattacatataaaaacaaaatacaaatttatacttacaaccatgtaaagtaaatctccataattaaaatacaacctccaaagcatggtagaatttgaattaactaagagagaagtatttttcttttttatctactaattcccagtgattctgacatttcacttgttttcggaaagtacattttgatttacacataaaaaaattgcttagtgtagaaattttattaaagctgaagcgtaatatttaatttctgtggtcatttttcttgtgatatgtttctttcttaaattatagccgcaatatggagaacatttcctaccagaaagatacaaaattctttattcaacgggtggtaaaattcataaacccagtctaatcagttatatgcggagacaaaagttaaagaatattaggctaactagctacttttaagagctaatataagacaagtaatatctggttctgaaatgtcatgtaaaccatatggcctttgcaaaataattaactcatgtgaaattagaagtttcctttcaggtggacaatttgtttttcacatcaagcaggaacagaaccttctgccctatgtgaaaaagcaggcagggagcctggtgtccagaaggaatttctttcatcagagtttgagacgccagagtgagtttgttgcatagatccattattacctagttactttaataatggaggtttggacacttgatcattcaatgaaaacaccaaggagatataccagggaacaggaacaatgaagaccctggccataccaacaacaaagaaatatgaaaatgacccaggtgagcccggtcatagatttcagaagggatggacttatttatttgtatatgctgctttttcttactttccaaagaattttgttgtcgtcgttgttgttgttgtttagttttgttttgagacagagtctcgctctgtcgcccaggctggagtgcagtgtcgcgacctgggctcactgcaacctctgcctccggggttcacgcctttctcctgcctcagcctccagagtacctgggactacaggtgcccgccaccacgcccggctaattttttgtgtttttaatacagacggaatttcaccgtgttagtcagaatggtctcgatctgctgacctcgtaatctgcctgccttggcctccccgagtgctgggattacagcccaggcgtgagccaccgtgcccgcccgaattttttaactgaatggaatttataacaacccactataagattaatacatgtaaacatgttgatattttctgtgcctcagtcttgcatcatcaacatgtttctatacatgaaaatattcattagaaaaaatgattcagtttattttttctatgttatagtcttaatattaggcctctagtatcttcatcattgttcaaactgaatattaaacacaatcttcagtagtcccaaccatgtatcttattacataaaagatttacctaagagtcagggtccctaagaatagagatggaatatttaatgggttaatttaaaaggctttttgtaaagagataatttgttagttctgcaaattcatggatagtattaacagaaaccaacaagggacccacaaagcactccagaggcaaaagacgtgaacagtctcttttcttcaggtgcagaggggcaagggagggaaagtgtggttatggcttgagaaggggctattccaccagagctgcgtctggagtagaaccatgcactgcacatgcggaaacagcaggagggggctaccagcatcgccctctcagttttgtcccgcacctgccctttgtccagtatactctgaggactgaacctccctggcacagagagaggaagagagcccaatgatgccgtcctcaaggccagactccaagggcacagagtcgtggagagacacaacaaggaagcttgaagcagcaaatgaaaattggccagcacaatgagaaactgacgatgctgaaattacttgtgcaaatattaatatcttactagtaagtccaatctaaatttattgagcaactcttaagctcctgcattattaaccaaagctacggctaaaaagtgttttaaaaaaattaattacactaatatgtgaaaattattatttatatatctagctcagtatgcgtttctttttatacttactttaaaagaacactaaccatgaaatagacttgtcacccctgtgccttatcttccaaattaggcacaataaaagagctcatctcatcatgaactaagcaatactgcaatcgtgtattttgactgtaagacacagcagtctcttataaaccaccaataaataataacaatcatatctcattacttagaattgcattccatactttaaaaaagatgctttagacatattaaagcacagatatttttgtcttatatcagtttggtacaaataaaacaaggaacattgaagcaaaatgaacatgcatttctaagccattttaacattcagtgtccaaagctgttctactagtttttgactcagtggtgagaccagatttaaggtttgatagagggatgtcctattagtgtctactgtagagctttccacacttttaaacactttctacaagttctaaagctggtgctttttgaacttaccaaatagtgtgtataaaaagttttaggataagaatcaggacttctgttctttattgcgtggttctcaagtgactattgcaccgaaatactgcgaagttgaagttctatattcctgtcactggaaaaagtaatgtggcaatgacactgacgtctgattaaccccgaccagcagccactgtaagatgccatcagcagcaactacaccccaatttcagggacaccaaaatgcgggagaaactgaacatctctgaattgatagcatatagatcgtgtgacaaacaatcacctatgaataaaggcttcggtgcttcatatccttttaataaataatacgtgcactgacggttttcaaaataaacccaagattctagagacagtattccagagagtgcaagatgtcaccgttctttctgattgtacttgaatagctaatgtttatcagacacttcaattaacatcgcaggcaatgataatgatctaaatcactgatctctgttgtttcatttaacctcaggataatgccatgagttcctccactttgcagatgagcaaacacaaatcacttgtccatggtgccatgttagagaatgaagtgaaaccagaaaccaggtctaaggactacagaccctgaacattccagaacaacttgatagaaagttatattcatgtttcttggtattttacattttaaaaatattctaagatgaccatctattttagcttctcttctcatataatctatttttttcttactgtaattagatgactttctaaatttatttgtaataatcatgggtaaaataaaaacctggaaaaaagtgcttacttttcaacccatgtgtaattagtaactttcctaaaataattccagaaaactttgtctttgcccttttagtagctgtcaatgtgtatggaacgaaagcctcaggtaaccatgtggtcctattctctcttctttcaggtaaagtgccaaggatatttttcttatattttgccaagtcacctgatctgaacccaatctaaggtgttaagattatatatacatataatatatgtatatattatacacatataatcttaagattacacacatataatcttaagattacacacatataatcttaagattacacacatataatcttaagattatataatcttaagattacgcacatataatcttaagattatataatcttaagattatgcacatataatcttaagattttctatataatcttaagattatatgcacatataatcttaagattttctatataatcttaagattatatgcacatataatcttaagattatctatataatcttaagattatgcacatataatcttaagattatgcacatataaccttaagattatatatgtatcttattatacacatataatcttaagattatataatcttattatacacatataatcttaagatatatataatcttattatacacatataatcttattatacacatataatcttaagattaaatatatcttatacacatataatcttatatatattacatatattataaatatataatcttaagattatatgtcatctttttaagggcttattaagggcttaagattatatataatcctaagattatatatatataaacatatattcataatatataaaaatataatcttaagattacatatgttatattatacatgttatatatgttatatattgtgttaaaattatatatatctgtgtgtgtgtatatgtgtgtgtgtatatatatatatatatatatatatatatatatatatacacacacacatcttgagagaaaatttaaagttaattctcccttatgcaaatttcagatttcttcaaccattatcccaaacaagtacaatgctcttgtcttttctccattgcctgcttcactaattactcccatctcaggaacacagcatgtcccagactcactctgtagaacattttcctgaaaaaaacaaacaaaaacaaaaacctaaagactttatctccaacaacatcttaaaaatgaaactgtctaattgcaaaaaagactgaaggagcccttaaaatgatgtgctctctgttgtttttctctttgcaaggagagaaatcttaatcaaaaccacaataagaagcgaaaatggaaggtgtggtcaaactatgctcagggtctccctcctggcaccttagtcctcaactcatctccagctgggtccagcttaaaaccttgatcagtgattagagctggaggagtttatagcaccagaattcagaagtgcccaaggcaggaagaattatttcgtccctgtggttataaattctatagttcagggattatgcactataaactcatgtatatttcaggaccacatccattatttctaaacataataatgatttaaaataaagggttatcacaagagtgtgagatagcatggcatttggactcatggccagaggtaaaatatttaaatattttaaataattaatatcttttcccaaagagagggtttatctatttctgatgttaagcattattcactactcataattcagaggatggatgtatttctacatgcaaaaggcaggtacatttacttcatattttataatagtttgttatttagttaatattcactattaactcgtatgtggaggtccctaggcttgggtccctgaaaacacgaaaataagggtttttttttttttttttttctccagggcttacactctattgggtatatttctactgtataatgatttctaaataatagctttatgctggtgaaaatgaatagaaaatgtgattattgtattcatctgaagatatctgtggagggcctgctatctcccagacttgtcttagactcccaatttttttaaaaatgctcatctcatggagattatattcctgtgcatgagtgatggacaatggtacacaaatgtgaaaatataaaaacctgtaagtcagatgacaatagtgcaaagaagtacaaagacaggaataggaagtgctgggaaagagtaatgctacatttttacgccaataaaaatggtcggatgggttagataggttgaagagcttggggagactctagagcatcgtaggtgtaatacgttttaatcttaattggcataaaaatataaaacacataaaatagtcatgaatatacttttacaatctagaaatgtatttttttaaatccctggagaaactggggaccaaacatttagaaataattaaatatagagcttgaaatttaccaaggctatatgaagaaacagccttgtatcttacataagatactgagagaaaacctgtttaatccaaatctaaaaaaacaaaacaaaacaaaagataaaagatgcagacgttcagcgtactgtaattcatttttattgactaagaagtgaatgttaaacggtattaaggaaaaacagacatcagttgctgggcgtccgcaagctaatactttattcagttaaccaaagttacattcaggccatttttgcttctatagctgttaaacccctcacatatgatcaatttataatgctaaatgttgttattttaattttagatgtttaaaattcctgtaaggctaagatagcctgaaattgaacttgacctttcaaaagttcacactagggtttggattttgactactttctgctactgttttagcattaacccggagccatcggtgatcgcctctgtgttggaagatcattcaatggcaccactaacgattaagaaccaacatcctgtgagaggtgatacatttcaaaaggattttcagtgaattatataattaaatttgatttctgaatatgccattatataaacattgctggtggtcctgcactttaaaacaagaaaatttatcgaatgttttaaaagtatataatcagaaaggtttttattagcaaaggaaaataaaaggctaggtgacggattacctgaagagtgaatatggtgaagaggtgctaaaatgtagcaaacgcttgtttcccttcaataaattgattttatattgaactcaagcatcactaccagtacatgctagcgtctctctggtgaaaacccagggtataaaggacctggagaacatcccagggcactggggacatattcaaaaatggtatagaagaaaagtttagaaaaacataattttgaggaatctgccttagttaaatgaagtttccaaaataatgccaatctttgcttcctgtttctgcaattaaaactaaaaacacatacattaaaaggtaagaagttacaataataatgtttgattcctttactgttattctcagttgtcctttcattcaaaaacgctccatgacatcagtttactgtaatagtttttatttactgtatttgctttgaatccaagaataccatactagacactagactgttatacaaagttgtgaataattccctatacaggaaattacttagtgagtacaatgtatattatttgagtaatggataccttaaaagccctgacttgacctatatacaatgtacacatgtagcaaaattgtacttgtacccaatgaatttatgtaaatttacaaatattgatacacatatttaatgttaaccatatgcaaacgttatagaacatcacaatttagttttaatacagttctaagaagttatttcattttcatttacatcttcaggctactctgatactaaatcaagtattttcttccaactagatgttaagaaattaatgttaaagtgatatttgtgcttttgaataaatttattttgaagaatgtgtttgtaaaatacatgtaccctagaacttaaagtataataaaaaattatttctggaaatactggtataattctttaattagacttaaatgagtaaattttacatcatatatatgtatatatacacacataaatacataaacacacaatacatatatatgtcatatataatagaacaatgaaagtgttgctttgcagatctactgatgttaaatttgccatttaaaaagcagaataaaagaactgtaggaaataaatattctcctgttaatcctatttcttacttatgataatataaggagggaagaaggtgatagaatacagaaaacattaaaagatcttgccaaaacagatcgtgcttttcttcaaaaaagaaacgttgtaagaaatttataggagaaaatatacttttgccaggtaatgtaagtcatcagaataaaataagacactgtaaatatttaaatttaaaaccgtcggataagataaagtttttcttcacccccatcacccccagagaacgcactttttaaataattacttccaagagggggtttttacttgacatattgtaagtgtctgaagtgattgtagataaccagtcgtctcaacatgagagaggtgattttcaggattcctacagtctttcaaaaagccactagtaattggttctttaattcaacagatacttactcaatagccatcatgtggtagacaccttgtaagtgctgagtatattgcaaagaaaaatcagtttctagcttctcataaaatttaaagtctacattcagaaatatgccccatattggccaatatttttgtatcatatcatatatcatacactatctttcttttctttctttgagatggagtctcattctgtcgccaggctggatgcagtggcgatcttggctcactgcaacccctgactccccatttcaagcgattgtcatgcctcagcctcccgagtagctgagattacaggtacgtgccaccacgcccgcctaatttttgtatttttagtacagatgggttttcaccttcttggccaggatggtctcgatctcctgacttcatgatctgcccacctcagcctcccaaactgctaggattacaggtataagccactgcgcccggcccagacactatttttcaagttataaatactatttgttgataatagctattagaatttctgtcctttgtagaaagcataaatctacaagtttgtataaagaggccacaaagagtgagaggaagaacttctcatacatgtcagaacatctggatttaggatttgatttgcccatttgctaattaggtaacatcagctgagtgcttttgactgcatagttatctttcataaaaacaacaacaaaacagacaatttcctttttgcctatctcacagaaggtgtgtaatgttcagttttgataatgtataaagtcgtttgtaaacacagagctttctgcatctaacatattttcctacacttgggcacagatggggaaatatgaggggacctcaaaaagtttgtggaaaaataatattaaaaggtaaaaataaaatatataaactttatttctcaatatatgctccatcaacctcaagacacttttgtaagcgatgatgccaggcattcagtccatccctaaagaactgagtgtccttggaatttaactacataaatacagtcttcttaacgttattaactgaaggaaatgtcctttacagacttttttttacattttattattattatgctttaagttttagggtacatgtgcacaacgtgcgggtttgtttcatatgtatacatgtgccatgctggtgtgctgcacccattaactcgtcatttagcattaggtatatctcctaatgctatctctccacactctcccaaccccacaacagtccccggagtgtgatgttccccttcctgcgtccacgtgttctggttgttcaattcctccctatgggtgagaacatgcagtgtttggttttttgtcctggcaatagtttgctgagaatgatggtttccagtttcatccatgtccctacaaaggacatgaactcatcattttttatggctacatagtattccatggtgtatatgtgccacattttcttaatccagactatcgttgttggacatttaggttggttccaagtctttactattgtaaatagtgcactataaacataagtgtgcatgtgtctttatagcagcatgataagattaggaaacaaaaagaagtcagaaggagccaaatcaggactgtaaagtggatgcctaatgagttcccattgaaactcttgcaaaattgcccgtgtttgaggagaggaatgagcaggagcattgttgtgatggaaaagaacgctctggggcagctctcctgggtagtggtctgctaaacttttggctagtttgtcaaaacaatctcataataagccaacatcatcattctttggccctccacaaagtcaacaagcaaaatgccttgagcatcccaaaataccagtgccatgacctttatactcaactgttatgcttttgctttgactgtaccacttccagcccttggtagccaatgctttgattctgttgtgtctccaggatggtactgggaaagatatgttttatctcctgtaacaactcttcagagaccagagtggtccaggatcttgatgccacttgcataagatctctattgaaagctctactcttgtttgaagctgatctgggtgcaatgttttggaattcaccaagtggaaagtctgctcaattattatttttttgtcaagattgtataagctgaaccagtcatcatgtctgtggcactggctgttttctgctgttaactttcaggcctcttcaattagggcatggaccagattattatttttcttgcaaattgatgtgcatagtctgttgctgtgggtttcatcttcactatcatgtcctgcctccttaaacctagttatctaattgtaaactcttgattttgccaggggggttcattgtccccataaacttttcagaaagcatcggtgatttcaccattcttctgcccaagcttcaccataaatttgttgttctcacttcaagtttattagaatttatgttgctttgataggggctcttttcaaactaatgccttatccttcttagtgcctcaaactagatcctgttcagatatgttagaacaagttaatatgagtttattttggtacaaatattttttgaaatccctaattttttcattagaattttccacaaactttatgaagaccccttgtatagttcatcatgttcattatgtagaagcaagctatcttgctaacaaaaaaacagtttatggacttaaggccaattgccaggtggaacttgaggggtacctaataaaaaacaaagctttaaatagatgcaatgaaggcccaaaagaaaaatgtagtgttttaggtgatggtctgggaaaataggtaagagatatccttggaatggttttccttaactcattagctaataactgtaaaaataataacaataatagtgattcatagtgataatgtatcaaggggttatactattcaggcactagttgaaaacctttatatatgtgattactttcatcccatagtgaaggtggttttatcacacatatcgtgcagacaaaacagcagtctgtgaaaatgtaagctacttgaccacagtagcgtgcttgcatgtaggaagtcagattaagagaccgtcttgaaagtcaggtttccgcctctctctcaaccctatacgataatgcaccgtaaggggattctctcctatgttgttgtgtttttctctgacacaaaggtcaaaactaatagctgattaatgttcaaaagcattcatctctactaaactggtgtgtatgtgccgtgttttcaacactcttttcttctcattaagtcatttagttttttactgaccccaactgagtccaggtagagttggcaccgtcagcccctctacaagccagagagtgaagtcacagggtcctagtgaccctgtgttttccaggactagcaggcaggaccagcagtttaaatgttggcctccatgctgattcatattaactcaaaagacagattttttttttctggaaaatgctgcttccctttatgcatgaaactgtgaccagaagttcagccctctgtatatcaaatagacacaaaatccaagaaaatcaggaatggcacttttgtgtttagggaaaacacatacaaggaagtaggtataaaaatgattttacacagacaatttttgagtaatttaaaaggaattaaaataaggacattatgattttctctaggaactaaaacttccctcaaacatataatagggcatgaatattgtgggcttgcaactgagaataacatctgttaacagaggcatcatctatttcagataagtattctctactctcatgaaatataaaagaaaacaaaacaaaaataattatttttacttagttataacctggcactgacaaatgtattaaaggaagcaaaaattagcatcttccatcaccaaaatcttcaaataatttattaattttttattcattgtctcatttatatattgggcaggaagctgttttttttttttttttttttttttttttttttttgagttctctgtgctgagctcatgttgattttcaatctccttaccatctctagcacgtctatattcaaagattctgtaaaaggaaaataaattttaaaaaatttcttctcagcagcgttggtgactgtgtggcaccttctggacattgtcatatgaagagagttctaccagaggtgactgggaagtttttcacttttttattttttatttatttttttgagatgtagtcttgctctcttgcccagactggagctcactgtcattatcttggctcaccccaacctcagcctcctggtttcaagcgattctcctgcctcagcctcctgagtagctgggactacaggcacactccactctccccggctaattgttgtagtttttagtagagacagggtttcactatgttgcccaggctggtctcgaactcctgaccttgtgatctgcctgcctcagcctctcagtacttttctaaagaaaggataagctccagctgccacttttccctcttccttttgcctcctcctgcctagaacctgaacatgatgtctaggaagcgtccataaaagaaccaagaaagcagtgatgagagaaccaggggatcacaaagcctcgatgaaacccttgaaataccattgtgttgtcttataaaattaaccactgttatttaggctactatttgaattttcaaataaaacaattagaaggacataaaccaattcaaatttgggagaataagccagttttgatgaaaagagatttaaagctgttttattctaaatgtgaagggctttgcaggcaaagtcaaggattttatattttattaacgggtaacatgttcaatatagaatatatagaagatatttattttgtatgtcaaactgatgtcttagatacattccatttgattatcaaagtgagctcatgttgtaaatagagaaattattaccatctaagagcgacagaaggtgaatttaagttccaaaagttaagtgacttgctggaagtcacccagatagtacagagtcccatcctgacacaaacgtaagccttactgtttcagtgtcaggactgggccacctgctagctcatcgtgataatcaattgggatgtgtttaaaattgctttgaaatgtcaaatcctctttaatatttcctcattttatacagatcagattcccctcactgctactcatacccaaataatgcacctatcagcaaggaaacatctccagtttgaagatgatgcccctccctacaaggagagccaactaaatcacttggtaaaagaaaagaccaaaaaataaatatacattacaataaattagtaacttcatcctaagccataccttggtgcaggtcattcagaaaaccactgaacttttgtcttgagaccctatttcaccttaatcatttcacaaaatatactcttaatctatcaaaatatatattaaggtgtaacgatgagatgatgaacaagtactcttttatcaggctgtggtatttgctacactaacgtctggatggtaatgccaatgcctgttcttacaggacccactacaaacacacagttccccacgttagagtcccttttcaacacaggcacctattcgttttagggcacagaatcacaacaggttccatgcctcctggataaaatttcaaaaataatattgcggatacatgcattggtatctattttgaaagatagtttttaacccaattacatcaagtaacttcacaaacacactccccaacagagaaggatgaagtgccagcaaactttgaggcttagctaaatcggccatttccaatgcctgggaactgagctgcatcagcctcccgctaggagagagtcaggccgccacaaagccaggcagcaagagaagtgagacccgaactggaatctaaggggcttgcagggatagagcaagagatttgctgagggttccatcagcttaagtgaaagggataatcgactaaaagtaaggtaagccactgagcagctggaatcactgtaaaattaatgtgcttttacaggcactgctttccctgagggcagagcggtgtcacagaacaacttcccagtattgctgttctctctggaataacaggaaagaatgaaaaagagtaaaaaattaacctttcaatacagaatccacgtaagaccgttttagctgaaggactcaaaaaggcataacatcctcaaccagcagagagtaagtgcttgctcaaaatgtgtcctcctgcaaagatggaatgatctcttgcatgtacagatgccacaccagccgtagacactactgatctgtattttaaatttcacttcacaaaagtgatttgggatttcaaaagcaggaaaacaacctctcatactgtaacttgccgatcttgtatggatccccttccagtctttgcttacgtgtgtatatgcaattgttctcaagcatcagaatgtttaccattctataacctttatttaataaactgtattgcagggtaactttcatactgatacatagtgtgcccagacattaccttaatggttgtgcaatattatactcggtgcatttgctgtaattatattaagtatgcacattactggacattttgatttatgattgtgagaaatgttataatgaatcttcttttgctttttaaatagttggtaatgaatagtctgtgtagatttttagaagaaagagtactggtttaaaacacgctgaagttgtctgcattaaaacgctagtgtgctcttcagaaaagttcttccaaaatatcacgacactaacaatacgtggtggcacaagttgtagaatggcccttcctgaatagacactaaataatatataacagcccagctcgatccttccatcatcaccatttttactcctttatgtgactaatcaatgagcctcactctgataatgctggattaaaaaacctacagaacaaaaaaatacagtatcatcgtgaaagttcaattgataaaaaatattttatcacctccatattgtgaatgcctcagcagggtgtaagatctcatttctagaaccactgatatccactgctcatcttgaagacaaaattttcttccttatgcaaaaaaacagctccctgcccatggtgtattaagcatcctgatgctttccttcttggcctcttcaatctcattcacacatctggatgtatccattgtcgatcacatgtaggtgattgtacaattcacatgctctcctcttccaaaacgtcctcatatagtgagcagcacctctaaatgagtgcccgaccgcagcagggtagtgttctggtgcgagtccacagatcagcccttctttcttccattctccatagcaccaatcaatccctaacatctccagatttaaaaaaaatctaataatttttcaatctctttttgcaaaatctgcagttatgctttccttacgctaaaaatatacttcaaaatcctcagtgtgggattcagtatctgtcgatcctacccccaagcatctctcagatcgactgtcttttcccatctgtcaccgccctggttcagcccctcttcgtcgcctgcaccatgtccactgtggggtttatggtatcctcatcacaaccctgctcccactattgccaatttcaattgttttatctctacaaggccggctgcctccttgtctctgtactgagttcccatttctacttctcatcttcagcacaggctccatttaatactgtatcaacccccttctacggctcattatttttataatacagctcatttgtgagtctaacatatgctaatcatgcacagagggctgttgatatctctcacatatatatattaatcccctagcacaggcatcacacatgtccacattgaggctgaaaatgagtcagagcaatgggagaggtggtggagcacagcttggcctcctgcactcttttctccaccacaattctcgtatcacaccaagttgagatgctatcatcaacttctgaaagcccatgttacatcccccaaggatattaacaggaaataaaacttcactaccctgttatgtcaaccatgcctggtctgttcaagtaatagcatattttaaaatgttgcctctgcttatctgtgtttacagagtccagcctctgtacccacccaacttgtgaaataagcaagcttatcgaattttgcatctcaaggacgatgggaaatgggttaaaatacaaatttgttggtgactttgcaaacgaacagcacgatgctcttgaccatgagtgggaatgaatacctacatgggcaaccagagagtttatcaagggtggaataaggtccagagtcagtttacctctctacactacagtctgaaaaattataatatgatgatttaactgtggtgaaactcaacagaaatcttcactgagcaagaagtgttcagtagagaggaggcagcagaggcacgtttttagcaagaggacccccggatgcaagggtcttcggtgtaacagaggagagacacacctgaagaaattacagaggctcaaggaggctgggatgtaaacagtgatggtgggcatactacagagcaacgccagacatggatctgactttcagcctcagttacacactttggtctttattcgaacagtggcagaagtggagagggtggcaaagcaggaagatgtgttttacttagagaaacaagagcgtttcttcgaatgttcctcaatatctctgtgagttaggaggtgaagtcacttgagactgtgtgggatgtgtgtggtatgcagtcatgtatagttttttttatgtgtgtgtgtgtctgttgtgtatagttgatggtgtgtgtgaagtttgaagtgtatgtgtggggtggtgtatctggtgtgtatcgtttgtggtgcgtgtgcactgtgtgtagtgtgtgttctgtgcacagtctgtggtgtattcgtgcatgtgtgtgtgtgttatgtggaaagtctgatgatgggaaaaaaggtttagaaaaggatgtgatcttcagcgagggccaatgtgaaacacggcaaaaggccatttcagtacttcagagaccctgctgtgtttagcagagttggacgttgtcttcgatatatcttcctgtgctcttacaggaaatgctccttagaataatggagagaatttgttaagcctgctttggaaaactaaggattcttattccaagaacagtttataagaggctttacgcaaatatctgggtgcttttggagtttaattgcatttgcatgatttagagtaatttatctgagatgtgtaagactggctgtttgagcgtgatgactaaagattatttacaaaactaattcacagatgagttattatgctattgtttccttcatttatgaagcaatgacaccccatatcaaaggcatgtaatgattatattatagctataaacacatggtttaaaatactcagaaaatatcaaaggtccatttatttctccttttttaaagactctcaaatactccctgtaaccttctgacataatgttgaactaattcctaaaactaggtgagaaaatgcataacagcaaatgattattgatgtcattcttcacacctatattactttttattattttttatgttaggttatttttgtagtcacttgttctatctagtttaatcaatgtcagggtgtactttgcacacacaggccaattcaacaactttctgaagatgtgtggagattctgaaggttactttcaattcctagggtcagtttgatattaccgttaagtgcaagacccataattttaattaattcacaccaactaattattcagcttcttcagatacaatataattgcactgtctatttagcatgttattttataaaatgagatgagaagtttttttaggaaaaaaactaatcttttgttctgtagtcccttagagaagaccctcaaaagctttggaaatttgaaagaaattaaattcaaaatttttataattttaatattatgaaagacgagaaaaaataaatattaaatgcattttctctcatcaaatttctaaactaaaaggtaaatcctgtaacacagacaaagtataaatcataggctcacatcaagcagccaaactctcagttcatatgaaattccctaatagcactcccattttagtacaactcccttgggaaggggcatactgctactgaaattagaccgtatttgagcatatcaccttacacatttttttagattttactctagggattgtaacatacacaacacatacaaaataacctatcacagtctattgatattaacgttttactagatcaatgaagcatagaaacctcacctccatataggtcccttcgcccttacttcattttaaatatagctgtctgagtattttctctgcagacactgagcatcacttcagagggtcttacatgtgcttcaactatgaaatgtgatttaagaagctcattagaaacatgatagtcgattatagttacccctatttttacatagtgctttattttcacaccagactaaggagtttggaaaacacgctaaaaggtatgaaaagccttagaagacagagggtaatggaaagatgaagtatcaggaatgctaaggtctgcaattatcacctctcagagattcacttatctcccattcatccctgctcctagtaactgcttcacgtttctaacacccaggtattgcatcagaccataaagaaacaatggtaatctcctttccatctagtggaggattcaggaattagcaattaacttatcacacagaaaaatatgaagttagaactgttatcatggctgcttagagctgaaattcttatgggtgggtgtggaagggaaaaggcctccacactggaatgaatgggtatcttggtcaaagggttcacagacagtgtttctcacagcctacatgatgcccagtcatttaaacattttggtattcaacaaagataaattgtgcagaagtaggaaggatgaacagcatgcgttatcttttatctgctgtttattaatttgaaacttcttttcttccacattaaataaaatatctttggacacaataaaatctcaatacttgtatgacatttacatttttgaaagttttcatagctctcgatgatgttaaatcaacatggtatgttaggaaaaatgagtcagacacatttgaccgagactataaaatttaggggtggcaaaacaaagacacaacaaccatagaacctgcaagacacgcaagcattgtataccatggagagagtagctccagcatggagagggagactgtgtccatatacagccttaccaaaggaagaaattcacattagatctcacctttgcttatttcagcagcaagactatctcaaaagaaatgccttcttctcaaaagaaaacttacatgtggccaacaagcatatgaaaaaaagctcagtatcactaatcattagagaaatgcaaatcaaaacctcagtgagatactatctcctaccagtcggaatggctactgaaaagtacaaagataatagaaagtggcaaggatgtggagaaaagggaacacttatacaccactggtgggagtgtaaattagttcaactactgtggaaagcaatgtggcatatcttcaaagagctagaagctgaactgccactcaacccagcaataccgtgactggctgtaagcccagtggaatataaatcattccaccataaagacacatgcacgtgaatgttcattatagcaccgttcacaacagcaaaggcacggaatcaacctaaatgtccatcaatgacagattagataaagaaaatgtggcacatgtacaccatggaatactatgcagccataaaaaggaatgcgatcaagtcctttgcagcaacatggatggagctggaggccattattcttggcaaactaatgcaggaacagaaaaccaaatacatgtttcacttatgagtggaatctaagtctggacatcgtggctcacagctgtaatcccagcatttcagaaggccaagttgggcagatcacctgagatcaggagttcgagaccagcctgaccaatacggtgaaaccctgtctctactaaaaatataaaactgagccaggtgtggttgtgggcgcctgtagtcccagctacttgggaagcttagacaggagaattgcttgaacctgggaggcagaggctgcagtgagccgagattgtgccacagcactccagcctgggcaacaaagcaagactcagtctcaaaaaaaaaaaaaaaaaagtagaatctaaattatgagagttcatagaggggaacacatagaggggaacaacacacactagggcttagtggatggtggagagtgcgaaggagaggagcggaaaagatcactgttaggtactgggtataatacctgggtgatcaaataatacatgcaacgaacccccatgacacttatttacctgtgtaacaaaccttcacttgtatccctaaacctgaaacttagaaaacaaaataaaaattattcagcatataaaaaagaaatgcattgctatgaaattattatagtgtgttgaaatcattgtcatttctagctagtaaagaaatacgtagaatgtgtgtcaatttccaggagttaaaaaagttatcaataccccccttttaaaaatcaaaatatattatctttacacacgcttcctacgtgcatttagtcagaagacacaatgaacatacacactatctatatgcatgtgtagaatgcatagatagcgtaactgatcatattgcaatcctaatttattggcaaactttagcattgatgtatactcatataggtattttaacacacatgatcatacctacttttttaaaagcaatttaaactccaaaataagctaattacttttaatggaacaaatatatatatatatatacatacatatatatgcgtgtatatatatgcgcgtatatatatatgcgtatatatatacgtatatatatgcgcgtatatatatatatacacatatagaactctatgtttccagttttattatcaatgttacttattgagaatgatgaaattgaaagggctcacagtcgttctatttatgagcaacagatgtattaaagttgttggccaggcacagtgtctcacgcctgtaatcccaacactttgggaggccgaggtgagtggatcacctgaggtcaggagtttgagaccagcctggccaacctgacgaaaccccatttctactaacgaaaaaatgagccaggcgtggtggcagatacctgtaatcccagctactccggaggctgaagcaggataattgcttgaaccagggtggtggaggttgcagttagctgagatcgcgccaggcaaggcggtaagagtgaaaccccatctcaaaaacattaaaaaacaaaaagctttcatcacacgtggcaaaaacaataacactgattggcataaataatttggaagcccagaggaagagcccataatttgacctgcaaggtaagttttgcggggaaatgaagatggggaggtagaatttagagaatgattcacataaatttctatagaataaactacaaatgaatatagtcccatgatagccatagagctaatatagaaacacaacattcttatggtcccttattggtcccttagacagtgagcaagctggaactggtctttaatttctaatctactaaatgtacattttttaaacctagggaataataacaggaaaagcttaacaaccctgaaaaaacctagttggctaaattttcagtcactttcctctagtgccccaggaagagaatgcgaagaatctggttaatagctagctgagtccctagagagggaggaatccatcatgggggtagcagaccatcattgtcactatgcgtgacacacactctgcttttgagaatgcgtttagtgtgaagatgcctgacgggacccctgtgacatttaattctcctctgaaaatgttagcaatgcaggaacccgaagagctcccaaaggtcttacatgtcaaaatgaaaaaaaaaaaaaaaatcacgcgtaggtcacatcaggaggaaatacgtgttatgggagggaaagaagaatgttggaattaactgtcaatgtggactgtctgttttaaacatgcagatgccatttaaacatcaacacatgtaaattcactttagagagggaaaccaggagctctgaaagtttcagacatttactctaaggtcatatgacttaaaaaaagcagaactaggccgggcacagtggctcacacctgtaattccagcgttttgggaggccaaggcaggcggatcaaaaggtcaggagttcgagactagcctgaccaatatggtgaaacctcatctctactaaaaatacaaaaattagctaggcatggtggtgcacacctgtaatcccagctacttgggaggctgagtcaggagagtcacttgaacctgggaggcagaggttgcagcgagccgagactgcgcccctgcactccagcctgggcaacaaagtgagaatccgtctcaaaataataataataataataatgataataataataataattccagttaaacttgctttctttctgtgtcctggagatgggggattcaacactgataccaccatgtatccgacatgcagagactgtcaacacatccgaagtctaaaggcttaaaagcatctcattccttggttccctcattattttcaagactgcagtcacgttaatagttaagtcacaacacaatgccacatggaatacaacagcacaaactcttagttacaatcgacaaagtacataggattaaagaagaagaaaatacattcactagcccaacagccagtgcctccacctgccatagaacatttcctacatatttctgtcagggccagagttcacaggcaaactaacagaaataagtgttctatttcaggaagcagtatggggtgttttaaaatataagccaatttcaattgcatccgttccttgaatacctttctaagcagtctggactttgctaatgccttgggatttctcccgaaatactaaagatgattctaaactccagtccacaatcacttttacttatgctactggttgtattacattttcacacacacacacacacacacacaaaagcaatgtaatgtactattacattaccatttgtgagttaagtgttaggtcaaaatgcctttcaagtttttatgtgttcttacgtacacacatacatcctgttttctcatttacacatctgacccatgtcttctaatgatttatcctcagaaaagattcagcatttatgaataaagaccacaggaaaagggcaaaggattttgtaagaggagggagctgcgacaagctgggtgttagaaaacgcttcctgttggagtgaagaacataattgggctcctaaaaacacagagattataccacaggaaaagtggggttgacattctacatggtgggaggaggtttcaccttcccacatggctaatagtactgacagccccagcctgagaaaagaggtccctcttctaatcatgactgcgttggcttcccactgccccgaccatttgaatgggcatctcgagggagggaagaggacagggcttcttacaccatcgcaagagcaccactcattctctgccctcatccacacctaccggagacagatgacactttctgcccagcttccacacctaccagaggtggcactttctgctcaaaggaaagcccagctctggcttgaagaccagagtgaggtagggtttatgaaaactgagacagtatgcgaggagacccttttaccctaaggtccacagcgtcttctagctgctgttgctgcactgtgagccccaggtggcaggtaccagcctgcctcattcactaatatgtccccaagcaagggatgagtggcccatgttcagcaaatatttgtaaaataaatcagtgaatgcaaaaaaaatattccaaggcctgactcaagataaaggataaataaaaagtgaaccaataaagtagaaaattagatttctagaaattaactaaaaatcacacagtgcttaaggagaaccaatcttccatccagaactttgccagatattatgaataaagtaaacttggtttccaaagataaaatgattttattatagaatcaaggtttacatcagcataaatatgatgattataaaatagccattgaagtcatatttgtaggtatagattgagctgtgcaaaaaagaaactgaatgaaagcaactagctggtcatttcatttcaaaacatattttgcataaagtaattcaaactttttttctttattcttcagaagcgttttcaaaaatttgtttcatattatattctcagtcttcttagtaaaattttaaaaacaggttttataaagctaaagatgcactcaaatgtacaaaatgaaatataaccttctcttaactcctaaataaagaacgggaaattttgtgaatgtcatcttttattcttttttctttcctttaaatattcaggcattattgaaatttgaaaatatcccactgagaaatatatgaatccttgagtagaaaataaaatgggttattaaaagccaaccactcattattgttaaccctcttaaccattcaaaaaccttcaacaatccaaatactccctttcaattatgtagattagctaaatttcaagagagcaggaccccatattctaaaattttatgattttctaatggtcttccatttgtagtgatttttcatcctcgaatctgaatttgttgtgatctgtaagatatctcaaggaatgctgcagagaaaataatctgcatattttattccaagcggtttcttaggttatggtcttatactctgggctgccacagacctctgttaattcttggacttaccaagacaatttcttcatatattaggttgatgtgaaataactgtggttttcgccattactttcgatgctgaaaacctcaacgatttttgcaccaacctatacaaatagaactattattccataatagatttctggtaaaataattatatataattaataactttccactaatattccatcgagtcctaagacttggtgtagacatcagagacacccgtgacagaaggtgaacgacaatggggtacactgtgtcaagatgaaggactcaaatgcaaactaaggggggggcttcctttatgtgtttcaaaataatgggattttcagaacgatagttaaataagaaagtggtcgaacgcccccaaaacccttttcaaatccagaagtaaatctatattgtgcttccctcaaagtcagcactcggtaaacgcaaaataattggtagctgcttctattagtgatgttttgtggttatactccaaatcttggggtgggggaatcttcaaaggaatagaaaagccaggtactgaatgaaaatatgccacatgtcagattcatacgaaaactcaagagtaaatacaatcgactcttattgagcatgccaatacactgttggggcaaaaaactacacttgtaaacggcactgaaaacatacaagccctgtggaattaatcagctactagtgtttatcacaggcaagaggtttccaactggccaagcacatcatcatcatctaaggttgaataataatccccaaatcccttgtaaagttttacagtttataaagcagctcaatgggttatattttatttacataacaatctggtaaggtaggcagggaatttttcttttttttactatgtatgattttaaaagaaagctgaaagcactggtgtgatttgtataaatttcctgcttgctaacgtggggtgcagtgaaattagactcccacgtctgtgttataagctgtggctctttcattctaccctgctgtaaaactcaaatggttacaaaaccagttagtgtatctctgttgtcatataatgtaacagatgtctatacgctgccagtgtaaggcatgtacatgcacaatcactatgcctgctaaggtaagtgacttttcttggctgtttcttcattttccagagatagatttaaagtgtccaagttaagtgtcagtactcaagagagagagaggagagaggggagagagagagaaagagagagagagagagacaattttatttactgacaagcaggaagtttaaatcaatagttctttatagacttagaagtgaggtaacataaaagagaagcgatagctcagctgagtacatgtctgtaccatttaggttacttccacactgccccagaagttttcttttatatagtaaagtgcctgatacattgtaggcattcagtaattatttgtttaatgtatttttgaccaagttaaaccgaattttggcaggatgaaaatatgttctgtctttcagatgtgttggaaaggagaacaaaatgtcaagaatgatgtaatatgttgccgttccgaatttaaggtatttggtattttataatagttattgaataaatatttggatatacaattagaatccaggagtaattctattagcaatatataaaattgtgcgttcgttttttctcacgtaagtgtgacatttagtttagcctgtctgtaaagctgtacccattccaaaattttatgcaactacattgttatttatgaaataatatgaacattctaatattgttactatccttctatgggtttacatgtgaatgataattattacaactattagaacttttttgtcactgtagaaagaaatgacacttggtaacatttttccttaattaaagtttttactttctaatctttgcagacaaaatctaaaatctttaccattaggtcatccatccctcctctctctttttatgcacacatgtgcacactctcgtacacatctctatttgcgcattttagtttctgtgtgtgtgagaaagagtaatattgtgaaaattacattgagttaaaaggtcattagcaagtaatgaaacaaagcttgcattcaggacctactcaactggcgagaaaacttgagtaagtactgattaataaagttacgttaacaagagcttttacactaaaaagaataaaaaacatgttgattgaaatgtttacccttattgaattagtaattaaaagtgacacaccttctaaatttaagacgtcactgattgtttttgatatcactgatttttaactcaaaggcttaatattattttaaaatctcaaaaaaaaaaaaaagccactctctgtactggttgtacagatcaaccaatagataccatatattggcattgtatttacaagcaagttaattttaaactatttgaaagctaacatcctcccataaatcataaagcatcttacaagatagataacatcagagatctgtcctaaatgaacgtactttctgaaactttagtcagaagtgggtttttaattttactctctttattaaaaacaaaatgaaagcacaataatgacaatctatcatcttcatattaaacagcttgaggccttaagtctaacaaagcggcttgaaggtacaaactccttgtttgaccaaataaacatcttttacttcattagtagtcctcacatatacatgcacatagtaacaaagtaaggaggattttaaaagcagattaaatcaaaattgggaaaatacctgaaaatttaaactgttagtcaatttcccccagtaattccaattacagattttgatgaaaagtgaccctaaatcctgacagtcatttttcccttttgctttccttcaatttatcttagtaatgtcctttccttgcttttaaacagtttcttctaaatgaattaaaaagtcttagcatattatgattttcctcctttccttttgctgaatgtttctttgaaatactgagcctctggggcccataatcgatacgtgagccctaaccaatatacctacacttctttccaaaatccaaataatagctactccttcttaaggctttgctaggatagcagggaccagatttactctcagagcagaaaataaacaaacaaacaaacaaagtcacagaaataaaggaaacattaattgttggctgttgaataacaggaaatacagagtggtgattcctgagagaagaaaacaaaagggtgaattacttacccagttcactgcctggaaagagaggccagggaacagagaagggaagcaatccaagcagaatttggcagttcttggattagaggaaaaagaactgagacttgccggggggccaaaggctgctagagttgccgggcaaaataccagagagagaagagagcttcacaagagatgtgtagaggaccctcggggtcttcagctgagagctcacctgtatattatgcaggtaacagaggtacccaaggctgagctcaggctacagaaagatccaccggaaagcagtagggagtcatcttcagagcttgcacaaggccaatgtttggatttttacaggcagagtggaaaaatatcataaaataggagtattgggttaagtactcaaagtaccacctcaacaatgaaaaaaatgagtagtaaacaaaagacttcgttggttttacccaacaaacattacatgttcaaaaaaatccaaccctttgcaagtaatttaactgtgtaacagaacaaagcacaaaactttatttagagaaatgcaaaaatatccagcacttaacaaggtaaaatgtgtgatatctcgcatctaagcaaaaattaccaggcatgaaaagaaacaggaaaataagacccacaacaagtaggaaaataaaatgaatacaagagtgttcaccttataataccttcaggctatttgttttccttccacaagtcatcacacaaataaaccttttttattattattatactttaagttgtgagggtacatgtgtagaatgtgcaggtttgtgacataggtagacacgtgccatgatggttttctgcacctatcaacctgcgatctacattagatatttttcctaatgctattcctcccctagacccccaccccccaacaggccccagtgggtgatgttcccctccctgtgtccatgtgttctctttgttcaactcccacttatgagtgagaacatgcggtgtttggctttctgttcttgtgttactttgctgagaatgatggtttacagcttcatcgatgtcctgcaaaggacatgaactcatccttttttatggctgcatagtattccatggtgtgtatgtgccacattttatttacccagtctatcattgacgggcatttggattggtgattcctcaaggatctagaactagacctaccatttgacccaacaatcccattactataacccaaaggattataaatcattctactataaagacacaaacacacttatgtttgttttgtttttcacttatagtatcttcttctttgtatcctctcctcccagtgtgaggtcctagccactctgccaggtccagtttcagcattgcctccttataccagtttctctgtaaattatttatttcccatacacattcatattttcacattttgttttacacacagatctcttatgaagtcttgtcatacgcttatattgagtttttgtctagactctagtctaaatcaatcaaaggcaggaagagtgtcaaacctattttttatcctgtcacctcgcacagtgatcaaagtgtagggttcaacatgtgtgtccagtgcatgaacacgttcatgaggcgtgcctacagctagtccctgtggcccactgatcatcctcggtgtgttggtatgttcagagctgacccagtctcttgcctattgtttcctcctgaaatggccatacgtcttctctcctctcccgcgctggcagttaaagcataagaacggagcaatcagaagagtttttttcatcccaaacctgctgctcccacttattgacttgtgaccttgggaatcttaccttatcactctcttaattcctcagtgatgcaagttagacaaacaaacccacagcagagggatgtgttaaggattaaagggatgagtatctggtatatcacagatataacagacaataaatggtgtgagtatctggtatataacaggcaccaaataccttttcctcccctttctgctctacctctgcaaagtttaatagtggtaaagataaaagagctgttcaacattcctaagatagtgataggaatcaatgtctttgttgattaaagtttccaaattattactatacgattaagagtactttcaaaaaggatgctttgaaaatttacaattttttttctaaatttacaaagtactaaatatcttttttggtagtgtagttacactacttgacacgtaattcattcagaagaaatgaataaataatatatcatcattgtgatttattagacttttgccttttattacagtatatttttatttctgcattttttcacattatcactatgaaattaccagggtcatagacattgttaattatcttcaagaagaaaatcaaaaaagctattccattaatttagttcatattttaaatgcctaattcacagatacttttcatcatagactgaaatgaactctttaattacataaatacttaatataaaatattggatcattttatcctccgatttctttacatttgaaataacattgctaaaagtttcctattttaacaatttcctttcactctatggttccatatagataattcacatgtaattttatttgaaaacatactgtatttaaaatagtttaaacataagtgagacctgaattcaatttcatgttatctgcatatttgaagagagtacttttttttgcaacaatctgagcactggagagagtttaaagtggaattagaattcccccagttggcaaaagcatctcacctattagcaaggtgactacatatggcagaatattctatcataagagtaggaaaaacccatagctcttagggattaaaagagtgaaagctgtatgcagttgtgggttcagggaaggctgtataaaaacataacatttgaggtaggccctgaagagagtaagtaagattttgatgaaggaaaatttcaacataaaagacatgttgtagaagcagaaaaatgctggacatatttgagaaaaatctaagaataatcactgtctacagaatattgcttattttcaaagagatggtgacaaggttgaaaatgcagtaggggccaggcacggggctcgtgcctgtaataccagcactttggaaggcagaggtaggcggatcacttgacttcaggagtacaagaccagcctggccaacatggtgaaaccccaactctcctacaaacacacaaaaattagccaggcttttgtagtcccagctactcaggaggctgaggcaggagaatcgcttgaaccctggaggtggaggttgcagtgagcctagatcgtgcccctgcaacccagcctgggtgacagagcgagactccgtctcaaaaaactacactaaaatataaaataaaataaaatgcagcaggaatctgagaatagaaagattttgaccagcctacaaatagagagttaagcagcgaaggaatggaaaaatcatatgattttaatgagacattaattggtggttccaaagttgtttcctcatttgtacaatgacaagctttggttatacaattctaatttccagttctaaactcctatgcagacccatgtgattgtaagagaagttaggcattatgtataagcaattttgcttaaacggaagttctgtagcaggttcaacagacttatttcacacagtcttactctatatagtacttcaacccctaaaattcatgaaaagtgagaaatataaacttatgttctttcctgtacagcatggccttcctaatttcacagccttgttccatgtcttcttcacaggtcaccccatttgattcaaagtaaccattcacaacaaaccatacataatgggactagggctttctctgaaacctgttatcagaaatgttgcctggcataaggatcctgaccagtgtgggtgatctatattgggtcatatatctgctttccaaggtgtttgagtggctgatacccaaagtcaacagtgcgacagaaaccagaagacataaggagaaaaaacaaataaggggcagtggactctacaaacaagaattatataggaaatgtataaaatagaaggaagccgagagggtatgatttgggtatttcacatccgctcactcaaatatcccccccttcccctggccagacctgcctatcttgacttattgaaccataaaggatgggcagctcctaataacctcctccaggtgccttgtactgagagtttagcttaaggcaacttctatgaagaaactccacattttgagtcttggagttctgagcctgggggtggcaggtgtcccagcaacaggcattcagactactgggctgtcagtgcagcctgctgcctcaaggacttcactgtgatcctgggaatggcaggcacagccacacccttagcaggccagttcctctgtgtagttcaaatttacccgaggccaagcttagattttacaccttttaccttcccaatgacatcacctaaaaatctcctgccttaactgctgctgtgcaattatcaatgctgacaaacagtggaaatagtataaaaaatatagaacaaagtaaactgtgtcatcggaatgtatgatgcatctgcagagatttccctacaccaagaatgtgagttctgagaccttttcctcttcctcatcactaactgcgtattccattaactaaacagcaacctcgaaagaaatcaatactcggaaggtcctgtagtagcagccattccatggatgggacaccagaggtggggcaggagcaaggaggggttcctcaccctggcaggaaagctagaagcctagcctttgtcagtgaacacagcaaaccaagcttcttttctgaaatcttcttggaagcagatgaagtgcacacaaaagagggttcttctccacccccaggaggtgcattctggtggccaatgccagggaataatttcaaaggactgataaacctactaggaacaagacaggtcagtggccatttatgacctcccatacagaagaaaacaaacaaacactgctcctggaagatccagctcagaggatataagggcaaaatccaatttgccctgttttccataaggtgttgttatatatggatgaagggtttcagtttattttgtttcagccccataaacaaacatcgaaagtgtgtttacctagcgcctgcttcccatgtcttgctagagaacataagcaagacaaagaagaggagggactcccatcccagcacacctcagggtcctggatcctcaaggcactctgagtcctgagttgattctaggtatggggcctcttcacgggaaggaggcaattgtatttggaaaggatatcattatatcactgttgacacatcattgcattcctggtgtggtcactcattgagtgagtgctgcactgtggctccttaaaatggcttgtagttacgcatccagtggagccaggagggaaaaatcagacatcagtaacccacttgatgatactgcacattgtatgcaatcatgaatgctgacaagacacaggggaaagaggagaaaaataaatataacaaaggaaactgtcatgaaaacagatgatacatttccagggattcccctgaaccaggaatgtgcgactttcaagaccttcttctgttcctccccactaaccaagtattccattaattaaatggcaacctagcaagaaaccagtagttggaggtggagggttctcttgtctaggaagtcttagataatcccaagagacagacctccaaatcccactgtgatctgccttagaaggaactctacagaagccaggcaatacatggtatttacttcatgtaagaatcgtctactttcaagcgcttcctgtggctgaagtttgtctgctcatttttgcatactcactttgcatgaatatccatggcaaccaaaagcatgcctaccttgttagcttttccggtgaggtaagaattattatagtaggcagggcaacatgaaagcatctgaagattttttcccaaactacccaaattacacaacaaccatcatgctcatctctagggccagaaagcgagatgcaggataaaactcagtgattatagatggaatccaacactgagaaggcgtgaatgttattcctgttgcacccctctccacttcccattttaaatgctggcccatttaaaatgctgatgaccctgagaacgactgtagattaacaaaagcttattccacctgatggctggaattgagagttccgttctgtatatgcacatggtcagaatataatagagcagatttacatgctggctggggcacctttttctgttcacggtcatatcagtctacagtagcacaatttccttcacctggggtacgaactcagtaaagacgttggctcgctatttttaaagcaatatttgttgacctaacacgggattctccaacactagcattcatcagcattaccagaacggagtggtaaatcagagctcagggccctaccgtcagcgtttctgaaatattcagtttagagttgtgccagagaatttggctttctaacaagctccctggggatgccaatgctgccgatttgggaacactgctttgaaaaccattggtctaagatgaccaaagactgcagatcatcttcacatacggtgggagactcagacatagcaaggacagcggataagtcctttgaaaatacagggcttgcgatttcagacatggggcaacctgacgacgatcaccaatgtggcgagaggcactcagattttcagcgcagataaaaagatgggaaaaccaattaggcagctactgagcaagaggtaaagaatgcatatatgcttgacataaggaagtatcaagaggagataggaaaaaaggtccataaacgagaggtagtgcataatgagtaatcaaaggtgggcataaaggaaagtgaacgttagaagcaattccaaacttctttttctctcctacggagaaaacagtaagaaacctcagaacatataggataaaagcatctacccaacgtttcctcaaagaccaaaggaaaaggtctggactcaagaacatgaaacattccgtttgggtaacaccaaatggggacttgatggaatagtaatgcccatcttcagaagaagatgaggtacgcagaaatggaattcagctaagaaatcaccaagaaaactttggctttgagattcttctgaaaaaaaaaggtcacaggtgaagctttgggaaagatttaacttggactattttacatagaccatgtataggaggaaaagtaagttaggagccataatctcaaggaatgtctactttggaagtgcaggtgaaaaaataggttaatgaaggaacctgagaaggaaaacgaaagaattgggagaaccagaccacagaaggtcagtggtatggattccaactcagaagacgacttcaaataagagatgaggttgtagcatattcttgaacaggagaggggaatccagctgtaatatctgttatcattgacaaggtctactagacaacaaatgttagatacattattgtatatataatgcagaaataacacattacatatctttaaaaatgatatagcttagttttcattagtgtttaatacaaacgtccattttacagtcaattgctctttaagtatctcttttacatttttctcttccttcttttcaagagcaattttaagagagaatcagaataggcagagagttaaaagaaaggttaatgaaaatggggagactctgctaatgtatttccttgggcaaattgcagaacactggcacaatcagtcggattgtttgcagcctccaggttgctgcctgtaggtaactggggatgagccattctctgtgctgagtgcctttcttgcagtgtgatgtgtcaggctgttccagctccaatgttggctttcctgtggggcgctcatcactgtcactcatactacaaagatgttaccaagtcagaaaggggaaaaagcccccaaaaacaacaacaacaaaaaacaacaaaaagctccacgatgcatgtttctagaatgtattttgtttacacataggtattagaagtttaaaatgaataacaagagacctactgtccgaaaacattgttacatacattatttttatttaatcataaaaccaaatgtaacttttcttgctaaaatgtctcctgtaagtataaagtaaggtacatttttgtttgaaagatgacacattttgtaaaacaaaaaactttaaaatctttccttttgcttccaggtccctaattttccttgctcaccacataattggcacattttccactgtgatctagaagttgaatgaaattcttgttttaacatttaccagtaaactttattcatttgggaaatgataagaggtacttagcgtcagttattggtgatccaagtactaagctctgcactccataatttacatgatatgtaacagaaactatgcaaacaagtcactatgtccatttatgaatgaagaaatactcaaagatgttaaatgcctcattcgaggtcacattataagacagtaagtaagcttgtatttgacccaaattctacacacccaattacattgcactcaatacaatttttttttttttttttttttttgagaggaattctcttcttaactgtgaattaccacttccccacgactcagttaagtcaactgtgcggtctgagacttctctctttcttagtgcacataagctatggaggcatgatttctttttattacttctggtttctacttttgagtagttttaatttcttaatttatacaaatttcggttgtcacacataaggtaacagttaacaggggacttacaaaaattagaaatactcctcctgcttttttggtaataaagcatctcctgtactctataaatatacacactatgtacccacaacaatttaaaaaaatgaaaaaaaattaaaaatgaagtcattttgttttgaaatatttaccatgcttacttaccaagaataacatcactttttctctttgaaaggcatgtctacatattcaacctactaggaagtgctttattagctatactatggctatttctttactgttcttgttttatcaaaaaagttacatcgtttaagttagcaatctgacaaagtattctctttgaaataaacttccaaaaataacactgtggttttagaagcttaagcaattcttgctagaataattataactgaaactcataaaatgtcctcataacattcatttgtatatattggtagtgtgttgtttgcattcgctgtttttgcaatgcatttgcaagtttagcagagtatcactcttctgtgatatttatttttgtgtttactattcctcttgggcttccaacatcaatcttcctttgtaagtcaagccctggagaataatcacataataaataaaaattgcacaacaaataaatccaagccttgtattgcgtctacagactgtatggcttccaaacgtgtgttatctgtcttgaatgcacggttctcatcaagcccataatggagaataacaagtatagagatgtttccaatacaaattatttggaccttatcagtgttgacatatgcacagaatacaaacaaagacctattactaaaatgcttgaacaaaaaaatactcatttattttttgagatggagtcttgctatctcacccaggctggagtgcagtgatgcattctcagctcactttaacctctgtctcccaggtacaagtgattctcccaccgcagcctcccgggtagctgggactacaggcaggcgtcagcacactggctaatttttgtattttcaggatagacggcatttcaccacgttggccaggccagtctcaaactcctgacctcaagtgatttgtcttccttggcctcccaaattgcttggattaaaggtgtgagccaccgcacgttgccaaaaaatacttatttttctttatttactacttacatgtatgcccaaacctcagtgatatcgtttggatctgtatccccacccaaatctcatgttgagatgtgatacccagtgttggagatgaggtccggtgggaggtatctggactatgggagcagattcctcaagaatggcttgggccatccccttggtgatgagtgagcttttgctccaagttctcatgagatgtggtcaattaaaaaagtgtgtggcaccaccctgcttacacacacacacacacacacacacagacacacacactctttctctcttgttcctgctctggccatgtgaggtgtctgctccccttttgctttctgccatgactggaagctccctgaggtctccccaaaagccaagcagatgccagcaccatgcttcctgtacagcatgcagaactgtgagccaattaaacctcttttcttcataaattatgcagtctcatatatttctttagagcaatgcaagaacagtccaatatagtcagcatttgactacatttaagacttcacaatgagtagtatcccaacaaatatacaacaggaacagaggttcctgttatgaaatccacaatttctccataacacccgtcagatccacctgtcagatccacccgtcagatccagtaggactctgtctggttgtactcttctacaaagtaacactatattgtcaatttaatattttgggctgggcgtgctggctcacacctgtaatcccagtgctttaggaggactagtcaggcagatcacttgaggtcaggagttcagaccagcctgaccaacatgaagaaatcccacaccaaatatacaaaaatgaaccatgcatgttggcaggtgcctgtaaacccagctacttaggaggctgagacaggaggatcacttgaaccgaggaggcagaggttacagtaagccaagatcacaccacagcacttcagcctgggcaacagagtgaaaccctgtctcaaaaaaaaaaaaagtattttgtaatagctcataaatctaatcatattttatttgttttcacaacctcttatgcctttaagttttacactcctaggtgtttgctcaattttctgtaggttgaggataccccaatcaagttcgtgacttatctgcattcctgtctttcctgcggcatctcctccctacttatcatttctttccctatctatcttctgaagcactgttcattcttgcacatgcagctcatatcccaccttcccagattctacagctcagcaggaatgtcagtttctctcagaaagcttcattatgtatgcccagcaccctacattggattcacttttccccatgttcatttttataactaaatgcaagaccccccgacatatacagccgcctttgtgttactgtgccgtaagttcttagtgcattatcttacacatactgcagattcaataactatttcttcataatttttgtttcttattctccaatatgcaactacatataatagcaaaatgaaaatatatttcccgaaactaaactaccgaactatcctccccaaattatttgcctgataagaataaaccagaaaatcttcctcaaatagttgacaagattactgcctcccaggtgagtccctgtgggaacctctttcagagagaagccagggaactcggtgacacaaggtgctgaatggcagaagcatcatgctgcacggtgggtgcaaacgcagttttgagactaattttaccccgcccctcaaagcttcctgtcacgtgtgtttgttgcgaggtgtctacagtttttcatggttagttgtctttcagtgatttaaaaatacatcctggtttctggtaacgagagccttgccagccttcttttgggttttgggttttgtaattcaaacatgtttcagtgttgttgtatcccattctcatttgtgtaagcctggcagtatgaattaaatccacagctgggagactgcagacaatggggcaacatttatagtggcaactgtggctttcttctgtcatgaaagcctcagtcataatcaataaagctaaaaggtagccatcccagaggccccagttaggtcatttcaatgttccttgttttcctaaaggcttcacaatgacctttctaaatattaaccagcttcggtccatgtgccaagtcttcccaggagaggtttttgtatttgactcacagtatttttcctccaagcaaataattattactgtttcctcatagcacaatccatttgcttaaaaaaatacataatacatagctagagagtttaactatggaaaagcccacatcgtaatgatttttttacagtctccatgaccatggcattggaattcattttcatttttatgcaaagcacatctgaaatgaaaatgctgagtaatttactcaaacccacaaacaatgatggatgcttgtggtttttattttttatcttatcagtttggctccactgaatcatctatttttaattttgccaagaaaccacgcataattctaccccaaagttgtgatgaaaatgtcaagttgcttaggtcatggagcaaacacaactgtggacagaaataatgaggtttgtgagcaaacaggtgcggatccctcacgaagctaacgctagccattgccaccacatcttaatgccaaggagccaaagggctgtgctccaagcctctcttggagatgctctttcagtcctttctcatatgaggatcaccaaaacgctgaaaaaggaagacagcattgcactcaaattaacgattcctaccatgcggcaggaggatagtataaattctttctaggcacctgtgagtaagcactgagtaggtaaaaacagtgtgtactgtctctccaactgagcacctcacagataggagctcttcttctggtttttgctttttttccccagtaatacccttctgtcatgatatcacatacacacacacacacacacacacacacacacacacacacacacacacacacacacagagtcatatgcagagacattcagatacacagacatgcagctctcattactaccgttttgctagctggcacccctgggggaatattaaattacatgaaaaagtattaagtactttttcagtgtgagttaccattcttagacacatatgtaatggcatgtgatgaatgttcaaattcaaaatagttatgtgtggagacaggagaagttttcagggaaactttatttagctgatgaaatgttttttcccaatcatctacacaaaggaatgtttttgagaaaaacaacacaatgacttgaaaagggtactttactatcacatttttttcttataaaaatctaaaaaaaaaaaaactaagatttctgccttcagttttgaggtaaacgtcatatgaaagagcctagcaacaatgtatttctcatcccacacacagcaaccattttaaatgtcaagagcgtttcatagaaatactacttttttcaggatggaattgtgtttgaaaatttgaaaatagcaggtgaaatccagcaacacctgattgaacataagaattcctcaaaaaatccttcgcaagttgggatatcatgccactcacagttctgaacaaaacagaagtcacaccctgcctagtgaccctggacacaattctattaaagccaatcctgacgctaagtcctcacctgaaagaagcgtctcagatgctgttgaacatctagatccgagagagatgatacagaaagggcgagcgcagggttactagcacaggctccagggacggctgacaggggttgaatttctgtctcctcaactacctgttgcctatgcttgaaaaagttgtcttctctgagcctcagtttccttatcttggaaattatattagtatgattatgtgtacagcactactctcatttcataaagtgcttaaacagtgaaatcatcaggatatgcacaccatgacatgcaatatgcgttagttattattactcttgctgttgttactgatgcagatatatttaaggagagtgatctaaatctagacacactgagaacacatcattttataagtgcttttctacgataccatttaatgagaaagagttgtagaaaggactgcttacaatgacagattccaagatctagtccgctgcctgccacgggtaggtagccttgacctgggtctgcccctggaaacacattgcttgtgtgcaaatattctctatgcttctcattagctttatggtgtttcatctttaacatggggattctaatacaatttttcccctttatttctttttgttttgttttgagaaaagttctcactctgtcatccagactggagggcagtgacaccatcacggctcactgcagtcttaatgttctgcctcaagccatcctcccgcctcagactcctgagtacctgggaccacaggcacccaccacaacatcgtttcattaattatgatgatgatgatgatgatgatgattacagacagggttttactgtgttaaccaagctggtctcaaactcccgaactcaagatatcctctggcctcagcttcccaaagtgctgggattacaggtgtgagccaccatgcctggcccttaaaattctgtttgtatcatccaataacttaatgtgtatgataaggtgcttaaaagtatgccttacacgtgtttggtcaaacactattccaggtattcctgggaaggtatttgtggatgtgaatgacatttacacttaataaagcaggtgaccctcccttaggtggtgggcttcattcaatctgaggggaactttaagagcaaatactgaggttttccaaagagattctttctcaagactgcaacatcaaactcctgagtgttcatcctgccttatcgatttttgacttaccagtccctataaatgcatgagctaattccttaaaataaaactctccagatagtatgaaagattgatggatgacagagagacatctctatttttatttctctatctgtatttcctctggagaatgctgactaatacatagctttataccttctatggttagagaagctgtaaatcctcaaagcctatactgcccaattcttaccatgaaaaataatttttatttgcatagatacttgaacgatacgctcgactctactgtgtagttgaatgtaggcattttagtctgtttgggctgctatgacaaaatgccatatattcggaggtttttaaagaaaagacatttatttctcattgatctggaggctgggaagtccaagatcaaggtgatagatcaggtgtcagtgaggacccactttctacccccacagatgctgtatttttgctacatcctcacatgacagtaaaaccagtgtcctccaggcttgtctttaagctccgttgcctaagtgatcttgttttagcctccttagtagctgggaccacagatgcacaccaccatatctgactaatttttgtactttgtgtagagacagagccacacaatgttgcccagattgatcttcaacttctggactcaagtgattcaccctcctcacagcctcccaaggtgctgggattacaggtgtgagccaccatggctggcctgggctctcttttctatggatactgatcccatttgtgaacacttcacccttatgacctaaccacctcccaaatgccctatgtcctactaccataaccgggagggtgaggatttcaacctcggacttttgtggggaaaggcacaaacattcaatctataggaatctggatatacacatcttctgaatacattaacattgcaccatctctttctgaaacacaccagaaactcgttactagaatcatttatttaaatcagggaatttatatggactccagaatacaaatgtcctgaacaaacgaagtcatcacctgccatgtaagaacatcagcaccaacatctaaattagcttaaaacctgtcactatcagtcttagctaacttttccttaaaactactctatgattatcattgattcatgtatttattcaaatatttaataaaatgaaaagttgctgggagcatgaagtatattgtgcaaaattgttacagaatatagtgtttctcaaaaataacaaatagtgtaccttaatagggctcacggcaacaagatagagtcatcaatacctgaagaggaacataccacgttacctgtgatcccatggaagatacaacattactcagcccaggggttgattggggtatctaagctggggagaacagggggacgagaaagtggagaacctccagggcttcctgcaatatgatcaaaaatagtgagggagccccatattggaggataagcacagggaggctctcacagatacatgagactatagggtcagccccgctcactgtcaagttaagatttggtacacttacttctagatttccaaacttcctccctgtcttcaataatgattaagttccacaagacaatccactaattgatgagaaatagtgtaagtatttttcctgttctgtataaacttctcactttaagctctaccctgaataatcatactcctggtttgcggtcagcgctggttgactcagggaatgcaggtagtatgaatgcacctgtaggttcaagaccctttaaaggtcttgctcgtccaaaaatagacagtattttatgtcagaagctttacttttaatgccacgtagcctctgtagaaaggcacatttttagttaggaagcagggagcaactgggtcattaacaggcaactgtgcctgactaggcgtgacccatggccactcctgatggaatgaccctaaggcccccggtcagttaatgtcagcatctgtgctatgtgtagatgtttgagccttcagacacggaaacacagatacaactacatggtgcctggccaataacgtgttcgatgaatgtcatgctgcttgttttctagatggtttccagtggcctggtgaagcatgaatttattttacacacacaaagtgcatttgttgtgttgcacaaatgagcacatgagcatgcttcacttcacagctttcacatctgtgacatagtccttcgaagacaaagtagagatgaggctgtgtattctttctaggatccaattactctgagttacttggtgactggatccacaatgggcaaagctgggcccagagggagatgccgcctggatgaaaggcaggctctcagtaactagagatggaatgaagatggggttgagatttatttccaataatcaattctgttaaaaacatacgggaatgggattgcctaatttccataataaataataacaatacagaaattctgtaggctacaatgttgaaatggagcaaaccctcaggatttgccgtgttttcttcccagaatggctgactggcctgcttactaaatctgcaattataaactgaattttgcccacacattgcattctgcatctgtttcactgtcccagagggttgccaacgttgcggccacgtacaggagaccgaagcatttaagtgggatcttctgcccccaccttcattactactctatctatacctctgtttgcaacagtgttatctcaaaaggggagactttcaatctttacccaggaggcaaaaactccactgcctgataaaacatagcatcatggcaactaaatgcttaatttctgcttgacatttttctctgccatgaagatcaaaatttctcccagttaccccagcaaccgacattgttgcaaacttccacctaagtcatttctgcccttcttcagtaaacaggtattttgtttcagactgcttttctatcttagccttctctgttaaatctaaatgtctttgcaaaccacactgtgatgggatctctgctttgctttttcttatattctaaggataattaatactcagatcgtaacattatttttaaaaataaactcagcgatgaagtacatgtgaggcatatcaattcttcaaactcaaaattctgtggacagtaaatattttagacaagtgtcatgctgaactattccgttgacttacagcagattattctcacagacaattttttctttaagcatgccaacttttaaaagagtacactcaagtatttgccattgacatagaatggattagtagtacagcctttacattgggctggagttattttaatcacacagctctgataaatttttaatcagtagaataaatcaggtaattataaaacttcttgttccttcgtaaagactttaagagtaaaaataggcattttcttcagcttaagacaaaatgaccccatcactgaacaaatcgtttatcatttaatgatatcgcatttctcaacctttttaaatatcagttttgtcaactgtaaaatgtctgtattcccaaatagaggtgttctgagtggaaatgcaaagatttattccaagaatctgcttcaataaagccccatcatactctttttaatacatgcacttttatgtgtaactttggtgtacaattaatttgagaattactatgatttttattccaaagcatggtagtagagaattacaaaaatattggtactaatgcaagagttagattagagatgcatgtcatagttcttgcatatttctaatattaagttagaatagttgcaatattccatagttgagtaagtgcaagagttcaatgcagtagttgaatatagttagttacacatttacctcgtatgtgatctgttccagggctctcttaaggaaacatacaaaaatatcttatgtttgcaaattacgtaaaagtacatactagtgtggatgaatcaagacctcatcagagccatgcaaacaagaaacctggacgtttacacctggttaggttcatggcaaatctacctcgggatattgtactttgtaccttcaaagttcttcggctttttctagtttactctattttcaaaactaatttctgggtttgataacacctctgacatactcataatagaaacacagcaattaaatctttaaattaggtccataaatttagctgtcataaaatgtgctcacgggtgagtcagaaatagaagccacaattccatagttccggttctacaagtatttttttaactcagatttttttcgcctaattcataagcgaatattaaattctccttgaacccaaatgaatcatattgatattagtttaatgttgcaattactcttgtgttgccttaatattcagctttatattactttttgaaagaagaaattatggaaggtttagaagagaaccttttactagaactgacaacagaggcatgataaataaagttaaagtaagggtaagcgtatctgaacataggtctgggcatacagtcaatgatcagaaaatgctttgagattctgtgaaaagcaaggcttttctgtgaggctcaattgctgtagagcctcaaatctaccgggaactattgcttgggtagtagaggcatggattctgagtctagacaaaagagctcatctctgaggcagaaatatattccaactacaaatgctatcagctatgaaaataaattcttgagccaggctttatctccttcaaaggagatctgcaagtataccccaggcaataagccataggaaataatctagttatggtcttggccagagacaaaagtaggaagttgataactacttcaaaccctttcagttcttaccattttgtgatttaaattcacaagctatgctggcagattcatcagctggtcaaataatgaatctattttttatcttgtcatgccctgtgctaatctcagtccaggctctctttcatgtaaatgagaggctggtgtttgaatcagctgtacaaagctaccgcgaaatgagatactggagctgagtgacaaagagtttaaatttataagacttcaatttcagtcctacatttctaaagactactgaatctttcataaataactttcggttgtttatttcatcgtgcaaagaacaggtgggaaatcgctcaatgattacctgcccacataggaaaacattcatcagatgattcaatatgttatgtttggatggccaaacagtttccaggtttgagtgagtgagaagaaaatgaaagaggacggtatacgaagtagaaaaagctgagtgcaggggcttacaccaaaaatcctaatgctttgggagaatgaggtgggagaaccacttgaggccaggagtttaagatcagcctgggcaacaaagtaagacctcatctctacaaaaacttaaaaaaattattctggcatggtggcacgcaccagtagtcctggctcctaaggggcctgaggcaagaggatcacttgagttcataagttggaggttcagtgagcggtgatagcaacactgcagtccagcctggacaacagaaccaggcacttctagcgaaaattatgttgagcagcataccgtatgttttaggactgactctggtaacgtaagtattagagaaattagagttaaccttagaagttttgttaatctctcctctttcagggctctcatttaacatgttctattttcttgataccttttttttctgatccaaaaaactaatgacaccttcgccaagaagagcttgctatgccttctccccttttcctctcactgaagcctggaagatttgtcctttttccttgagactagtcatctgtgtttgcaaggcatctccatccaaacccttacattggctgggatgaggtttgaggggctgctacaccctagttaaaaatgtagaaaataacactcttgacatgagtttgctttaccattggccaaataaactcctcaattaagctgcgcattccttgaaggaattatgggtctgtctaggggtgatgaactcctcatggtcgagtccccaatgtcatggttagactttattatatgtcagatgaatcaaagcaggattgtccaagggcaattcagggacaaaacccaccctgctgatttcttcacagtactcttgcttggctgcgcctcctctgccaatgagccaagtggagcttggtcgtgaattatattaacctagagagtaggctggagtttattagaagtacattttaaacaaaatatcagcacgtggaacaaactgaaaatttattttcagcaaactctgcaaaactgtcaagcaaactcataatggttgcttctagagagttaactatgctgcttacccacttctagaatctcaattatttggttgctaattacactgtactatttttgatattaactattaatgaatattacctacaatttaaagtgggaactcaagcggagagatttctaggcctgagagaatgtagtctgtactctgcgggtttatttcaagctgatggatttaaaaattatcacagtcatcctattttttcagaaaattacatattcaactttagaatctatactctaaatcaacgtaaaaggtaaaacttgggaaagaatagtgagagaatagagatatctcatttccaatacatcgttgcctaggtaacaaggcctatccaagcattttgaattagtaggcgttgatcatctatatttggggattcaaatctgcaatgaaggcaagtttccatggtactagcaattacataactgttttccagtatttttcagaaggcagttgtatgtcatatgggcatatttcaggctcaaatatattaagcaatcaatcatatcactaggtaaaagtttttcacattgaattctgagattcatattcactatcgcaggaaataatttagtactgaagaaagccttgaactcaaaatgtagaggaaaatgtttgaagataagtttacctcattgtggttaagaagcagtattctctgtgatcaaaggacagactactctgcatatcatgaatgtggccctttctaggaagcaaacccatggaaacattatttttcctacagtgtgattttgagaagaaatactaacgttctgtggttccctgtttgtccagtgaaactgtaacttacggaaaaatgtttaggatatgctcttgtgttctaaaagcatctttcagcaaagcgacgcagtcaagataaatggaaacctaagattagtcaatatgttttttcaacaaattagaattaggcagttagggtgcattaataatggtcaataatattgtgcagatttcagtgcccattaatttgttcacatgacttaacgagcacatctgcataataacagaaggatgcttcacccagcagccacagctgatgttaaccttccacaccactaactttctgattactcattatctgtacttagaattagtactatgctttgtccaatggactgacacatattaccctggttcaagagacgaaagtggccttatttccaccatgcagtcattttaagacttggtctcaagatacaaattcttgatatgaatttggagcatcctgaagatcctgcagttcaagtagcgcaagccatctctatgtttccatggtaactccacaatctctaacaagacaagaagccaatctaagactgtctaccaagccacattcttacttcccttatgcaaacttggcagcagtgctgtgtctgtgtgtgtgtgtgtgtgtgtgtgtgtctgtgtgtgtgtgtgtgtctctgtatgtgtgtgtgtagagggatatttaaaccacaagccaagattcaaaggtgtgcaatgtatgtaaaacataggtattacacacacagaaaaatatgtgtatacattctacagctatcacatatgtttattatagtataaatgtgtgaataggttaatcactttctgaactgttgaaaactattctggctatcccaacagcagacaataaactggcagaaaaagcacaggactaaatcagccagggtaggtttcattccgaactctgacattttcctgatgtatgacatttgcccagtaagtgatcctctcagatggacacttccccataaggttactgggaaaaaaaagatggtaatatgattcacatgcagacattctttatttattttcatcacatgtgatgctaaacatgaactggctgcccagcgatagagccaatgattcccaggaggttagcaaagggagaacattccgcagtagacaggcttgcagaagacgtgttaaaaagaaaaataatacaagctcaagggacttggaaaggtggttcgttcctgccacaacatcgcaaagaaaaagcaggaagtgagtcaccctagatacaccaaaggccacccatgtgacatatcaggagaagcaaaggacttatgttttagagaattccaagatatgctgcacactgatctgtaagtttcagactctgacaggtagatgtcaggtagagaattccaagctgtagcgtagattgcagtgcacctgacttgtgcctcctccaaccctcatattcaacatttcaacattttaagttgccttcaacatcacatggtatctcagtgaccaagggatatggggtattttataactctccaaaacataaaaacagatgccacatgaaatgggcaatgtatttggtaaaatacaaggagtgcttcagcttgctttgttagagcataaaaagcacatatgataatcaaatacaaagacacagacaggaggatggaggttgccagtggttgtggggaagtgaatatagagagatattggccaaagggtacaaaattttagtaagagaatgaatacattccggagatctaatatagaacagtgtgactgaatttaatattctcttgctaagagagctgaccttaagtgttgtaaccataaaaaaattattaaaaatggtcactatgtgtggtgatgaatatgttacttagcttgatcatggtgatgtacatgcgtacatgattcacaatgcatatcaaatatcaaattgtacaagttatatacaatgttacttgtcaattatatatcaatagagctggaataaagtatatttttatctaatagaaactaacccaaaaagcagactatgtgcactagagcatgtggtcatctcctaggagacaaagtctgtgtctggtgatctgacctttgcagctttttcttttcaccaggggagcttcgactaggtccataaggaaatatcatcttgatgtgtgcactggggctcatctttctcatcctacacgttccgtattagaaatatgtggaacagttctgatgagacactaccacttcaatttgtttttctcgtacatctcctgtagcatatggccctggtcaactcaataactaatttttaaggcttatttacttttaaatactgccaagagaagtgttttaaaaattataataagtattttcatatatacaataaattctagtaaagccattgccaataataccacaagcactgtggttgtgaaattgtgaatgtatacaaataggtgtgtgtatgtgcgtgtgcgcacacacatactctggcttaacacggtataccagcacctcgagtaaaaggcctattcaaaaacacactgatcattagcaactgagaaatgccttgttaatctgctttttcatatattttcagatttctctgtaaccgtctccatggagactttcctctgttttcccaaaggtgcctctgacacaatcatctttacacgtgttcattcaattgttcattctgtcatgtgtctagtttaacaaaacatttcagacgtggccttcaaatcagctttacatctttcaggtttggtacattatttttcatactcccatacgctcaagctcagagagtacctactatcttctgttgagcaaaggcaggaatattttaaaactgaactgctcaaagatgcattcttttacaaatgtctacctctatctctcaatctattttttcattttcataaaaatgattgtcagaaatatatataaataaataggtatataagaatataaatatatacatatataagtatatatatgacaatgactcgctgggttatgagttacactaccgctatgctcaaaggaaggtttgtttaaaagcactcaagaattgaatcaataaacacaaagatattaaaaatgtttcctaaaaataaaaaggcatatccatcattgagcaaaagaatataaaagttgccattcacatttcaccgttgtagataaaaacatgtttaccagcaagaaatatacattagcatatgatatatagcagctgatctttaaaaaggatctttgagaacctttaaaaatatttacctagcgataaggacaactcaaatacgtcatggacaagaacaggcactatgcaacaggttgtggtcagctggtctctgttccaatgtgcaaagattaaggaattttcggactgaagaaaacaaatggctagccaatgtttcattctttctaaggcagcatcacaccataacatcaagctcagaattctgtgattaagtcagtctgtggttggggcttagaaagaggagaaatgatggggcagccaaggggagctaaacctgtcagtaatttcggattcaagaagcagaaaacagtggaaacagatttccacttacatgcaagacatcgcattgatgaccaacgctaacatatattagcagctattgcggtttggaggtgaaatggacatgaaaattagataggaacttatgctttctatgaggattaacgatgtttgaacaccctagaaggtaacatataaatcttttccttgcttggtttccaattttgttatttttgacatgtaattatacacacttatgcaatagagtattttcatacatggatacaatgtatagtgatcaaatcaggataaagaagagaaaaaatagataactggaattacatcaaactacaaagcttttatatagcaaaggaaacagtgacaaagtgaagagacaacatgcagaatgggggaaatatatgcaaatcactcatcggacaaagcactaatatctaaaatatatgaggaaatcacagaaaacaaaaacaaaaagtaccaaaataattactgaaacacggttcaaatgactggaagagacctttctcaagatatgaaatggccatgtaatttttttaaaaaggctcaacgtcatgaattatcaagaaaatgcaaatcagaactataatgtgctatcatctcaaccccgttaaaatgctaattcttccacaaaaccagtctgtgccttcacagggaggtcatcccgagcagcgacctacattggagtgttctgaggttacatgcactgacaggcagacaggtgatgagtctgtgtattcagtcaagacgtaacaagggaggggcttttcttcctcagtgttttcaaactacgctcttcatactgactagatatcatttggaatttcagtagttcacattagtataaaataacggaatattacattcttattatcatatccagattgttcatggtccatgtgctggcatgtgtgaatacgaaagtactacaactagaaatcttcagcattagaaaggacctggaggtttttctactccaaactctccatgctggtcaactatggttaacaatcaaatatggcctgctaatttatctggacagctcatttgctaagaatgatttttatattttgaaatgactaaatatacatccaaagaataataatatttcatagcacatgaaagatacacataatttaaatttcagtgaccataaatccagttttactggaaagcagccatgcccatctatttccatacgatctgcggctgcttacctgaccccacagccgagttgaacagttacatcagggagtatgacccacacagtatctggccctttaaagcaaggcttgccgatccttgatataatccatccctgctctgatagcctcatgacattattgtctaaactgaattaaaatccagttacagaaaactttcagtctttgggcttgagcgtgcttttcgttattgttcttgactgatttcatttcaatcttcagcaggaatcaaatttaaaagaaaaaaatggtaagtgaaatcttcattgcaattttgaattttttttctaatttgcctcgtatgagtgctagtcagaaatgtcgtattatttataattatattttagatataaaaataaattaacagaattcttatcaaaattcaaaggagacaagtcagtggtaagctctggatacaatgtcccgctgtagaaatccaaggggattgagactgagggcctgaggccatctccacctctctcaacatgtcattctggctggattgtaaaacctggctggacctcaatcttttcctcaaatactaatttgaaagtgagtttagttaggtaacattcaactctcttgtaatggagggtgcttgtggctgaggacaagggctccaggatacttaaagttttcattttattatttcctctaattatctagaccagagacacctttgaccatttttctcctattctttgacccctcagaagttactttttctccaaggcaggaaagatgaatgattttagcacttggtgtgacaactgggatcggtgttcaagttttagctttactcctaacttattaatcttgagttagaaatacttggaaattacatcatgcttaaaatgaaacagacatccacgatttggggtaatctcaccttggccctctctaaacagcagcagcagcaactataaaattattcagtctatagcataggacaaaactacataatataatcgatactctctgctctttgatttcttgggacatctaagacattatcatttaaaataggtaacattacttaaatattttagccaaacacacacaagagcttataccacatctatgaagaagaaggaaattgcaagactaaaggagactaaattataatttaccaatgacattacaggataaggctgtctcaacagaaatacttccctgttgcctattattaaagttcgccaaagagaatgtagatattggccatctgctctgagtcttctagtgcaaaagcaatgaaaggaggagtgtaatttcacatcagtatgcaattgcaatgactcctattactacaaacatcccttctatctcctgtagcacgtaactcaattctgagtgcctagcaagcatgtattgccaagttgtattggataaagttttagtaactctaaataaaatctataatcacttaaacagatattatatcttctctcgttcaaagaaacaaaaaaaaacagatcagaggtaatttccaaagttaatccatgataagaaaaaaataaaaagttaaataaacaaggataaaataggagcacaaaaataaaatggaggcacagaagaatttatacacgggaagcactacactggcaaacatgcgtcacttattttactatatgcataaagaggaaaaaaacagattagttacaacatactccaaaatacaccaggcaaaaacaaaccagtggcccaggaaaagtgaatgcttggctaactaccagttagaagtattaaagagagaagaccttttcggtttttaaaacatatttactgcatatgatctctggatatggcattgtgctgggaaaatgtatataagaaattcacaatgcatactaagtgctcttgactatctcttcatgtctaaggggaaggtagatataaccaggagcaaaggcatgttctgtggatgcctttgtaagagtgtgaggccacagcagcgaagtcatggaatccacccaagtgtactacgctacaagtgtttaaagaacgttgcaggtcacagaactgtaagtgattctgtatttttaaaaatcagaatattaggcctttctgatcatttgctgaagtatcttcatatttctttccacaaaaaggtagcttaataagttgtatctgcaaagattttgagagttgtatcacaaataaaagtgtgtgtgtgcacatgtgtgcatctgtgtgtgtgtatgcatgtgtgtgtgcgtgggtgtgttgggggtgggggagggaggggagagggggagagggagggggagagagagagagagagagagactcttttgcgtacatatccgcttaagtgaattttataccaggagaatttgatcttcgtctttaggaagaccgtgagttaaaattgtagaaaataaactacgaatgtgactttctttcaatcccttaacccatttattcttccaagacccagttaaatcaataagcttttaaggtacgaacatgctcttagttcatctacatgtctgttgctctgattgagtcataagcctttctccctgtgatatcacagctattgttccttaaccagacagtgccctcagaatactcttgaattgcaccatatgcaaaaacaggacaaactgaaaaattgaaaatccaactgtccacacaagccgaaatcttacattcttgctaatttagttagaaattattaacatgactcatgaaatgctcaaattacaaaatgagctgaagtttgaagataagtaaaattcagtctgaatccgaatacagagcttgcatatgtgcttttggtgtaatttcatcagagaactaagtgaagattttaatcagaatgactataagaagggcttgtttgctaattgtcttgtggtatttggtacagaccagtggttttcaaaaacaatttttgcagcagtggaaagctatttttctacactctaagacctccacagaattgagtataagatgtaggtgttatcgtattttacatttttcttaaagcatccttttgtggtaggcagaggaaatattatcacctctactttaatgatagagaaaagtcagatttacaactagtgatatgtctcaggttatataggtagaaaatggagagctctatctagaatctaccttctttttccctttcaacagcctttctactctataccatgcttttttatattaggtgacatagaaggcttcaacatttagcaaccaaattgtcttagaaagctgttacgtctccctgaaatttcacaattgcataccttcataatatttggctaaatggtaaattttgaaatgtggccaatttctatcatacctataaatacaatcatcagttacaagatcatttatttgacatttttcaaatgcccaaatgaatctttcctccattaagatatttatttgtctcaattgcttaaaattaaaatatgatatgaccttttttttttttttttaagtttaggttactttttaactatgtaatgttacctttaagaaaagacagggagccaaaatatattagcaaaaaggttgtgctatgacctttatactgccaaactttaacaaaacaaatgtatgctgtagacttaagggatccaaagtaatagctttggtccctgagccctggaatcttgtcttttccttgactaaagaggcttagttttagcttatttcaaataagaatctctcagccctgaaacatgacttatgagccaccactggctgctacgtcagattcatcccaaacttcagtccaaatcatcaaatcttgatggtccttattgttacaagccttctcttctttttgctgtacaattgcaaggctctgtcaagcgtccaggcacctgcctgaagcctaagtctcaacaactggaagcctcactctaggggacgccaactgcaggtgactgtgctgtctacttgaggtctaacaggctgacacacctgaggggcacacaaactgtgaaccaagaaatggagaaaaatcaaaatagtgttataaatgaaatgcacagctatgatatgctctgatttactatatctcatcaaccaaccttgattcaccaaaccacatgatactctttgcctgctacaaaccacacataaaggtaagatcaccgcagcagtgagctctcagcctgaaggaggtaggaatggaggctaatgtcctgattccacatttattcaattaacacttccacgcttacaatgagaaaaagcagaacaaaactgacctgggcaatgggctagagaattgcgagttgactcatgaaatttactagaacaaaggtgtatttttcatcactgatgtcaaggttgtccacttctcctgctgaccaaaagtcacatttgctcttctctaaatccagtggcagctgattgaatttaagtaggttatttttaaattcccagcatctagttactttagcaagatgactttgctttccttagctgtggagacactatctgccagtggctctagttccggtggatggaggggaaaggatgtgcattctaaggtgggccgtgcttacaggaccgccttccttgacacatacttgctttctgcaagtcatcgtttaaagcttcttttaataattttgcctctctgcttaatcgaaattaaagttctgtcttggctacctctatcaaagaacaaatctgcctggctcagaccagtaattccagaacttcaggagtctgaagccagaggatcgcctgagcccaggggttcgagaccagtccgggcaacatagcaaggtcccatctctaaaaaaaaaaaaaattagggaaagaacaaatgacttctaggagttaataaaatgtaccaagtttcacctgatacctaaagctccatctacatcctgtctttctaagaagtaaacattagaacgtatctttcctaacaagagatttttcaatgctaaatgtttctccagctatataaaaacattcaatgaaaatttgaggcatctccttattcgtcttgttctcctctcttctcgtctcatagcccatgctggctgttataccaagtaaggtaagaagagttacttaaaataatgtctaaaaagcagagttccatagctattactgtgccaaatttatagattaggaagaaaattgacagaacttaaattgtgagattcatggaggtagaaagtggccggtcagtttggctttaaaatgcatgttttatgcaaaaatcctgaaagagacttcaacttgttgtgggagtgagaaaggagatgagggaggtttataggaaaggcttcccaggcaagatgtcttccaagaggagacttgaatccttaggaggaattagccagacatggaaaagaaaaaggccttctaggttgagcaagacccacttgagaagatgtgaaattgccacttattttgtgcacttggaatccagcatctcaaaaggagcagagcaacacaccaggccaaggagatgtccaggaccctggtcattatatacgacaggacttgtatgtggattacgcactacagaaaccaaactgtagaaacactgacattcaaggtaacattgcctttatgctatttttttttttttttcagaaaaaaaaatgagtggcttgaaacacgggtatggaattgactaatgcaatgctgatcgtttaagttcattgtgtcccagtgtggtctacaattattcagtgttagccactctccttctactgctggaatactttgtaaattagagaatgaggtggactggcctgtggccccaactcagaatatcatttttatattaagtccacttaggttctcattgcctgggatgaataagcaagccccacttagagctaatgcaattgtaagcaccaacataaggttctaaatggaaatgaactcacctgctcatgagggttcttccaggtgatttagaaaatagaactatctatgccatcataaaaattaaaattcaacatttagaatgttctcagataattcacaaacagcaataaatatgtctgtagatccacagaaaatgagaacaccagtataaatatttccttttcaactcaaaaaaatctttaaagaatagaaagtggaaatattctccagaacatattttcagtgaatcaagtttgaagaaacatgaaattttccagttgcaaaagaatgcagacatcatctatgtcatcctttcattttccatgtaacttcattttgcaagtagctaagtttgagaaaagtcatttgccccgagtgacaccgaggagcttaacagcatactatttcccctatgaaggtcatttataaaaacgtatgcattttaagttttactttcaagaacacaaataagaaccctctgttctgagatttaagagtcatttgatggaaaccatggcagacaaatctactgttggaatgtggacatggctgttgccgtccatttcaagatggttcaaacgaactcaaacaagattggacctgtttctctttgttttgtattgatcgtcagccataattacctcagaaaatgacactagaaagatttaggcaaaatatttataagtaaatacgagcttgtagggctaattatggtaaattctaccaagcctttgaatgcaacattaaaatgactaattatttcctctggatactatttcctgagtcttaatatattagattgtagaaagagtaaaatcagatattgtcaacttcacttattttttacctgaagtaatataacattcggtttatgttctctgatatggtttggctgtgtccccacacaactgtcaccttgaattgtaataatccccacgtgtcaagtgtggagccaggtggagacaagtgaatcatgacgacggtttcccccagactgttcttctggtagtaagtctcaggagatctgatggttttataaaggggagtttccttcacaagctctcttccctgccaccatgtaagatgtgactttgctcctcctttgccttccaccatgattgtgaggcctccccagccgtgtggaactgtgagtccactaaacctctttcctttataaattacctattctcgagtatgtctttattagcagtgtgagaaaagaataatacattctttaattaaaattggtcaaatgaatccactgcatatgatctcaatataaaaatcagacctttcctaggaaatatactagatcacgaataaagcccaaagtagcatatcctgaagcacatgcataaggcaactaaagagcagagtcacgcccaacgggacaggctaaaccttctcaatctgcctttactcatttctctcagaattcacaatcaggcataagaaaaatcttctttgtgaaccacagtttttgttggggttcatggagatttctttttttgcccttcacacatttgatttacttatttgctggcttataaatggctcgatcattaaaaccagtgttcttctctcctcagtgacccgcacttaattatggctcatctggtttacagcaatagtgccagggaaaagagcatgttcagcaagctgtttttacacaatgttcatttgaggtatattagggaacttcatcagccctctatgatgatatattgtttcactttttcctaacacctgcgtggttgttcagcacattcttcaggctttttcctctccataccagtgtctatgcagctatatatcatttcagaaatctgcatggcaatattgcttccatattctcgttaacttgcccaagaacgcgcctgaaagtaaattttaaaaatttaaatgtaaaaattatagcatattcccaaacaacatgtccacaagcacatcttcagagattaccaccctgagccttccgatatttccaccttaccaacaacattgtagatcacggtgttattttatgacaaagtaaccaagttactcagtattattaaggcgatgaaacatttcaactgtataatctcttttgaggttgggaaaccattctaatattcacaaacctggtcatttcgtaactattaaaatacaccgttccccaacagaactgaaatagcatgctaggagagaacaccaaacatctgcgttagctaaaattataatacatggggtggaatgtcagagagaaaatcagagtcatgaatgtttaatcacttgatgttgtggaaaagctggtggctgcattagcactaaacatagatggcagacttcaccgtgactcaaccttaccaccttctccttgaacgtataagaacgtgtctactcaaaaaataaacacatgaacatctatgcagaatttaaaatttttgtaacatttgtatattgtcaccgtgtatatttttgaaacacttgtatttataatgtaagtgatgcaggtgtttgaattccttttatagatttcccccctcccagaaaaatgaaagcaaaaagtttatcaaacttagtattatacctggtttctgagctctcactagagggcaggtaaatgaggaaaatgtagtgtgtgtgtgtgtgtgtgtgtgtgtgtgtgtgtgtgtgtgtgttaaatatttgagtattttcaggttgaaagaaaccaccgaattccacccaaacccatgtttagatcttttgtggccaggcacggtggctcacgcctgtaatcccagcactttgggaggccgaggcgggcggatgacgaggtcaggagatcgagaccatcctggctaacatggtgaaaccccgtctctactaaaaagacaaaaaattagccgggcgtggtggcgggcgcctgcagtcccagctactcaggaggctgaggcaggagaatggcgtgaacctgggaggcggagcttgcaatgatccgagatcgcgccactgcactccagcctgggtaagaaactccatttcaaataaataaataaatataccttttgtggacacaggaacaaaccacttcatacacacacacacacacacgcacacacacacacgtatatatgatatatatacacacacacaaaactctacaaaaatgacgcgttaagagtgttcttaacagaagtagcgaattcaggtatcttctttatgtgtttgcatgtaggaaagcataaatagctcaaactcatttttattaaaagtagagtgaatgaaagggaacattcagtagtttagtaaaggaagttctccttcagtacataagtgaagaaataacaactgcaacaaaacttggtgagggaccagagtgttcagacagaagaataactgagttaaatattgcttacagaaatcattcaagaaaagcaagcatgctataaaacctccaaagcctacagagtttcctaccaatcccactccaagttaagggtccagcaatgcatctttattcattttccccctgcatgaagctctgtttctccagtgtcattcatgggtaacatgtgctactaacctggctgctgtttggaagtgaagatttctagattccaggccgaaagtagaggagctttggaggatgggaaccaggccttgccatttaaacagcgcaggtgagtctcatgatttgaatcagctgtttttttgttttgttttgtttgtagaattgcatttttttatggatgttctttcttattttttcatgatattggggtacatgtggcatttggttacttaagttactggtgtttgggagatcctggtgcactcatcacctgagcagtgtacactgcaccatatatgttgtcttttatccctcacacacctcctagtcttcccctcaagttcccaaagtccattgtatctttcttatgcctttgcatccttatagcttaactgccacaaatcagtgggaagatacaatgtttggttttccattcctgagttacttcacttagaacaattgtctccaatctcatcccggtcactgcaaatgctgttcattcattcattccttattatggctaagtagtattcatcatatgtaatacacacacacacacacacaccagtttctttatccacttgttgatttatggacatttgggttggttctacgattttgcaattgtcaattgtgctactataaacatgcatgtacaagtatccttttcgtgtaatgacttcttttcctctgagtagatacctgggagtgggattgctggatcaaatgttgttcttttgttgaagtcttagagtattttaaatatgtttcattttaaatgtctgtttcagtccatttttacctctatcctgtaagcatcttggctgttttcactgtgtctgctttattctggtcctgcgaaggtagttcacatacacctgttagtgagggcttctttccatgtgttttgtccttctcaccgtgctctccaatggagaggtacagtgagggcaccttctccggccgtgaatgactggaaccgagttcttctctcaaagcagtcttgcaggcccagcccctgaccgacttgacaatggcgcacattcctagttgttcagctatctctgccctttcctctaaaatctagaggctgaaactataatgaatttagccctttaaatctgaataaacatattactttttaaatgtcaatatgtgaaatataatagcaactgaaagactttgcagctatgtgaatatgtgaatatatgaagataaacgaatttcaattgctataaaattcttacattgtatgcagttattaaaatgtatctttactgaaggaagaataatatgaataatactgtgttatgtattacaactctgaattggtcatcaaaaccccaattcactttggtatatgatctcaaataaaatatggtacgcaaatgctcacacatgtagtgtgttcttaagtagctaagggttttcagttgaaagagcctcttacgtgctagaattagaggttcagggactaaaaagtaaccttatagatctcatctggccattgtgctttctcacatttcctcctgatatcatgcctgttgcgtaagctattcacaacaggatcgtagagctgagcccactgtatttcatcaaataatttaaatatcaaatatttactccaaggccagaaatattaagagtttatattttatcacctccaagatacttctctcctaccatcgccctcaccaacatggcattactttatccacagttcctctgcactaccatctctaagtaagttggaaatgcacagttggaaaaaaaaaatctgtcattctccatggtctgcttagtattagtcctttaggatacaaataaatagcatgcttaaataaatacaatatctacaggtttcctataactttaaagttttcttcatggtaggacttcaaaaacttaacaaataatcagaattaatttgagatcaagagatactcaagccaaaattttaaaggtatattgtaaaagaaaaatgaaaagaataaggaggatggggagacagaggaggagaaataccaaaatagtattacaaaatttaaaagtgtgagtaatatcacttaaaatttatcatattttaatgctaaaatcatagacgtataattgtagtatttataaaaaatagagaatatacttaattaaaagcccattgctagtggtgtaatgcctgaatgagactcagtttaagatgtataataaacatctccctccccttcccatggaacttctgtcctgaggaatacacagtagctgctgctgatttacatgtatacttacgtatatatgtatatatgtatacatacatatgctatgatcagccaatttaatttattctcaaaatttattctcaaaatttccatgcatgcaaaattatgatgacgttcactttattcagggatgaatgtcttctggggtgttataattttatgtaccaaatgaatgtcactgtggggcttgttgaacttttgctttaccagtgggtgtggagcgcggccatgggccagatccagctggtgccatctgacagctgcctagttttgtaaggcccatgagcttagaatgattttacactttttaatggttgaaaagaaaaagaaggggactgtttcgtgacacgtgaaaatatatgaaattcaaatttcagtgtccacacagtcggcctggggggagctgccactggctcctttccacaaggtgtatgtctccttttgcgataccagcagagctccgcagatgcagaggtgacgatatggcctacaaaacttaaaatatttactatctggccatttaaagaaaaagtgtgctgaaagtaatagtctaacagggtataactatatcatgcaataatttatgaattccttttagtgctaacttggtattttgcatactttttctaagagtagaaaccaggtatttgtagcttaatcattaaaatatctctcaagataagtgtatatgatttcaaaaagcaattaggttgcaataaagctttgtcagccaaggcaagggtaaacaagttataaatcacgtaagagtgccttggtttcagtgctcaaataacttttaaacacggttttaccaataatcaccataaacctaaaactacaggacagtgaacctttattaaaaaaactgaataattagtacattcagtactacacttccagagtcttgtgcacacacacacacacacatttaagttgacatatataggcatataatatatacatatatgcctatatatgtggcaaaatcaatatacatgtgatacgaatgaagtattccagttacacatagtatattaataaatgcaggaatactagggtagaaatttagaaggcagagttgtagcccagttcggtcactaataagttacttggttatcagcaatttcacaaaagtcccagagcatgagttgcattatctgtagagaggggtgtccctccttctgagattacttcactcttcaagaatatttaattcaatagatatattctgtgtatatatggctgcagtgcattattgtgcaggggccaaataggtacaacatatctaaacactataattatctacagaaattatcaatagggtttaaactcacaataacatattaactagagaagctttgtttttcttcctattttctcgagcaatttaaagctaagccattctttaaaaacaagattgaatccttcctctttgtctcttatagacttccccaaccttgcaaatagagatgtctccttccaatcctcttgcgcagaagagccctgtgttccttggagattacatggtgttctaaaagactgaattaactcaagagtcaatgaacctgtgtttgagtcatgctccccttgcaaatgtgtgtggttgattctgggtatgaatcctcagccctctgggttttagtgtgtttgtctatagacaggagcactgtggcctggcccacttctacattcattccaagggtccacgtcaaggagttggtaaagaacgcacaatgagtacaggctagttgcaggaacccaccatctctcctactgtcggaagcaagactcagtgcaagtccagagacaacactactaaattctaaacagcccctaccttttaaccacagtttaaaacatcaacgttcagtgaaagaatgcttccctactggagatcttccacatggttaggatgctcaattagccaaatgccactgccatcccagttgtggagttccagctctcttccctgtccccatctgagcatacagttcctctcgtctctgaccgcctgggatctcggacaagttacttaacatatctgtatgtctggtttcctctctgcaggtttggctgtgaggatgatctgagaggatgaactacacgtgagagtgactgtcaccgagtaaacgcgtggcatttgtcaccattttagggggtaacccttctcatctaatgttgatttcctgatgaacacacatctacctccctgaatttgcttttacttaatagtggtccccaaatgcatccagctccatgggaagtgcaaatcctcctcttatctgttgcatgattaacacatgcctctttaccctaattgtaagttactgcaaactccatctataaaacagtatttgtggaattaattaactgtgttttaagtcatagaagagcccgttatcataacctcttttttcttgcacatacttcctgttcctcccaggttctttgagatggagtctggctctgtcgcccaggctggagggcagtggcgcgatctcggctcactgcaagctccgcctcccaggttcacgtcattctcctgcctcagcctccagagtagctgagactacaggctgcccgccaccacacctggctaattttttttttgttttttagtggacacagggtttcaacatcttagccaggatggtctccgatctcctgacctcgtgatccgcctacctcggcctccaaaagtgctgggactacaggtgtgagccactgcacccggcccctcggggttcgtaatctcacagttcctgacacaattaatcacggagcttctggtctcctttatctatctttaatattggtaaagcactgacaggtcccctgaaagtagaattaggcttctgatagcaggtgaatttctttttaatcatttcatgggacttgaggaatacttgactgacagtagatatttgactaatatttgaagacattttaaaataaaatatttcttaaaattaatgctatattgaaaagaaaaactggatttttcgtgcccaacagatgttttgtcagttctcatgctacacactgtgtggatgctgaaatagtcactgaatctctgagctgaagctttatcatttgtagaatgggctaaattagacttattaagctgtgaggcttaaattagacaactggttttcagtggaatacctaagttactcaaaaagcaggaaggaaaaggcgtaaaagaaaatattactacttactcataaataatacaagataaagaaacttatttttaaaatattagataatgatatatctgatatctgcagtcatctgtgatttttaattgatttaatgtagcctcatgaagggctaactgtgtctcaggcactgcttctaagtaatctgaaaaactaactcattttatcttcattacagcctaataaggtcgacattattgcatttccactttacagattagaagacggaggcctgcaagatcaggtaacgaccacggtcctacaaagttaaaaagtcgtagagttcaagtttgttcctctgtgaaacgcagttgccctattttatactcccaactctctgctttgctgtcccttttgttttgtttttccttaaagaagtttcctatcagcagccaggtgcgacggcttggctcacgcctgtaatcccaacactttgggaggccgaagtgggcggatcacgaggtcaggagatcgagaccatcctggctaacacggtgaaaccccatctctactaaaaatacaaaaaactagccaggcgtggtgcggggcgcctgtactcccagctatttgggaggctaaggcagaagaattgcttgaacccgggaggcggagcttgcagtgaggcgagttcactccactgcacgccaaggccctccagcctgggcaacacagcaagactccatctcaaaataaataaataaataaataaataaagtttcctatccttagattaagaaaaagcaagacaaggattagaggtaggatacataaggaacctgtgaaaataaaggctgagataatttaattgatatacaaatgagaacagaattacaaatccaagtactttataaaaatagaattatgacagagggtaattcaatttacatgagtacagtgaagaaaaagtccattacatctgtattttccaaaggatcctgggagattttaacaaaagacttgttttttccatgagaggggatttcaaccagaacacaagcagtggactcctcctccttcaggtggactccttggccctggggttgtaactgaaccttgagaccccaagctcatctgtctgccccctgcactcatagtggtccagcagagcctggggacagagtctcaggtccgagggattagatgtaactttggacaagaagagttttgttaaaggtcccttgctgataagattacggctttcttcagagaactcttcctcatttgtctgcttaatttgtgcaatagatagaacaggatctttaatttattgtgggaagtggataatatagccccgtgaagtgtagcacaaaatagctgctcaataaacattcttttctcttttcaccagtttgctaccccctctactggcctcaagaaggaaaggacagtgaaataaaagaaattatgggatgactgataagatttgtaagagaaaaggactttctttacattgttgtgtaatcagtttttacttactgagcaatttagtttttaagttaaatttaaaaatgaaagggaattattattgtagtttgattttataatatgggatagttgttccccattggttatcagggtctctataaattcatggctcatctgagttataaaagtaatttaattaaatgtaaaagattatttcttaaactgttaggacaagtctatgtaatttaagccaaatatctaaaaactgctatcaacaaacatctcagtagcagtctttgaatagattttgaattttcagtatttacttctgctactacggaagggagaaaattgaattttctcttcagagcagccaggtcacagtggatcataatatcagagacttcatcagacactttcaacagagtaaataataggtgagagacagtttcaaacatacctaaacaggcttaaacaggaaatgccaccattttgtatttggtggatcttccatgatgaccaaggtcagtgtttctcaattttctttttccattatcaccccttaaaggagccttttcaaagtttttccctcctgcccgtcatgaaattctatactacaggtaccctgcataactgttttaggtactcgtatgtgtatgcatgtgcgtgcatgctttatacgtaagagggataaaaaaatgttctggcctccaggattttattcctgctcccctcatttagggtctttccagctctatcttccccaccaccccctctctggaggaggaaaagcatacttttattgtttgcaaagctaagaaagaagagcaataactccctccctactacagattgtaggaaacaggagcgccatctgcctggaggacccatttcaaagagacaacatcaacgtccctgggaaggacggtgccaggacatacaactggcaggcagcctttaaaaagcattacatcgctctgtgcctggttatttcacttaacaaagtgacttctagttccacccatgttgttgcaaaagacaggatctcatttttcatggctgaatagtactccactatgtatatgtatctcattttctttataaattcatcacatgttctcacttatttgtgggatctgaaaatcaaaacaatagaactcatggacatagagagtaaaggacggttaccagagtctagaaagggtgtagggcaggggggagatgaaaatggttaacaagtacaaaaaagaaagaatgagtaagacctactttttgctagcataacaggttgactgactgtagtcaataatttaattgtacttatttcaataactaagactataattgaattgtctgtaacagaaaagttaagtgcttgagggaatagctaccccattccccatcatgtctttattatgcattgcatgcctgtatcaaaatctctcttgtacttcataaatatatatacctactaaatgcccacaaaaatttaaaaaataagttattgtaaaaataagtagttaattaacattaaaaatgctttacatctcaaaggggcagaaaggattacaactttctttaagccaaggggaacattaaggtcctcttgataagactagggcccttaaaataaagagaaatcttacctaagaaaacagctttcccctcttcagttcctgtttactgttatagcttccattattgccctagtccatacaagattcatttgtttttcatgttttttccaaagtaatctatttttagtaatacaatttcctctcttgctttctagaagactctacattgtcagttaaaacattttttaaaaagataatcaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgcgcgacagagcgagactccttctcaaaaaaaaaaaaaaaaaaaaaaaaaaaaaaaaaaaaaaaaaaaaaaaagataatcaatataatacactgcctgttactaaaatcataaccaaatattgaacctaaatcaaagcacccgacaaaaacgtgcaagggatttaatatgtttaaattttactcgaaaacatttatattctaatggaactcagatgatattttatgaaatatgttctctttcaattgtgaggacattttccatattcatcagttgtaatggcaagtttacaagaaaaagtttaaatactttaagtgtgtagacatatagtgaactaatatacagcatatcatatttttattttgaatttggtagttttgctcacaataaatatttgcaccttgtctatatataaaaaaagagttttgttaatgcttaagtagtttggaatgtaattttactttcttaaagaaaaactgtaagtgtaaataaatttaggattacacctgattctgaaaactgtacaactaattgaaatgctaagattatcaaaatcatgcatcattttttcacatttctgtattttaggtgttctttttaaatgttaattttgcctaacctctggggaaaaataaaagacaacatttctttttagattgtctgttctttttctccaagtctactggccttagggcagtgctacgaatccaggcgttgtgattaaattccctgtgatatcagagacagttacttatgattgtgcctcttattgatgatatcaagcagatactctggtttctgtctttgtacttgatttgtttactctgaacactaacggtgaattttaacagttgcttcctgtggttaaaacctaaggcaaactccagcctctgatccagcctgagactttctgccacgtgctttaggctgagcttccagatttgaatagctgactccggtgaccgaatttatagtcaagtcctgattactcttggcattaccctccagaggttttgatcttttgacttttctagattccaccaaggaaacatcactaaaaatctacttaaagagtaattttcttttgatatcaaaatatttcatctttaaagttttattatttttttcttttttgaaaatgtttttaggttcagggtatccacgtacaggtttgttcatggggaaactgtgtgttgttgaggcttgatttaggaatgagcctgtcgcccaggtagtgagcacagtacctgacagatagccttccaatccatgagcctctcctaccctccccactcaggtagtacccggcacctgttgttccctactttgtgtcactgtcttcagtgtttcactcccgtttatgagaacatgcagcatttggttttctgtctctgcattgcttcacttaggataatggtcttcaactgcatccatgtagctgcaaaagacgtgattcttttttttttctgttttatggctgcatagtgtctcactttgcatatgtaccacattttctttagccagttcaccattggtgaacatcgtggctgattccacgtgtttaccattgagaatagcactgcaatgaacatatgcatgcacgtgtctttttgacagaatgatttatttccttttgggtaatcccaaaggtgggactgctggtttaaatagtagtcctgttttaagttcttcgataaaactccacagttttccacagtagcttaattaatttgcattccactcacagcatataaaaacgttacttttttttctgcaaattcaccagcatctgttgttttttttgctttttattaacagcaattttgactcatgagagatggtatctcatcgtggttttgatttgcatgtctctaatagttactgatgagcgttttttctttttcttttattttattattattattagactttaagttttagggtacatgtgaacaacgtgcacgttagttacatacatatacatgtgccatgctgctgtgctgcacccattaactcgtcatttggtttgctggctgcttgtttatcttcttttgagaagtgcctgttcatgtccttgcccatttttttaatagggttgtttttcgtttgctgatttgtctaagttccctacagattcttgatattacacctttgttggatgtgtactctgcaaatattttctcccattctggaggttgtctgcttactctgttgataacttcttttgctgtgcagaagcttcttagtttaataggtcccacttgtcaatttttatttttattgcaattgcttttagagacttattcataaattgtttaccaaggccaatgttcagaatggtatttcttaggttgttttctatgattttaattgtgttagagcttgcattgaatcctttaatccatctggagttattttttgtatgtggtgtaaggaaggggtccagtctcataagtccagccgggccagactgcatgagtctagacagttttcccagctccattttttaaatagggagtcctttccccattgtctgatattgtcaactttgtcaaagatcacgtgattgtaggtgtatggctttatttctgggtcctctctcatttttcattggtctatgtgtctatttctgtaccagtaccatgatgttttgattaatgtagtcctgcagtacagtttgaaatcgggtagtgtgatacctccagctttgttccttttgctcaggactgctttagctaatgtggggctctttgggctccatataaattttagaatggtttttctttttctaattctgtaaaaaatgacattggtactttgatattaatattgaatctgtaaattgctttgggtggtatgatgattttcacaatattgagtcttcctgaccatgagcactgaatggttttcatctgtttctgtcatctctgatttctttcagcagtgttttgtaattcttgctgtggaaatatttttcattgttggtaagttatatccctaggtattttattctttgtgctatttttaaataggattgtgttcttaattcggctttgagcttcgatagggtatagaaatgctactaattttcgtacattattttgtatcctgaaacattactgaagttgtttatcagttctagaagccttctggcaggctttatggggtgttctaggtatagagttacattgtcagtgaagtgagacaccttttcttggctgattgctctggctagaacttccagtactatgttgaatagtggtcaaagtgcgcatccttgtctcattcctgttctcaaggggagtgcttctagctttttctcattcagtatggtgttcatagatgatcatttttttgagatatattccttcaatgcctaatttgttgagggtttttaacatgaatgtgtgctgaatttatcagaggcattttctgtgtctactgagatgatcttgtggcttttttgttctgtgtatatggtgaatcacatttattgatatgtgtatgttaaaccaactttagatcacaggtatacagcctactttattgtggtgaattagctttttcatctgctgctggattcagtttgctggtattttctacgttcatcaggaatatttgccagaagattcatttttctgttgtgtctctaccagggttttaatatcagaatgatgctggtttcataaagtgacttagagagaagtccctctttctcaaatttttgggaatcattttagtaagataggtactagctcttttttgtacatctggtaaaattcggctttgaatacatttggtccaggacttttggttggtaggctttttattaccgattcaattttggaacttattggtctgttcaggattttaatttcttcctggcttaatatgagatgttgtgtatttctaggaatttatctagtctcctaggttttctagtttgtgtatacagaggtgctcataatactctcaggattttttgtatttctgttggataggttgtaatgtcagctttgtcatttctaagtgtctttatttgggtcttcttaaaattaatctatctcacagtctatcaatcttatttaatccttcaaatcatcaacttttggttttattgatctcttatatggattttagcagttcaatttcattcagttcagctctgattttggttattttctgctatgtttggggatggtttgctctggtttttctagttcctctaggtttgatgttaggttgctaatttaagatctttttgacttcttgatatagacattaagtgctaaaaactttcctcttaacactgatttagctgtttcccagagattctggtattttgtgtctccattttcactggtttcaaaaactttttttgatttctgacttaatttcattctttacctaaaagtcatttggtgtcaagttcaacttccatgtaattgtatggctctgatgggtctttctgatacgacttcatttttgtttgtgctgttttatttgtggttgttatgaattgaatttttttttaaatttattgagacttgctttaaggccaagcatgtggttgatcttagactgtgtgccatgtgcaggtaagaagaaagtatattctatcactgttgggtggagtgttttatagatgtctctgacgtataattagtcaagtgtcaaggttaagttcaaaatatctgttagttttctgccacaatgatttgtctaacaccgtcagtgcagtattgaagtctcccagtattattgagtggttgtctaagtctgtctgtagatctctatgaacttgttttatgactatgagtgctcccacgttgagtgacttaactacttaaaatagttgtcttcttgttgagttgagccctttatcattacgtaatgcccttgtctttttttattgttgttggtttaaagatcgttttctctaatatagaattagctactcctgtttgttcattttctgtttgcctgatagatctttatccatccctttacttcgagactatgggtgttgttacttgtaagacgagtatctggaagacagcagagagttgggtcttgcttctttacccaactttccatttgggtaaaatgtattttatgcatttaaagttagacatttaacccatttacattctgggtcaatactgacacgtgagaattgtatctatcatcttgctgtaagctggttcttatgtagacttagttgtatagttgatttataatgtcaatgaggtatgtgcttcagtgtgtttttcggtggtagtcattctttcatttccatatttagcatgccttttagatagtctggtaaggcaggtcgagtttcaacaaattaccttagctttggctttcctgaaaagaatttcatttctcctttgcttatgaaggttagtttggtgagatacgaaattcttgtttggaattactttttaaggatattcaatacaggctcccagtctttcccagtttgtaaggtttgtgctgaaatgtctgctgttagcctgatgggggtccctttgtaagtgacctgctccttctctctagctgctttcaagattttttctttctcacagaccttggaaaatctgatgatattgtcttggaaagggtcatcttgtataatatctcatggagattctctgaatttcttgcatttgcatggcaactgtcctaatgggactggaaggatttccatggactatatgttcaaatgtgtttctcaagtttcttgctctctttctcttgctggaataacaatgagttgtgtttggtctctttgcataatctcatatttttggaagttttgtccatttttaaaaattcatttttaatttttgtatgctcacgttgcttcaaaggagtggtgttcaagacctgagattctttcctcagctcggtctgttatacagttaatgtcaccagttgtgtttcgaaattcctgtggcaaatttaattcacaagatccagtttggttctttcttaaaatggttatgttggcttccaactcttagatcattttattgttttccttggattctgtttcaacctcctcttgtatcttgatgagctccattgccatccagattctgaagtctatgtctgacacacttcagccatttcagtctggtttgaatccattgctggcgagctagtgtgattgtttggaggcaagaagacacactgacctttagtgttactagggtcttggagtggttcattctcttttgtgaaggctaatcatcatttccctttgaagttactgttctttagatggggcattttgtttttatggtctttattgcccttgagagtttcacagtagaacaagttgggtatagctgaatgactttatttctggatactttaggggtcaaggctcagctccacactgctgggctacatgctctcaccgtgggggattaggaccaggtcagcagtttggcttctagtcccttgaggatgcgcctctgctgggctggagaggccaagatactcacagactactggcaacaggcaagttaaagttttaaatgcagggttttgagagaaacttcctgttatattttgtattaaacatatttttattctgtttaattcaagtaagcattaggtttttaaggaggaaatggagcagagggcatgtctggggatagaaaatataataaacctaaggcttcaatattagatatgggatattcccttatgcaaagagacaatatcgttataaattttttaaagcaatgtattattttttcattcatggattcaaaatgctgatttctctgcttcataaaaattcatcttactgcacaaattcacttattttctttcttacgtcttaaagttcttatatcttaaagttagtagaatgttagctatataatcattactttgtatgtatgtatgtttttatgtatttttcaaacgcctaaggtctttacggttacataatagacaaatattgttttttaattcatgttgttggactgccaagcaattgtagtggaggaacagggtcaagtaaactgaattgatcaaaataaatatttacgattgtggactgtggaggccatgcaagttaagaagggaagtgtggatttcacaagagtaatgatgacgaaaagtggtagctccgctaatataaactcattgccgtgatggaaatgttatgactgaagacataagagttcaaaggttcagcacgatatagctacaggtcatggcaaggtctggggtgaacatggcagtaggtggctgaggtggaagaaaagccctttctatctcagtgcaaagtccatttactgaatattagcatttttctatgtgcatttctctaaccttctacttgtccaaaaagagatatttttttgtcagtattagccattaaggtataagctaaagcaggaaaaagtaaaactttatatgaagtaaagatacataacgtcggctctccatttcattttattaagtctgtgggttaaatgacatcatgagaacagactgtggtagcattaaaagtgaaggaggaacgcttagtgtttccttccacatgctgttttccattgctgctgtcaaaaggtaatcatttcatctgtatttgacatatatttttgtataccatgaattagtgaactcaattcaagggcaatagttaagtgtcacttaaaacaacaacaacaaaaaacagaaaaaaagtcctctaatacctcatccaataaaatgattcaaagccttttggaggaatggctgtttctaggtttgaggtacacttaaaacaaggtgagcgtttttactgtcagaaagtaaggaagtgttaaaaaaaaaaaaaaaaatcacaaacaaaaagccacattgatgcaggcctgtcaaaggactcaatagctaactgaaagagttctcactgtccaaacctagaaaatggaggcaaaagaaaaaaaaaaagtagcattggataacccaaagtgtacaataaatatacttgagtgcatactgataaaaataaaataggaagaaagcccaatttccagtgcagaagactacaaaattatttacatggaaatatagccctcaagaaggcaaagtgtaactccccatcccttaagcatgagtagcacatagtgatttgcttccgaagagtgcagtgtggcaagaggaaaatataaagtgacttcacactggacagccctcagctagcatcagcagtgatgattcgggctcacagtgtataaccctgatttgatgtgatgagaagacagtttacctgtgtggtctgtctcccaaaaccccaaactccagtctcatcatgagaaaaacatcagacacctccctagggaggagcaacccatgataccccttgaccggtgctgctccaaactgtcaaagtcatcacaaacaagaggagtctgagaaactaccccagccaagaggagcctacgaaggtatgataagtaaatgtcaagtgtgatccagggacagaaagggaacattaggtaataaccaaagaaagtatgcgacataggatttttagttaataacgtgtcactgttggtttattaactgcaacaaatgtgccaccagaatataaaatgttaacaacagaggagacagagtgtggagtatttgaaaacactgcaatatctctgaaatgttcccataaatctaaaactgtcctaaaaaagtttatttagcaaaaaactttcagaactactgcattattcctctcacttctattacgtactcaactcttatcatttaatttcatcttatttaattttcctatgtgcgatggtgattcatgaacataactgaaatttcttttctaaaaatattatggaagttatgatagtttaatgaaacgtttcactttaatttaattagaaggaaacatttctatactgtcatctttccctccggggaaggaacactgtgccatcttattatcaggttctccctggggcactttttctctttgataaatttgttatagtcgtcaaagcctggaagacagtactagccaaaggagcttttctatgtatatgtataattctttcttttgctttaacgcagaagctgttagtgaggtattaaaatgaaaatttcccctttctctctatacctagaagactttagtgtctctactgagtagacttgatatataccattaacggaaaagccagtatgaactatgacagaaattaagacagaattctcagtaaaaatacgtgatcaaattgaacttaaataatataatcaataatgaagtgtatcatatgtgaccgaagcatggttttcacacctgccattttattgacccatcagctggataagtacgtccttaccctccccttttagatcccccctctgagttccagtccagggttagctttgaggaaggattaacagcagtccccacaacatcatcaccatcactaacgtgtgagttaattttttttaatacagcctacctactgttatgctgtattagagtacaatataattacagtacaatgtaatctttttctttattttcagaatctgattataggtgtcaggggatatcagtaataataaaaagaaagtcataggggctgaaggcacctgaaaaaactttttgtagaaggaatggaactttatctgtcctacggagtgaaaggaagacagcttgctactggcaggagtgaggagagaatgcccacagcagatctagagagaagaggctggtcagtcccactcaagcgactcacactgtccaggaatgagccatgggaagacaagggaagcagctaagaaatggtcctgaaagccaggagcatgaagttgttttttagctggatgttttctgagtagacggctagattataaaggtggcatttaggaaaataagcagctgcatccgtgtctggagcagactaagcatgagcagcagagacgtccaagtggttcttgtctaatgaatggccacctgctctaggatggcccaggagaggatggcaggaaaacggcctgctgagcaaagtctagagtgaatttaaagaacctaggggctaattaaacacaggacatgaagctgaagaagagccaatgatctgttccaggtttctaatcagagtcttagaaaacaatgattaaacagacaaaggtggggtggggggggggggcgatagtgggggtacgggcaaggagcaatagtggggacagggcagggagctagagcaatttgtgaagattaagaggctgttataggtagaaaaggagtgatgaatatttccaggcatgttcattggcagacctgaagaacgaagtcaaaaatggcaactgtagataggtgaaaatacagtgttagggtaaaataacgaaagcaagaaatatggagtgttttcaagtctttgcccacggggatagatagtttggatggtcttagaatacataaaacatgcagttgtccataaacagacttcaggaaaagacacaaaaaagtgtcatatctccaaaagcacctttcttcctggtctgtcaggagggtgatcatcctattcaccatccacacaggggcacttttgagaggaaaacagggcattatattttggaataatgagcacaagcatcttgtactaccccaggaaaccagagctgtcctcacccgtttgtagttttacagtccatcttatggagtctccttgatgggcaagtgacatcagaagaatttttttttcctccttaacattttagcccacttcttactaacattagcatttcaactgaagactcctactgaggaagaaggctcactggctaacagccacgtggaattgtggctgtgggatggtcgcggctggtggaaggataagggaggaatgcccacagagtgagaggggtaattaaaggtctgcatgactgttttcttcctcctcacttcccgactgcctgcaccatgccctgccctgtctttgtacagtgatttccccctcttcaaaccatcctcatacattttttaagagttcaatgtttttaagccaaaacagacttcacagtcatctaaataaaagatgtacacaactcccatcaaacacaggcaaatgccttcaggatacggccaccacctcctgctcttagatgtgcagagagtttcctggcaacctccaggccttgccaatgctgcttatcccactgtttctgagagcagccaagggattgtctatggtggaaaatgcccgtctttaagtcttgatatctatactgaagctagagaagaaaatttccataatttaatatatcataactaagtaggactcagcttatcaaaagatatggaaatgcactgcaaactttatgctctaacatcaagtgtgcttaacaactgtatcaaaagaatttattttctgctggctctgtttgtcaataatcgtttttgacgttttcctatttgacaatactgatagcattttctctgatggtaagaatgacctgtggccattgtagaaaatttagaaagtcaggacattttcaagaagagaataaaagttacctataatctcaactcttagaaatacttactgtgagtaaccatatgtaacccgtgctgtgattctcttgtgcatatttttttctttacgtttcaaaatattttcggcttattctgtagaaacatcatttagaaagaaaacctccatttttatatgaatagaccattattttccccacagtatatttaatcaatttttaatttaattttatctcatatatttgcctgtttgttgttgttacaacattgagttagtctgacaatttttaggggggaattaaataatatttcttttcagaagggttgcattctatagccgtgctcatatcacaccgttgttaacgctgaatattaattctttaatctttgcaaactgattgcattttaacttgcactgctttattcacccagctgcaatatttttcagcctgtttgataaccaactctattttctgttgtccgacctctactttcatgttcctcacccctgtgattttgtcttatttgtaagtgcttctctgttatgcatttttacaggtatttgacttggattttgtattttggacacactactgtactgcaattttatggaacgggggtaatgttcactcctccactcaccgcacaggtgctgagcaccagcatggcagaagctgtgccccgggacacaggtacagtggcaagtgggatggcctcgtcggtttcagattgttctcctggatcattgcttctgttgctttcatacatttcattcctctttcttctaaattttcatatagagccatttctcctttatttttcatttttatgtgttttaaacagtgggattatagtgcatggaattgattacacatcttttggaagggctgagagcgcaaaagaggaaaataattaaccgagattagtaattaaacaaagcaactatcacccctgggacagagagagcaaaagggaggaggagaagtcaccacagcccaaaaccttggtcgggggaggcttagagcttactaatttggcttttaatggtttgcttccttttcttttagtcgttatatctaaactacttaaatctattcagttttcaatgcgaagtgagaggttaaattgattttttcccccttaaattactaacaagtcaatttgactatattttaaaggttctccaaagatcacttttggacccaggagaactaatatatactcaaagttgagtcagtaaaggtgctggactttgcgaagaagccaagtaaattctcaaagcctcaattttatgatgtgcaaaactagaggttcaatgaaatcatttataaggttctttttagcaaagtatatatttctattaagcttttaaaaatttcatctgtggcatacttttgatttaaaatacttcttactctgcccataacaactattaggctatcaggaaaaaagaatttttggcacctttaaatatccaagcgttgtacaattgtttagctttgtgtataaatatttttgccccaattagtatacttctgtaactgtgattactgccgaaatgaattgaattagtatggattactttgtatagtacttaaattgggaggtacttaacaaatggccctcataatattgattatagcaaatgatagaattgtagtgctgtcaacaacatttaaatatatttgtaattcctttatttgtattccctctaatatacaggtaagtgtaacacccactactcattcaattacagactccgaaggtgaagtagatgcaaaacacagaagccaaattttacgggtggcatggagtgtacatgcttcaatatttccattattcacttatactctagatattgcgactctaatcggcgtccaacgaattagtcgtgttatgtactgatgagatttccttaaaattacttttctattaacatttgtcaatacattgtccctgttatataatccatgcaaagtaactattaaattgttataaattgctgtttttgaactttgacatttaatgaatgtaggtggaacataatcatgagaaattagctcactcgtttgcacgcaagttggcttaaaacagaagagcatgatatcaattgtaaaaatctcaaaaattattctctgtctagcactctgtctccctagtttttatcccctttatctctctctctctctttctctctgttcatattcgctgaagtcaccgtgtgaccattcttccttttagctttgcactggtcttcaataagtttcaaataccttgagtcaaaaaggatgctaaaacaagagtttgaagacaaaaagaataggtggatagcagctgctggtttaatcatccccttcctgtccctgctcaaatgttgaaacctaatattcagtgtggtggtcttagaaggtgaggcctttgggagattatgaggttatgagagctctgctctcatgaatgggattactgcccttgtaagacgtcaagggagctttttccccttctgccatgtgaggacacatagaaggcataatctatgaaacagagagtcagccctttctctagttgctgaatccgcaatgcttgggtcttggacttcccagcccctggaattgtgataaattcctattatttataagccttccagtttatgatattttgtaatcacagctcagatggattaagaaagtagcaaagtatcttcttcaaaatatccattaactgcagaggaaaaaaaaggaattttatagtggagatattcagcctacaccaccttaccaagtaattaatgttaacatcataagtgaaataacagatatatcagcccctgtaatttgagacactggaaatggctgatttattctgtagtattctgcccccaagttcataaattcaaccaaattatgggaaaatatcagaaagcctcaacatgtgggactttttaaaaaataggtgaccagaaatcttcaaaactgtcaaggtcaagaaagacaaggaaagactaattagctgtcacaaattggaggagattcaggagacaggaggaataaatagaatgtagaattttggaacagaaaagtgacagtggcaaacctggtgagttccagtaaagcctgcagtttagttaataatgctgtgtcaacattaatgtcttcagttttgacaattgcattctggttaatgttagcactggaaggcaagtgggtgaagtatatataggatgtctgtattatttttgcaattttgtggtgtctaaaattatttcaaagtaaaaactgaaaaatgtttgcaaggtaagccatgagatttattaacaccaaaatgagtctgctggactttttttgaaattagttcttacaggggaagagggcaatgaagcaacaatggcgggaagagggcaatgaagcaacagtggcagaaagtatgataaatgagaaaaatctatggcccacactttaggtccaagtcctccagtcaaaatgttgacaattctatgaggtaagtactgtttgctgaaaaagtgatccctgctaggagacagtgatgttcacatgctggcatgctgatggaagccgtgttccacacactggacgtgaactccatgagcgcggccagcatacactctggagatggaagagtcgccactttgtagaaaacacatggaatagcatcagtattgcagagaggactgctgaaactcaatgtgggtagcccaaggtataaattaaatatccatcaatccatatgaagataaatgattgggataaaaagtaaatgggagaaaaataaaacaaattccttgtgttgaattctaaatagtttctacatatctgccctcagaaggtggcatgtaactcccttaggagggctcccagttacttctttccagactacagtatggaaaaaggacaccagagtaaccttgcagtggacaagcctgacaaacacctctgccaggtgactaaggtcagcatctgcagtgctgagccacagtgatagcacaccctccttacattgtcatgggaatgacacttcacctctagttttcctcccaaaaatctatagctccagtcaacacatgaggaaaacatcagaaacatcacaatcaagagaatttccacagaatggtttaccagtcggcctccaatctgtcgaggtcatcaaagacaaggaaaacctgagaaaccgtcacagccaaggggagcccaaggagacgtgacgactaaatgccacatgaggtttgggatgggacccgtggatggaatgagaacattaggtgaaaactcagaacattcaatgcggtacggactgtagtcattaaagtgtcaatatcagttcattaattgtggcaaatggaccatactaacataagacattaataacagaggattgtggatgttgtatctatgggagcacttcatactgtcctcacgacttctctgtaaaagtgctgaaacaaaaagtatatttaaaaaactaaatcttgggagcaaggcacattaatttagaatgtttctgtgtttaatatctcattattttattagtatattactatactttttatattttaggtagtaataatattattgttttatacattttgagatattctatccacaactgataacctgtggttattgttaacccatttcccatttgggaaaagaaaaagcgtatctcactgccagaactcatttctcagggcaaatgggaaatgggttaaggaatatgtgagtattgtgggttatattaggttggttcaaaagtaattgtggttttagccattacttttgcaccaacctaataaaatgtcagtgacttcagaactaaagaagtcaatttttaaaaatatgtattacagttctctacggtactgataaaatttgctgcacggatttaaaatgctgtcccagtgagattaggggagcatctgagtgaggaataaaggcgtcaaaacagccttccagaggttggggaaaccactgggtggggaattgcactggctattcattcccaacacaatggatgaggcatctggtgaccctatgaccctgtggctgtaagagtaagcaggggtggaaaacccatgaatatttcctgacgtaaaacccattgaaaagggggtgggggctggtgccgacgtgtgctaaagatcattgtcttccaactggcaggcctataatttggacaaaacaaggtcattatattgaggttggtagggaggaggtatttttggagatatgattgcaattctgcccaaaagcaatgaccacttccccttggttcccgccctgaacacccactgatccctccaccccttgtaggcaaccatcccccaaccctcattccccagtgttgtgtgggagaagcagatgcgtcaacatctccaaagttcacgctgccgtggatggactttaggcttcgatgctatgtttttttgttttgtttttgtttttttcctttttctagttgacctttttctgctgatgacttagtttcatcttttctatctcctgcttcaccaaagctcagcatcacctaggctctctttgcggacctttttggttccctgctatacagtgatcaagacacttgcccactgcagggaaaacaaatttaagtatgtgtagaataactgcactaagtggacactctctgtggtaaaatgaccggaccaagatccctgaaaaaggaaatggtatagctggggtctgaatttctgttatgcgacaccagaactgggactctcagccatgactttcctcttcttgacacatagcactgtaattaatatagaatgcacttcaataaaggacatctttgacaaagcaaagcatgcattcttcatgggatgttattatataattaggaagaataaaatatccccttcaaatggaaactcaatttcattaaacaaccattaccaaagccataaagatcattgacctgacagcactggggcttattgagttctttatccagaaaaaagagaggagttatatgtgcactttctcaccagtgctcatgactggtcgaccaatgacacacatttcccagataattccggagaggagcgcatggtcaatgaatgaagcaaattagctgtcctattgtagtatagtctggccttgttactttataatatagaccattaactctacattccaaccacctaaactctctgttcaccgctcttcttttaaactgtattgcaaaaaggattataaaaaaccctctgagtataagcattcctttaaaggaaagttaaaagacttgagtatccattaaatcttaaaggtcatacatataattgcatctaagtttaggaaaacaagtcttcacatcaggtcttagcataaataatgtaaattaagatacatttgaatttactggcttctttgtttttaacgctttgcattgttaggtccataaacattctgtgtctaaaagaaacacaaaataataatgatggcccctcagtgtcagatgcattaaaccaatatcattacattgtgacaacgaccttacacattttgcctacaaggagctcaaggcgcagtaagattaaataaattgttcaagaatacctagttaataagtgggaaggtgtacattcattttatcacctaagctgcatatacaggggatgacaaagaactgagaggtcgcaccatcgtctgtatatcagcgccttcagtaagaattggtggaatattctggtctctgtcagcattaggattcgggagtaatagctgctccatgattaagcaatgctatcatcctctattatgggctttcctgtgtattaaactaagcaacttgatgatttgtttcaaaatttctcaccttagctccagatgacattcagaagtatataactctgagtactgacccagtatgttaatggtggttttggaagtagattctgagcagcattgtctagtacagtttgtattcctttccaagggcaagataagaatgttaggcggtgggcatggggggatctctgagtcaaagaagattttatgatgagagagttttcttttgcttatggaaatgtttacttgggggctacatttactacatgccttgcctcatttccgttaagtccagccagataccatgaatttcacagtagttcctaatacttcatacacagtgatctgtcgtctgtaattttattccaggacaccaacaagccctggctattgcagacaggttgtggtaccagaagcatttataaacctcaaatctgattacagggccctgaaacatggaagtgtttaataaagacgtgctgattaaactgagaatcaactatgtacttcagtgttcagagaaatattccaaagaaagaaaccaaaatattacagtgtgggaaacctaataaaaaccctgtcccatgagaaattccacatgtgcagataaaaaaaatttccttttctatcagcatcaccattttttcaagtgtcaaatgctacatatataataccaaattattgtgaaagtggaacttgaaaataataacatggaaataaacagaattttaaagaagaaaatatcttaaaatatattttagatactcataaatgtttataaatatgataccgtgaagaaaaatgcgttctcttttatggaaacagctctctcaacagcataccctttaagtagcacttggacaagaaggatccagggaccaccccccgcctcataacagatgtttggtcttgttcagtgttgttttttttgcaccgtctcagatggaatggtgttcctgtcacacctaaagcatcaacacaggcttcagcttttatcatacttgagcctcctcccttgggaatgccaggattctctaagaaagacatcctgctcaagattagaatcaccacactcctatgatttcaaacaagacagaagtgataaattacagacttttttttttgccattgccaacatggtaaagccttagccaattaagatccataaagggcagttccgaaatctacctcatggcaacgcacacaccacaatgcaacgcatctgaggcccatcactatgaagctacaaaatattaaatacttttggaaaatatacaacaaaggaaaactaatacattctaaacacttgctggttttttcaaataaagcttcttctatctactatctatgaatttgttgatcaaatagttgatactgtgacaaatactttattcaatactttatgaagtcctacccctgtatcagtgctgtaagcaatgctacttagaaaaggcatacatttctggaagaaaaataaaatagaagatttttttttgttattcaacaacctgctatttcatattccctccaacattaagtagcaacagacacgagtgggcctttcccagggccaaggcacgtgcacacactctatggagcaatgttgtgccacttcacatcagcaattcctaccggtcgggcttcccgacttcactaatcagtcctacagaacatcaaaattatgctacctaatttgagtagagaaagaggctactgtttgatcttaacaaatacaactgctctaatttctggtgactatcaacagagtggctggatggcttccagatcaaggtaatcatcttcacatcaggaaatttcctctgtcacccaggatggagtgcaatggcgcaatctcgatctcggctcaatgcaacctccgtccccctggttcaagggattctcctgcctcagcctcccgaagagctgtgattacaggtgccttccagcacacccagctaatttttgtatttttagaagagacggtgtttcaccatgttggccaggctggtcttgaactcctgacctcaggtgatcctccccgtctcggcgtcttaaagtgatgtgattacaggcatgagccactgcacccggccacattaaaaaagttcttaaataggtgtttgatgtttattcatcaggctttcaaaatactatctgttcatgttaaacaatgatgtagtctgacaggcagtcacctaaaacgggcccttcactgccacaaataaccgacgtggccccagccttaacatttgttctgaagggcaaatgcatgcacttgctacagcactgatttcacttagtacatgtttcttttcttagttttatttttaaattcatatttaaaatagatatttggagcttagtactaccgtattagtagtcttaagaatattaatctcctttcatttttttggactgcacattactacagtgtattgtttttaaggagtaagaatgttattaattgctgatttaatgtatttatgaatcagtaacagatgcaaagacaattggcatcatcctgtaggcattatccaaagcacatgctaaaaatagtaatatagtatttttatagagaaaattcaacccatacgttgaaaattataaaaatctaaagaggaattcatgtcgattgtaatggttgtttgtatttgtagagtgttaatgtctcatagcttaaaaattattttgtgtttctgggaaactgttaaaatctggatatttaaaaatatatgcttaaaaattaatgccagaattttctcagaaccagttctccaggaattccagagtttctcacccctcaacattcagatacccaacccagagcatcagcatctttcctttaagttcatttcctctgtttcattttaactttccctttttttatcactacgatttctccagtctgtgccatcctgtcttctctgtgataccttcttgtgtttgctcttctctcgctgtacccagaatcttgacttttacccgggaatttcaaaccttccgtccctggttatgacttccatcccactcaaacaatacacactatcagacattctcctaccttccatccctggttatgacttccatccaactcaagcaatacacactatcagacattctcctaccttccatccccggttatgacttccatcccactcaaacaaaacacactatcagacattctcctaccttccgtcctcggttatgacttccatcccactcaaacaatatacactatcagacattctcctaagttccatccccggttatgacttccatcccactcaaacaatacacactatcagacattctcctctctttacatgtccatcaaaaccaccttatctcccagtctccaatagagaatctcaatcccattgcttgtctaactctaaagaggaacttaaagcaagcctaaaataagtaagacctataagagagaaaggcctgttacggcagggcatgcagtttatatttaatcagagagaccctggcaagccatgggagttatctcagcctttcaggaagattacctgatgagcccttgcagaatgtattgcagacaaggatccagatggtaagggatagctggcagagaagtgctaatgatgactttaattaggggtagaaacagttggtttcagttgaagagatacaataaaaaaatattctgggctcttgggattaatgtaaagcggaaataagaccacagcagcaaatgttgaatccctcgtggatgactgaaaaaggtatagtatcatgaatagttaaaaggaaacttcgaggcagataatactattgatagaaaaatcatgaagtgtaatatgttacgattatctattgtatgaatgaaaggacagtaatcggcttcatttgaaagggactgagtttgagatacatgggggatatccagattaaaaaacataaaacggatgcacagaatttcaaaagccaattaatagagttaggataaatggaaagtttctgtaaaacggaatgaaggaaatttcttaatttggaaaatgagttaacacaatgccatcttgtggctaggaggtatctgagtgtcactcactttgtctaaacaaatgtaaatattttatgcttcaattatcattttcttaagctataggagcagactttttaaattaagtcactctacttttagatagtaattcctgaaacaatttaccgtaagtgacaaatgagcctacactcagaagtgcaaatttcttcttatgtgttaaataatcatggaaaatattttaaaagaattaagtaatgactcaaagcattatgtcaagatatgcttggtctccataatcaggaagttgagtgtactttcatatcatacttgcataattgttcataaatactatttctgtgggagcttatcttttacaacacgcagaagagatgcataaatccaaactggcaaaaaaaaaaaaaaaaaaaaaagagttgaatgtttggaagtatttttaagaatttaatatgaaaccatttacaataattaaaaatgaaaaactacatcaattaagggcttttacaaagagacagccttgaggcaatagtactttattttagctaaaatagacatatttctacaacatattcaaaaatcctatctgaaggcttatgagaattaacaagacggattttgaatatgcacttcaaaccgtgtaggtttcttttcatagccacaaatgacagctgtcaacaaatattctttaatgtccttattccaaatcgtatctgccaagattatataaagaaaaaaatatgactatcgagtaacaacaaaggatttcatgtctggtaatttaaaattttactctcagaagacacaatcatgttaaacacataattgaatccatttacaccaagcatctattttaccacattcctgatgaatgaatgtccacctcatttggactaatgtcagaagtaaaccaggactaaagatacagctgtctctgcccagctaaatgtaattatttaaaaacttacttctaccaacagtcccactaatgggcatctacccagaggaaaagaagtcattatacgaaaaagatatttgcacatgcgtgtttacagtggaattcacaattgcaaaatcatggaatgaacccaaatatccatcaaacaagtggataaagaaactgtgatacacacacacacacacagacacacacacacacacacacacacgaacacatgatggactgctactcagccataaaaatgcatgaattaatggcatttgcagagacctggatgacattggagactatttttctaagtgaagtaactcaggaatgaaaaacaaacatcatatgttctcactgatatgtgggaggtaagttgtgagcatacaaagggcataagaaggatacagtggattttggggactgagggggaagggtgggggggtgatggataaaagactgcaaatagggtacagtgtatactgctcaggtggtgggtgcaccaaaatcttgcaaatcaccattaaaaaacttacctatgtaaccaaataccacttgaactccaatagctcatggaaaaaacaaaaaataaaatgtacttgtttatacttggcagaaaaaagtaaaaataaaataaaacctgtctttctgtgtattcagtccttgatcctcccagtacctctggacccagcactgaataatcctgccttccctttgatttaaaaaccatttaaaactttgaaatcagctgaaacgtctcctcttcatcttctctcatccagctatttgttcaaagttactaatgctttgaaaacctgttgccatctctacgtctcttacctcacacacttgtaacataacatgttctttgtaattgttcaggtgtgacctaaccagcattaagtaagcatgcagttagtctggtcttattttacatttgcttttctcttactctacattataggaatgtttccagtgaaagtctgtacagaatgataaatattaagtgtatctgttctaaagcttttcattaatttaaaacacaaaataacatcaactggcctgttactttttctggagggagtgggctacttctagcaatactttctctcctctttgggtcatatattaagcataaatgaagaatacagaaccaggagaattagaaaatgcgatcatataactatgtaatccttgtcatccttctcttggtgagtgtaaagagctgatatgtggagggagtacttggaaattactattaatgaggtccccagaattagaccatagaaacatacgaaaatctcacataaacaaaacaaagaaacaaacaaacataatttggttagtgcttttttttctcagaaatgtaaaagaaaaatacaaaggataatatatcagtcatatactcagcagaagacactaaaatgttaatttatcaaaagaacaagagatgtttaagaaataaaacatttcaagtgaagtcaaacttctctacaaatccctccacaaatcgtagtatccacttccctccctaaactccacctttatttttaatttggggtaaacacattctaagatttttttattttcctgtatattttaaaattggcatgagtagttacacaaatatattgtttgcttctttatttttgaaacctattaaaaatgtaaagccttacaactactttatttaaagtactctaaagcataatgtctacatgaatattacaaactttatatatctcccgccctactaacaaacatgtgggttgtttccagttttccactgttataattctaggatgaatagctctgtgtatgtcctatgatatgcatgcatgatgtacttgctcatcatttaggaatattttttaactttcctagatattaccaatttgcttttcacaaattgctatactaatttacattttctagagcaatttgagaattaccacttctatgcattctcctaaacatttggtattccataatttttaatgctcagcaattggactttaattcattgtcatcccattgtgttttaatttgcatttcctgagtctggctggtataaacatgtttttgaccagtcaggtttcctcttttgtgccttcttcttggggaaaaagaaaaaccaactacttttttaaaactgtcacgaggagcaatcaagttatctcttattgaagttaattgggaaaagaaggaaaagagaaataaccataataataccacattccaagcctgggagatctaaaatgttgtcaatgtaacaggagaaataaaacatcgtatagagatatgataaatgacatattggatgtgttttatcaccaacatagttaagaaaactgttacccacagaagcgtccatttttatttatttatttatttatttatttattttttgagatggagtcttgctctgttgcccaggctggagtgcagtggtgcgatctcagctccctgcaagctccgcctcccggactcacgccattctcctgcctcagcctcccaaggagctgggacgacaggcaccccccaccacgcccggctaattttttgtattttcagtagagacggggtttcaccatgttagccaggatggtctcgatcttctgacctcgtcaggatggtctcaatcttctgacctcgtgatccacctgcctcagcctcccaaagtgctgggattacagacatgagccaccatgcccggccaaaagtatccaattttaaggtgtacctcacatgtttcatatgttgtccttagtcccccaaaatgtagaaaggtagttatcagtagaaaaccactgctaatccaaagacacacaaatacttaaaacagattctgtaactttctaccatatgtgtgtttgtacttcaggaattcattttatcctaagaatcatctgggatcctgtttaaaccccagagcactagggtcgttgtctagatcctggaatgaggacataaactgaaggcagccacaaatctgtgtttctctagggacccagataatgcctgtgctcaggcaagtatggcaagaactattcttcatcaagctgtttcctgaaaagttgcatttcatgcagtaagaagcactgtgtgcaaagacagccaccataactcccccactcactgctttcactcatctttgccattaactctaccctttcttctcttaagacatggtgtgtttccttctcatcccttgactgagctgagctatggacttgcttttccactacaatgcagaaaaagtgatgtaagactttgaagactaggctttcagagccttagtgattgagagaaggaacataaacagctaattatcagagtacatatgaacatagaactctgacccacaccctctgctgtgaccagtgcaggagaccaagccacaaccactgcatcaaccagctcagagtaggtaagacttggccagtgactttcagctaccctatttttgcccccgcttttgactccagaccaagcagaggaagtgaaatacactgctgggttgactggtgagaagtgggaagacggcttacttccacttagctcttcgccaccaccagcttccccatgtgaaaaacctccaagtgcaatgtgcctgaagccttcccctcttccaccatagggctttccctctcccctgagtttgagcggctgctaagctcaaatcatggcagctgccttgcttgttctggcaaacctgagtcaatagcctctgttctcatctgggtatgtccaccagcttctgccgagagcttcttttcagatgtcttagaaccctgaggctcccatgaagaatactgagatagtctccttgagcagaaagcacattaaaagagagacctagtcaacaccaagcatcaatcctaaacttgtgagtgggtaagtgagtcccagggttttgggggcaatgcgaccctgtgggacaccatgggtctgcagctgcatgagtgtccaaggaaagaccagcagaatctgtacagctgagtcaagtccagattgctgaccactgaaactgtcatgggcatttttgtttcaacgtgctaagtcttgaggttgctttttacacagcagatcgttctaacatttttcaatttacttgtgaggatataaactgaagagttatttgcatgtagctgataatatatcctggaataaaacacaagcggcaggttttaccatggggaccacggatatgtagggaaggtcacatgaggaggagcagtaaagagaaaatagagattaaaatcagagacacaaaattattcaaatccctcccaaaaatatgaagccaaagaacgtaaacttttaaaagaattatcagtccattggcatcaaacactcctgagccaaagaaaaggtaaagaatcacggtttgtgtgtggagatgggagtgtcattggtcactaggaaacttaaatataaaaacttgtgtaaatggctttcatctgaatttgctatgaattgaataggatatgagaaaagagcaggggttttttgggggggagggttattattattattattatttttttttgagatggactgtgggctgggcacagtggctgacacctgtaataccagcactttgggaggctgaggcgggcggatcacgaggtcaagagattgagaacatcctggccaacatggtgaaaccccatctctagtaaaaatacaaatattagccgggtgtggtggcaggcacctgtaatcccagctacccagggaggctaaggcaggagaattgcttgaacccaggagacggagcttgcagtgagcggagatcctgccactgcactccagactgggcaacacggtgggacactgtgtcaaaaataaaaaacaaacaaaaaagagagatggagtgtcactctgtcatccaggctggagtgcagtgacatgacctaggctcactgtaccctccgcctccggggttcaagcgattctcgtgcctcaatctcccgagtagctgggattacaggcgtgtgccaccacgcccgactaatttttgtatttttagtagagacgaagtttcaccatgttgcccaggatggtctcaaactcctcagctaaattgatctacccacatcagcctcccaaagtgctgggattacaggcgtgagccaccccacctggcctacaaagcagtttttaattaggtgctttagaaataaaaggaatatcacaaagttgaggcagcagaaaaatcattttctaaattgccaaggccaagaaactgaaggagaaattcagttatggttgtgaaatcatttaatagggaaaatacatagaacccaaaatgcagttttatgaatatcacatgcatgattatgttgagatggcagcagccactatgtagatttaaacatatctcatacatcctaggcccagtttcacttggcaacagctagataagcatgcagcaagagaaaggccttctgactctcgtttccaattaatgagtttggtaaagtgtcattgattaaattatcaatgttgaaaagacgtgagcactagcccagtcaccttcacactcctatactataattaaccaagaacctggaactccaggagcagaccttgaaaatctctgatccatttgccttcagacattcattgccttaaaaacagaaaaagctgcaatccttaactgatcatctttatatgccatattttcctatgtttctgtatcttttccaaagttctaggaatgtacacacatggagcacacggaacaaccatgagacatatgaaatatacctttccatcttaaatccgttagctagattgtaagatattgcctgtgtttcaggtattaacgcagaatatgccatttgccaatttgctacgtaatagagcaacacatatatagcatggctgccttcaaagaacacctcagtgaagggctaatacttctcagttactcatatctgaaacaaactcctcaatcctctcagagcactaacgattaattttccagattatcttctaagtattattattgagagcttattcatttgaactatcatccaacatacatctgtgtgttgtatacttctgagacaagtgcctaggtcttagaaaaacagtaattattttattctttcataagaaaacaaatataaaaattgacatatataatgaagttgagtaaaaatgtttaccctcctatgtttcaataatttaatggagaatgtagttattctcttgggttctaaatgtcctgtttccatcatgagctccactagaaatggttttcttagaacacaatcaatatttcgtcctattcaatatgcgatttttagtactgagtctttgaagaaaactgctcaggttctctcccttctgaaatacctctgggtgtgaatgagtgagatgaggcgctcattcagcctaaactcattgctttggagcaaatggactttggttcaacccatgtctgtggatgcccccagtagctgcaggaaggtgagatgttgtcattagggctgggaactcctgtgatagtagtagaatttctcctttctttccctattcccttgggcgtcttgctggccctgactggcttatctgttgcccagatcaaagagtgacattttctcttttcctgatcttaatcagatccatctgcaccttcctgttgatgcagcctcaccttagttttcagctgactttaaatttctggattttttcatggtcctttgtgcttctctgggctagagagtccgatacaaccttgtctacacgtctgttttcaccacagtgttcctctacagcaggtgcactgaatctcaactcacagctcaagaagttaagaaagggaagagttaattcacagttaagaaagggaagaggcacagcagaggaggtagaccctttccctctgcgtggcatatcccatatccctttcccgtgctggacagctccagggtgtcctggcacctcctgcacccacatgaacctccgctgggagacccagagagtggagctgaagccctttgtccctgctgtcctctgacactcccttagaacaacccctcctcttttagccagagatgagagaacatcagacatctggctggttttctcctcccaactgtttatcttcttttatcttctctcttactccagaactaccacaaagaagggcttttgctaattcttcataacttcagccccttcgctattcttagtatctgagagcattgtttgcattaagactaggggagtagtcccaatatctggtccagctagccaggctccagaagcgctaaagaatcataaaaaaaacaagaaaagcagtctctcatcaagaatagcagcaagattactgtttcgatgaagaatacaaatctccacccctcactccctacaccagttccccacctactgttttttttttgcctgtcgtggagctataactatctgaaagaaaggccaagaggaggatagatttcaggataaaattattaatattgcccccattatactaatacttctatctaaatgttttgataagactctgttccaaaagctagggagacataaacacaaacatgtatgatgaagagtctttgtaaaattagcagctacaaatgtttctgctgtgtaagcatttgtaaaaaaaaatgctaagtggaagaagagaatacaattcaattatgcatgtgaaccctcaaagtagatacacattaacttagaaaatgatagcatgaaaaccattacagtctttaattcggtagtgtatctagaaacacatataagtgtaattgtaagtctgacagtttttgtaaccgttgaaatattccccatttatgccattaactttagataaatatattctgttacttttaaaaatggaatgttttataatcattttgttctaattctatagaaggagtagctagctataatgttggcatgcatcacccatttctgtcttataccatctccatttgtgtttagtatttttaagttttactactgtaatgggaatgtatgctaaatatagaagtaattatttgcaaagcaagaataacatttccagttgggcacaatgactcacgccaatcccagcactttgggagaccaaggtaggcagatcgcttgagcccaggtgtttgagaccagcttggggaatacagtgagacatcatctcttaaaagtaaaaaaaaaaaaaaatagccaggcatggtagcatgcacctgtactcccagctactcaggaagctgaggcaggaggattgcttgagcctgggaggcagaggtttcagtgaaccaagactgcaccactgaactctagcctggtgggctacagagtgacagccagtctcactctgcaatgggaattgcactggatttatcgattgccaaaagcatacgaagaagatacttgcacagttaagtttatagcagcaaaattcgcaactgcaaccagcctaaatgcccatcaagcaatgagtgcataaggaaaatgtgatacacacacacacacacacacacacataaatatctatatatctccccatacacacacacacccaatggaataccgatcagccataaaatggaatgaaatcatggcatttgcagcaacctggatggaaatggagacaattactctaagtgaagtacctcaggaatagaaaaccaaacatcgtatgttctcacttataagaagtgggagctaagctatgagcatgaaaaggcataagaatgatacaacaactttcaggactagggggaaagggtgggaggcagatgggaaacaaaagactacaccttgggtacaaggtacactgcctgggtgatgagtgcaccaaagtctcagaaatcactaaaggacctattcatgtaaccaaacaccatctgttccctaaaaatctaatgaaattaaaaaaaaaataaagaaaaattattacccttctcaaattatgcacacttccccatctctcttttccctaagaagagtatataaccatctgcacgccatcacatggtcgagcaatcactctcatttctacgtccatgcatgatgatcaacatgtatgtgtttgatcctattttaaaaaaaacaagaacagctcccttctgtttatttagcgtgtgagcatgcgttttttcataaaaactgagcattagttacctaagcagaacattgttttctaattttaaatgtataagcatattcaactgaagattatctttccatgaaagaggaagtcgaaaaagatataatcttaagtggaaaagagaagttacttcattcaaaataagaaatcattaggaacatggaaatgaagaaagcttcgggagatacgtgatctgttgcagggttttcatgaaacttctgtgtgcccatgagcaatgtcaacaagcctgagactctttttttttttttttttttttttttttttgagacggaatcttgctcttttgcccaggccacagtgcagcacctgagattcacttttatttgctaatgaaacagacaatatgcatcacttgttctaagattctgctttaaattgcggcagtaagatgaagaaatagatattaataagatttcaaattaactagatttgaatctcaaaatacaaatatgtttgaataacaaagacatgaagggaaaaaccttaatactgacatgtatctcaatattacatgctaattatacaatatttataatcggaaaataatgtaatgtcaggatacatctttctaattaaaacaattttcttccaatgttctaatggctccaattgtcacaattttaagcttgttctttaaaacattctagagtaggaaaaaatgggttgtcatacacctgctactgaaaagacttagatgatttttaaatacctttgtctaggtcatacatactggtatcaatttctaacttggtatctctctagaaatatcaaatagctagtattactttatcagtcaaggaagagatatgccatcttttatgttgctaatgccacatctggcaaagtgtttagagcaggtggttctacaatgacaagtttcctgacaacagaactccaagtagctgagaatgtagaaggatgatctgtagtatgtggtgggcctcactccaaggaggctgttgtaatattgtggtgtggttatttctacttcggggtggacaatcgtctctactcttagtatgagttttaaatattcgttaggactgatagctttaaaagtttttaattatcctctttttaaattgtcttgctgcaacttcttttttttttttttttttttgtgagatagagtctcactctgtcaccccaggctggagcgcagtggtgcgatctcggctcactgcaacctcctctcctgggttcacgccattctcctagcctcagcctcccgagtaggtgggactacaggcgcccgccaccatgcccggccaaatttttttgtatttttagtagagacggggtttcaccgtgttagccaggattgtctcgatctcctgacctcctgatctgcccctcttggcctcccaaagtgctgggattacaggcatgagccatcacacccggccactctgcaacatttagctacagctttcaaacaaatgctaacagatttatcaattagtttctcatttatcaaaattattgatcagcactgttctttcacctatgaatgaccctatcttgtgtggtattttcttttcaaggtctttttatgtctaattgaaacttttaaaccataaaataactgacattctcaataaaaaataaaagtctctaattcacaaatccatttaagatgctccagaatatattcttgagaatgttttttaaaagcttcttccaggaaacagtcaaaattatttactgagcacctaatatgtacacagctttgtaaataagtatgagacaagtgttctgtaagaatctcagtcgtaacattcactagctggtgacttttagccatgtaaatgcttagagctttaagagttttgtgtttaaaatgggaataatgataaaactttgtgtgatcagcatacagattaataaataaagatgatcctagcctggaatttactatgtgtttaaatatatgacaaaccgtatttccccttgtgtgtaattcctccccacaaaaacagcaacaaaggaccatcattagtaatgagggagcttcaattctacatgtgaaaacaatttaaacaatacaccatatagtgaagtactaaattacagaataaaataattagaatagagtttcaaacataggcaagggctaaagaggttaacgtcatatgtgagaaattgatgagcctttcaaagaatgggtatgattttactggcttttcctcatgttcacgcttaagttcaatgtccttagcttaacattcaagaaactttcctctctgaatcctggccacctaactggcataatcccccttttttgtctttataccacccctggatcttgccatatttgtagttgtaacaccatcctagatgtcaacaatgtgaatttcaatcagcacatattgtagtctgcagctgaatttattagtacagaaactccttttgaaaaaagcagttttaccttgaatctaatgaagacttttgttttatacatcaggctcctgaattttcctcatgtgagtctatttctaaaagatgcatctgcttttaggaagctattaaaataagttttctaagccattaaggtgagagaaagatcccagattaaaagtgtaccaaagtagtaaatatcatcattttaagctctcatgagaagtaaaaggttggcttttttctccagacctcatctagggctctctggaccaatgtattagcaccaggttgataagcctttctttccaagtgaattcccacaccatctagtggaggtagacagacacacacataattaacttatggacagtatcagcatgccaaaagagagatctaaatacgagtacattaaaatagtgtatactctctgctctatagtaatttgtatttgggaaaatatagctgtggttagggaagtaattactgattaaatacaagccatagagaaagcagcttgaagcaagcttggaagttgcaaacttatggacatggaagaagttctggctctctggtttaatgaattaaaataagtaagatactagcaaatgggatttcgcagttcctggtcccataggaaactgttttgtgtgtgttataaattgtcaaagcttccaaatgcttttcatttatatatccatcctgtgtttgccgttccaggagcatatgtttgtacatgtgcacatgcatgtatgcagacatcgagattcattcatttgctccacgcaaattcttgtgttcagcaacatcacgagttctaaaaaagtcaataaaaattgccctctatgcctttcgtgcaaggcacagggccagccacatcagccattactttcattagagctgctggagtttgaaataggatggctgggatccagactgacctgcaatcttgaagtctttaaatttaatacaacccatattttaggccgttcaggctaatttgccttttttttcagattttttaatggacactttgtttctaagagtttctctctaatagagtgcatacagatcagtttttttttttttttcctttttaaaaaactattgatgagctcatgcttttaaaggattattagggcatttgaagaacattttttatttaatagcagaaaaattgaactcaacatggatttaccaggtgccaatcttttgtatattgcaatgactcagtacaataccaacttcacaactttattttagataatattatgtcttatattccctaagtattttaacaggtgtttcttaacatgaaactgagtccatttaaaatctgaaagttaatatacgctgagcatgcaatatgatatacttgattttaagaaaatgagtttttacaaagaaaattgaagataaccttcttcagctccacataaagcttctgtttgaagctgggagtcgaggattcatcaaaacaggggttccatccaaattaagagaaaaactcttcaaacggtttctgaaataacttaatgaatttcagcattgtatgcttatttaaaatattagatatatgtcttgaaacctgtaatcaagtcaaagtgcttttataatatttctacaggaataaaattaagtgtgctccaatcaaacccacacgtattgttattacattttattcaccaaagaggtgtatcagatgttagttgtttatgaccacaactattttatattatttggacatgttttaaaaacataggtaatttcaagcttccagtggcccaagcagcaccatcccctcacccagagaggagaacctcccaggtcagcttctaccctcccagcagtagctcccctgtctgatgtttgctttgagcctgtctagaccaatccatcatgtcctccatccctgtcacctcggtcaccacaagaatcccggattctgtgtcgtacccgaccctccatctcattttattctcatcccaaataccggaaaaactcacctcccatctaatcctccttctttgagaattcccttaacattccacctgaagctggcgtcccctctcttgaacatagtccccgcagccctgtccagcagtgcttcctctctcactcacccctccgttccctgggattggctgctcatcatcatttcctgactttccccccaaattcccagctttgactcttctgtcttcaggttactcacatgtagatcctcttattgaagccatccatcccaccctgctctcccgtgcatttgatacactggctccttgaaaatttcagcaccggactccctgccacattcctgctgctaccactgttataattcgtggtgacttcactatcctgctaaatggtccttctaaccccatggcttcctttgttctcaacctcctccccttccgatgaacttgtcttccattctctttcattaattagtcatatggtcagagaccagccctaataccaaccacatctacttctccaaaattgcgactttctgacatcccatgctcttatctctgttttgggggctcattccctccaggaacatcataaactgcaaatccaattatcattccccacggtctttgccccttctctcctctttccctccttcaaatctatacttcatcatcacactccttcccctgactgcaccctcaattcccttgttcctctctggctctgacctctccgctagccttattactgctgcgttcctgcagctgagagtgactggaagatagcatggagctaagcttcctggtctctctgtatgttcatgaccactcctctcccaagcatccatatagcagccccaaaattatgctcaattctcacagcctctttattcttccactcttgaagggagacttttatagaagatgctttgaatattacattactgctccccattctttaatcttgcaagacctatccctcatcacattttcattaatgaatttgcccattacttcatggagaaaatagaagcaatgtgaaaacagccgtcatatccttctctcacctcattcaactacctctttgcatctgtactgaatgcccttgatgctgtgagtataatgtcctcacttttttcttttttttttttttttttttcttttttttttttttttggagacagagccttgctctgttgccaggctggagtgcagcggcgcaatctgggctcactgccagctccgcctcctgggttcatgccattctcctgtcttagcctcctgagtagctgggactacaggtacctgccaccatgcctggctaattttcttttgttgttgttgtttttttagtggagacggggtttcaccacgttggccaggatggtctcaatctcctgacctcgtgatccgctcgcctcagcctcccaaagtgctgggattacaggcgtgagccactgcccccggccaaaatgtcctcactttttaaagcttccacttttacataagacattagtctgattactgaaagatattactcaaccaattttcttttccttatgagaatataaagatcatttctcctacgttaaaggcaaaacagtcaacaatgaacataactcttctcttcattccccctttctacaactattccatttccttacatttcattttagaacaaaactccttataaggaagtctctacttgacctctctaacttctctcatctaattctcttttgaaccacagaagtaagagtttcacacctgccattcgactcaaaatgtccttatcagggtcaccaatgacctacttatggtgaaatccagtgaaaaatcacctctcctcatcagtcatgacttagtatcattcgccagggctgatcacctcttccttcctgaaaggcttgagttgacttctaggacagtacacactcctaagaactcccccttttcaccatctggtctacttagtcggtgtttatttgttttcatctctctagagtctaacccctagagtaaccaaaatactcttttgacctcttcatgtcactctcttcttgcctgctgatgacctcatcttactgctagcaactccacttacgtttccatcttgatcctctctcctggacttcagcttacatttctagctgctcaaatggcatctgccattgggtgtctgattgggaatttacatttaacttgcctaaaaatgaactcctgattctcacatcccctacccacacccgcattaactccaatcttcgccttttgaagtgtcctctttcaaaacctttggcatcacccctaaaactctcctttctcaggtcaaccaatcaattagcaaactcgattggtattaaagttaaaatacatccagacttatccaaaaacactctacgccagagctttttacgtgcttttactgctttagggaatggtatttctccagaattccacgcgagtgtttatctttttctcagcgtagagctttccggaacactctatttaatattgaaactcaacctatagcctgacaatccgtatgccacttccctactattttatattatctgtcaccttgtgataggctatatatttatgtcatctatcaccttatgatatgctgtatatttcaatcatgtatttgtttatgatgtggctttctccactggaattaagacccatgagcgcagggattttgtgctgttttgttcaacgctgtatatgtaatctctagaaattgtttcagttaatcatcaataaatatttgtcaagcaacgaaagtaatttttgcaaagccaaactatgtttgaggcatattgagtgatacaaagatgagcagtggggggcaaaaaataagtttcatgaaggtgatgtttaatattaaatatgaacatttttaaaactcacttaaattttagctagtaatggcaaaaatggcaatttcttttgcaccaacctaagtaatgtgaatttatattaaatccattaatatttatcttacactatattaaacttatgtttataatattaatatttaaattttacttatattttcctatttatgtttaaatttatttggatggcacatataaatgaaagttgaatagccataagcaagacttgaactaaatatgttctatgggtacacagtaagtgaggcaataacaacaacaggcccttacactctaccagccacacttccatgcacttcacatttatttcgctcattgaatttttccaaaaagcctatgatgtcagtcatccgatatgattatcctcttttggaaatatggaaaccgaggcacaagaggattagtcattttctcaaggctaaaagctaagtaataaaactgaggtttaaactagcatgtcgtgactatgctggacactttctcaaatcaatgctgcatccatggtacagcgttcagaagagattttcagactattgccttagcattggttatttcacataggagaagtactcttacttcctggaatccaccataaatcctttgtcaacacaatgtattttactcaaaggagactaacccgtggttttgcatcaatggaaatgcttagcttggaaaagagaagtcaaaaaaggaaaatgatattatcatagcatattgaaataacttccacttagtttttttctcattttttttttcttctcaatttcctaagaatagaaatggtttagattctggcacaaactacttgttacctgcgtgaacataagcgagtttcttaacctcagttgtcaattgtaaaatgaagattttaacgcccatctatagttgtgtttgaaagagtgaagtgaagtcaatgtgcaacacccagcacagcggcttaacaaaaaattatagtaagtgccatgaaaccatcaccatggattcagaaatacactatacaaaacgtgagtttgtttgttgacaatcaaaaaagaaaaaaagaaaaacaaggttttgcttggcattgcattatcctcgcatgagacacatcactcatcgctaagctccataaaacaggatgtgtctattgcttcttatgaaaccatctttgaagttagtgcaccaccagacaccccagaaacagtttaagctgtatttgagtttgttgagtgattttagacacatgccctgggcggagcagtgcgtgcctccaagacacagcttagaagtgatccactcaccactttagaaatgcatgtggttatttttggtcaatcctaatatttgctccaaggagcatctcgtttcctttaattagtatcctgagtaatgccttctgttctgctcgcctgtcctgtaacagacatggctgtgacgagtgagagggcaattcattcagactggcttgtgttagaactggctgctggaaacaatgccagcaactttatttttggtctattagtaaaatgacagcactaattcatttcacagcggaaccaaacagctgtcagatggcagtgagcataatcgtgcacacattagaatttagatatgctgagtaggatttttccactggcaccgcattctactgtaatgtgctccaaagtccccccaaatggtgcaagtggctctcctggtgcatttgccctcagatagtgcaattcaaacaaaacaaaccctttgcaattgggcttccagttgtgaattcaacacactcaaaatgacagaatttagggaaagagagatgacaattagatgattcatgaaactcaacttttacttccccaacctcataaaaatgataccccaagagccacaaatttcaaatttctgataaatctactcatcatcctctgggcattaattagatgggaacaaggaatttgactagttgatattacttttcattctaagaagtttgaggagcacagagtcctgccttctgtaggcatatgagcttctgagacagataagacacccacaccaaggaaagtgaccggaggctgggactggccacacaacaggaagcatgggcactcctcctggccatgccttacacaaaaactacacaaagaaaactttcaacaagcttgtgatgtccaaatgataccagagaatgtattgtttgccaacaaagaaaaaaataatttactagaactcctgagtcatctggtgtttgatgaaggtgactaacaaagttgtcttgtcagttacagcaaaactattaaaatgtccactgtaaatacagctcgtattgagggccatttactttctctattgtgcattgagaaagtgggttaaataacaagaccaagctgacttaaaagggaagagtatcttgtttcctaaacgaggaaaatgttctagctttagggttgggattccacaccatagctacgggtcccctgtcttggtaaataaagatttattgaaacacggccaaggtcactcaagtattgtctatggcgctttcatactgtagcagcagagttgggtagttaccacagacaccagatgagctgcaaagccaaaagagtaactctggccctttaccaaagaagtttgccagtcctctttagagtgatcacccctgaattccagctcttctatgccacaggatgtcaatggaatgtttaaaaaatgaccttaacttttggagtaatttcataggaataaaatcactgctataatatataagggatgaaatgaaaacatatacaataacttttttaaaactcaatttttactatgactcttgtttaacaggctagaaggcaacttgtgtttaggttgctgcaaattcaaacaattgaattaaatgtgattaaatcaaaagtatgttgtaaaacgtaattttgtatataataaatttcattgtactctgttgtatttttacagtgtttaaattcagagtacagatatcttgtgctaatttcatatagtaatgtataaatgaaatgatacctcacttaaatttctaggaatttcagtgttaaatatattggaattcattgtaaatacaagttaattagtgcctttgtctttgtgaacttcatacaaatttaaatttgttatcacgatattcataaatagctgtagtttttccatgattcatgcatgtaagcattcctttaaaaacagtcaagtaaatacagaaattttgatacacatgtcagtattgtggcatatgagaaggttttgaacaagtgtgaaagtcttaaaaaatgaaaaatcagatgtggaatgttgaaagctcatatttatgagttaagatggataacacatccaaagctgaaacgtgttcagcatcttattcctgcacaaaatctcccatttgttatcctcctacacccggcaaaaatcacaggagaaaactgcaagtccccacacaccagctgtccacttactcaccctcctcccctccccaaatgtagctttccattccattattctaatatttaaaagcatgcttcacaaaaagtttatgcctgaatggaaaaacaaaatggaaacttcgagtacacatgtgatttaaatgactaccaaagcttagtcagatgtatacaaatcagtgttgcaagttgacaggccccaggccattcctccttccttattggtggtgtttctctctcctcagaggatatgaaagaatataaggttatattatgaaagaaccagtgtcaaaaacgtcttcaagtaagctacttaaaacaaactgggaagctgtctggaaagggcgtatcatcctctactgtcaaaaaagaggcattttaccctatgaaaggattctccattgatcaggttttaaagaaaagaattgggagaatacaaataactgcatgaattattgactgtttttaatagcttaattttacttctttatctcaagcttctaaacaattcttggacataaagattttcctatttagatttatattactctgatttgcaccaatgaatgaaaagtgaaggaagcaattaagaaatgtctgataatggaaaatgtactctatatgacaccatttcaagttgatcaattaaatcaatagttcattttcttgaaaccaagaataagcccatagttgaccagctctcagaatatgaaccttgtagaggtcaacagagtatctattgtgcaggtgaggccatcagctgccatttttctggctccatttaaagaaaaaaaatagcacaataaagggggaaaccttttagactaacatatcctttgaaaaatatacttacgtttagaaacacagatccttgtttgatagtaaaccatcaactttaggtagcaagaacatcagaaatcataaatttacatgttgcattcaaattcagaaagggaaatgaactgtgaattctttgccgactgatttaagaactctgaagacaaaacaaatatctgtatcactttgtcatttgggtgcacattcggcattgaatttattggatagcagactgtgaagccttttttaaagtttagcatctgcatatggctataaattatatttaatgtactatacctgtattttacaaaatgaccttcaaatgggagatttttaaaaaattatctacaaaatggaaatgaatttgattgatgaaattcgaatgcatttttaccttaacttacatacttcctacttatttccagtgttctcggctttgtgttaagtcaatatatgtgttttttcttctcttaatccaaatctatgtcattctctcacatcttctcctcgaattgcctcagactaacaaaagataatttaccctttctcagtgattttcaccccatattcttgtcattttagaataaaaacaaatcaacaacaaaaaacagcaagaatgcctatctacctaagttgatatttgagaacaataaaaatgtaaccctaaccaaaatatgtaactaggcagctcattgttaattcagaacatgccactcaacacttcagcagggatgaatttgttctgtgtactctgacttagaagagtatagattcatcattatttgactttttttcttttttttttttttttttttaacacataaaccagataaagagacaaagcacagagaaggagaaggtggacacaggcttcccaagatggcaaaggaacattagcacagggcataactgttccaggagaatgtaatatcatacataatttggaagaaataacaataccgtacttttagtttgtttgtctttgagacagagtctcactctgttgcccaggctggagtgtaatggtgcaatcttggctcactgcaacctccgcctcctgggttcaaatgattctcctgcctcagcttcccaagtagctgggattacaggcacccgccactacgcccagcaaatttttgtatttttagtagagatgggatttcaccatgttggccaagatggtatcaaactcttgaccttgtgatccacacctgccgtggcctcccaaagtgctgggattacagccatgagccaccgtacccggtcccatactttataatctttgaagccatcttctaggctaatctaggccaaatggaaggagaaattaaaagttttctataccagatactgaaccaaacagtttaggtaactaattctgtaagcctcatgccaactctctaaggtaggtaccatttatttttcatttcacaagggaaaacaaattgaggtaatgagcgcttagtcaccagcacaatggtcacactcatagtgactgggaaactgcatggaacccacacctcagaattcatgtgcttatccacatgtaaatatttaaattaattttccctaacactttgcatttctagcgtccagatagtatatagccaatatttgatggtgtttaaatagaaagtcatctgatttctagttactgtataagagagacagaaagagactattagacatcatccactctcatttttgcttattgaagttcattttaaataatgaccaatttttgtttttcatttatctgaaattatgtattaccaaatgtaatgtatatgcatgtaaacatggagaaatttgcccctgacacaagagtatactggaaaaaaattaataaaaaaatcttgggagagaagtatgtacagaagataaaattatgattaagatgaaaaatattaagaaatgaaagtataacaactcatgagttgagactcccctctgcaatggtttgaatatggtttgtctccaccaaaacatgttgaaatttaactgtcagtgtaataagtttggaaggaggagggcttagaggttataagttcaataagatcaatgaatgtctttctcttcagactagatttgttctagtgggactaggttagttattgaaacagtggattgttatacagtgaggttgcccctgtgtcttacctcttttgcattcatgcttcccgttttgctggtccaccatgtgataccactccacccgtttatgaggaaacccaaggccccctccacgtgtggccacctgatcttcaatctcccaacctccataaccatgagatacatctctttcctttataaattacccagtctcaggtaacacagcaacataaaatgaactaggaaacccatcaagtacaaatattaattaatacatattttgttactgaaaattgattatgaaatgggctctatggagttaacttgccctttactatattccttttagacaagtaactatttctgtgagtggatttctatcaagagcaccttgatttcttacattaaaaaaaaatcagccacagtgctggtcttagaattcattaaccatttgaaaaaatacacagcaaaggacttttaattacttggttctatttttcattcaaattccaattaagagccagagatccacttaacaatattcattcccacattatcatcagacatttcttaactctatagtattcattaattaattttttctgtgctcattgcaatgagctaaataacagttatacggagaaaaatacagcaatccttccacctgctcattccattcttctcaaacctaatttattttcacaattcacattttctcctacacgtttctgaatgctcacgaaagcatatatatatgtgtgctatgtatttgtacatatagacgttcacatacctatccaagtactttatcttttcaccaaaatggaatcacgtggcatatgcattcacatagctatgcaaatacttttatttatatttttaccaaaatggaattatgttgcattttttttcactttaatgtaccatgcacatcttctgaggtcaatacacataggactaaaaggaattatttttaatagtactagaacttacgatttttgatgaaaagtacacagcaacatagctaagggtgtgtgtgtgtgtgtgtgtgtgtgtgtagccagggcaaatgattagctaaatatctcaatgtgcctctgatatagttcagatatttctcaacgtgcaagagtgcgtgcgtgtgtgtgcatgtgtgtttagccagggcaaatgattagctaaatatctcaatgtgcctctgatatagttcggatatctgtcaacgtgcaaacctcatgttaaattgtaacccccagtattggaggtagggcctggtaggaggtgactagatcatggtggggcagatttctcatgaatagtttaccaccatcctctcggttgctctcctggacacagcgcaaaagattcaccaaaattgaactgaaaagtgtgtggcacctctcactcctccccttgcttccgcatttgccatgtgttgcgctggctcctcctttgccttctaccatgattggaagcttcccgaggcctcaacagaagccgggcagatgccagtaccacggttcctgtccagcctgcagaactgtgaaccaattacacctattttatcggaaaattacccagtctccggtatttctttatactaatacaagaatggactaatacagcctcacaagtggaatttctcttaatgaagttgcaatggtctattccaacggaatcagaaactagattttctgatgctaagattttcagggttaaatgtatattaagttcacgtaaccaacatataaagacatagtgaaaagttaataaattacagcttataggaattagactacttacattgatacctatactgatatgacagttttattatttttatttaactcactctaggcctgtatgtgaaaccaaattgtaatggaagaatgcctgctcaaacaaggaattcagaacaagaaaaagaaagacataagataactgacaacaatcagataaaagaaaagttgacgcctcaggttaacagaacttgtatcatcaatggacagaagccatctttatcttttcagtagttatgagatttttgacaacttgaagtctatacaatgttctttccagaaaaatagacttacaaaattacgcatataatttcacagcttcatggaaagagatatttcatggccctcaaattaagaaagatggatatatagaatatggacagtctcacagtggaccagaataatcagagttaacaccttaaattcacaaacatcccagggagggttgctcagttgactgcaaccatcagggtgcaactgtgagctggctaagctttcctttccttgaggctgatcctcaatgacacagcttctccttgggctctgtgcttttaactacgctcgtggggctgcccaaaccaattctatcattcattcttttatccgacacattagaagtcacaggtagcacataagcctcgctagattagctaaatttgtttctttagggcagttcagcgtctctcttctaatgacttgattgtcttaaagctgtactttcagaaggcaattatatctctgctatatccctacttttagaaaatgttagtgttcatgtactgacagcactaattcttttaaaaaattattttatcatagcaagaacgcttattatgagatctacccttataacgaatattcagttgcacaagacagcactgttgactatacacgcaatggtgtaccgcggatcccaagaacttacccagtgagtattttccaatgtcatttaacattgattaggggttctaatacagctagtgttcaaaacccctgcaaatggaggacaaacgagagatttcggtagcttctggcaactaagcctagagataactaaggtgaggaccctacttctacttgttatgaaatgaggaaggaatgtgtttacaggaaggatacctgggtttaccagtctaagttacctaattagcccagaggaaagtaattattgaaattttgcatttgtttcaagctctataattgttataaatctacaacaatgttacactatgggctaatggagagccagctgctcttcttgtgctagcacgttcttgaaaaggaaacatttctatcctgccaggtgcatcatgcatgctccatgctttaattcaggtggagtttgggttatcacttcaagggagaaataaatcagtgctgacattctaaataaagctttgagcttgaagagtaataatctagctgctctttctaaatccagatccacaggtgttaaagaaaatcatgcttgagggatgtgtcagagggaaatgccacacatattcagccaacagagtgacaccctggtaagaggaagccccgcccatcctaaatcacttcctgaaacccgaagaaaaggtctctctagcagcccagattcacttttctctggtgaaaattcaaggactgtatagaactgtaggccattttctttcataaaataaatgttcaatggattaataaatactgatccctcattttctgtttgtgaggattaaatttcatatcctatactgagcaatatttttaagaggatctgcttatgcatagtttataagtaataaactacgatccatactatagatcatataatctctttatctttaaatcaattcagtgattttttttaaacttctgcatgcgtgggtgtgttcactagaaagaaaatcaaattcaaatttttcaataccaatacttactggcagtttttctttcaggttttgaggaaatatgaactactagaaaaagttaagttgtggttgagttcagatttttatccaaaaatatttttgagtatgtatcatgtgccaagtgtcaaggattcaaattttccttagagttagttattgccctcaagggtacaaagagtaatggccagagagtaggcatatgaggtgccatctactggcttccattaagtgctctgggaattcagaattcatttaatccatgttctgtcttctccctgcatttattttgggacaatataactatcacttaaaagccaaaatgtgataaattgtcacatagaagcataggcaagcaaaaatgctatccttcgtttcatagtccagtgaaagtaattcagctttttttgcaaaggatctcacggagtaagttttctattgcaaggatgaaataacgtaaactcaattttctacccttcagatagggcagaaaggctcagctccaggctctctgagctccagagaacccaggctcaggatcatccgcctccgctccccactgaactcagcctccatcaactccgcctcacttctgcaccccctcctcctgtaaaccacattgctaagcattctcaaagacaggcatctgtttttctctatgcttctgcagggattcctccttactcaggaagatccttctgttgtctctcttccttgagaccttctattccgggtttgacacaaagtaggcatttagcgcacgtgctttaataacacgctcttcaggtcgtggcctgagcccactctgtgatggcctctacatggcccacgtagacctgctctttcccttgctcttccgccctgttttataaagccggaatgactattgagtcacaccaattacaccagtgttctgtttgattgtttcattctccttcactagtcactgacaataagcagtattcatttcatctttgtattcctgtaacttaactcagtattgtgtctctggtagaggccccgtgaatgctgattaaataaatgagagaagaaatgaatgagcaaatctgtgtatccacttacacttgtgcacgtataagtatggatagcaatgtgtatgagcacacgtgtttacatgtatgtgcatttttgagtatgtatttgtgtatgtgtgtatacgtaaataaacgtaatatatacaagaggaaacagtgagtgtataaggattgcaacttctgtagatgtacagacatgtggataatttctgctttcattccctagcagccatgggatctcgggaaactaaagtactgcagttaactacttcactttctctacgtgataataatagatcaccttatttcacttagacaatttccgtgaagatttcctaagaaaagacatgaataaagtctttgccaattgttatgaaaaattgtgtcctatctgtacaattgccttacactatggagaaaagttctatacaaagcaagtagtgattctagttaataaataccggagtcactgttttgattcagagctgctgctttctatccaaagaaaggttggattatgtacaaaacttctattttccgaaagctactggatcataaagaatacaattaacttccgaaaaaccttgttttacttataaaatgaactaaaaagtcaacctaaattattgcatataattcataaaagctagattttaaaaatataaccaatatttaaattattgaagtccatgtatgatttcccaaatattttagaaaacatttgaaattatattcataataaacacgtgcattaaaattgatatttagactttagaaccaaaataatgaacattttgagtctaagagttttgataatagatgcacgcatttccaacatttagcttacgtttttactaataagggcaactattataaaatagaagaattcctttttaaaatctaaagagaaaaatatataaagtacatcagagagagaggctctttggggaacaatttttagatgaccgtgtatcacccagtccgtatattttcttcaatgtcctcaagtctaatatgtgtcagcctttgtctcatgtcaattttctgacttcctagatgtttttcttaaaacataggtcagcttgatgacaaagtaatattttttaatacttgagattttgataaaagaagaaacattacacaaataaaatttatagacatagtacttcaaaactgggcatatctaggaattttaatagtaatcttattataaactatgtgtaatcctaatagtttctgttattaatttgtcaaagacagctatgcaactatgttggttcacaattaagactaatgtccaagtatagaactagcaagtaaaatcttacaacactgaattaagttactaccttcaattttattctatatttagcagttaaaatgtgttaatttgaatatatacacttaattgctgagacttgctgaggtctatattcagaaagtcaaatactgtaaataatcaatgttagtataaaatttatcagtgttcccactggatttccagagttaaattcaatgactgaacacgttgattacactattttaatttgtttctattctcattatgtagcttaatagttccatgtgtgaataatagtttatgtaaataaagcctattccaaagtactgccagacaacagttgagtttggtgtccggattatgtttattcccaaggttatcatgtttacatagatcttagaactttggaagattcttctcctttcaagccaatacatttcaattaaaattttatgcagcagtctgttaatactaccacaattccatgttttagttaaataaaaaaacatgaatttattataatatgaaagttcattttatatctaaatccagttgcctttatacgtcttggattatacatcagtattttattctattatttgactcataccaattacttggtgggtcaaataacaggatccgtgggcagtctctccaaaataaaaactaatgggaaaagaggaaatctgaggtatcagaaagagaattttgtgactctaaatcaacttgaaacatttttctaattattatcattaattctacttcatatacatatatatacatgtacaaattggtgtatttgcttattttatgcactcttaataaattctgaccttttcccatgacatttccttggaaagtaatagttgtctaaagtttatgtgtaaagtatttggtacttgcaataaatattgctataaaagctctcttctactctagattatcttaccttactcttccacttaagactataattgataatttttctccaaataacgcacactcatttttgcaggagacctggaagctaactgataaatagatttaaacacacacatactaaatactagatacaattttggtttagccaacaaagcacctttttgacaggtttttttcttttaaatagaggtttgtcttcacttgtcaacatcagactataatatcaccatttcaaatcgaaataccacaaaatcattttctacatagccacattaaaaaataaatccaagttactcaacttatggccctattccattttctagaaagtttttcagttgatcttttggagtaacaaagaaatatttttccaacatagacaatcttgccctattttcttcattataccatcatgaccaccagtaaacccagaaatagcccagaaatatttgatagaattattcatatagtgatttctcaacagcgatggagttttcacaacattaattttgggaatctaacaagaccaccttttcagctatcaacttcatcaggaggggagaaaaaaatgccaagttttctaaaatgtggaagcattatctattttctgaacaaatattgtatgttaacaggacaaaatatgcctggcatatagctggtatggattgctttagagatgcttttgtaatattctgcaaaaaatgaaatgatgtgaatttagagtttatatgaagtggtacattgatatcatcaatgatacaatcaaaactgaaagctaataacatccactgatcttcaattagcctgctgctttccaaagattaacttattccttgatagtaacgtacttaaaggtgatagaccctttccagccactgacgctggcttatgcacaaatgcggtggcatgaaagacattagaggcagaatcgcagaccattctcagcattattccacacgtaactttaagcaaaaggataagtcggtccattcctatgtctctgcaaagagaaccttctacactgtaattttctgctaatttcactacagccacccatttgcacaaaccacgtgtatattttaacttcccacaaaatacgatttttgcctaaatgcagagtattcccagtaagaatatataatttgtgacttagtagcaaatgacatcccaagtaaacagtgtgtgttgtaaataggaattggtttacacccctaacgatagattgctttttaaatttacagactccagagtttctgttacagacagtagctcttgtattacgtgtaaaaggcaatttaaaatctccatccaaaacaaaagtagacacacatcggcctttaaagtattaactagttcaatttcttaaaacctaatacttgaaatgataatttccttttccaaagttctatctctgcatttaaaaaaaatttctgccaaaagccgttttaataatgatagcaatacctcaaaggtatctaggcacaaaatctgaagacatgaaaacaaataagtctctatgccttgcatgatcaaacaacagtaaaagcaaattaattttctctcttaaaaatttcagctttgacaacaaaagttcatttaatgaaatttcctttactcaagcactatcagtataattgtccaaccaaaaatttaatgaaactcttctgcattaaaaatgaactctttaccacgtaagagggctattagtttatagtcaaatttctcaaaacttattcgctacaaattaaccaaaacaaaaccccaagaagaaaagttctagtgataagaagaaaattgtgaacacgttttgggctggaaagtttggcgattataacagtgttaccaaatgccattgcattacacagaagccaaatgtctacaccacggaacgacctgcgacatagcagcctagtttgtcattattaatccagtgtagcatgtattagatcatttggacagtgaatgcatgtgcaaaacacaaccaatctcctaccttcatataatgctttgaaaccttgggcactcacagcgaagtctgtcgtgaaccacagagtgaggatagatcctgtactcactatagaggagggcagctgaaatcccgataatctaaatttaaaagacaagacacaaagagagttaaaagcatgaatttgtcaaaaaaagcttatttgatgaagtcactgaataacttgaacagtggtatattcacttgaaatatggcattaaacacttagataatccatacacatagctttggttgttaagtatttgaaattaaacattttcaagtatgagaatatgtttatttaaataacttgagagaatttcttcttgaaaatacttacttatataatatgccattgtcttaaatgctcctcgtttttggatggcaattatctactgccaacttttttttttatttgaatttttaagttatagggtacatgtgcaatatgtgcaggtttattaggtaggtgaaggtgcgtcatggtggtttgctgcacctctcaacccatcacgtcggtatgaagcccagcatgcattatctatttttcctaattcactatttttaatttttttctaataaaaaatatgacaggtaaagcatgtgaatgtgtgtataaacatttgtgcactcaaacatgaaagtattgcaaaaccactgagttggtcgtgaaacaatctgtgtttcagttggattccaagctgtgctcttaggaaaagtgagtgagatggtcaggatagcaaaggccccgtgcaataggctgtgagccgtctagagggcaaaccaatgctgacacagctctgtgatccacaataggactcccaacataagaatgctgagaatacccacattctggtaagtagcttattttttatgttataaaatccacaaactcctgtgctgtgaagcctggtctgtcctctttcaccctcctaggagccctcctccctccctgtcttttggtttatcacctttcttatctggtacaattcacggggatcttcaactctcaaattgtattcatctttgtaaactgcagtatctgctgtctgcttttattttttaattcagtccccttaaagagactcatttgttcattttttcccattggatgccaatccaaacaactttcagacagtgcattcacatgaaggagtaaatgactgatgaatggaaaaagaaaccattgtcataccagaagacactgctttgtactttatgtgttagcgaacgcaatacagaagacaagtcagtgaagcaaacgttgctttaagaaaggaaaaacaaaaaacaaaaaacagtgagtttaaattctcctgtgactgaagaccagcaagaatacagaactcatcaaccctatataacagtatttaatcaatatttatagtacactttacccagcaagaacagagtacacatttctttcaggtgcccacagaacatataccaagataaaccatattcgaggccataaaacaaacctcaaactatataaaataactgaaatcatatagcgtgtgttctctgaccacacagtggaatcaaattagaaatcagtaagataaaaatgacagaaaaatatctaattacttggaaaataaacaacacacttctaaataatccaggggccaaagagaaagtctcaaggaaaataaaaatacagataaactgaatgaaaatataaaatacaacatattaaactttgtaagactcagctaagcagtgctgagaaggtaattagtcgcactaaaaacacagcttagaaaaactcccaaatccctaatccaaattcttattgcaagaactataaaagaaaaaaacaaaaaaaactaaagcaaacagaaagcaaaaaacaagaaaagtacagaaatcaataaaattgaaagaaaaaagaacaaataatgaaagagccagttctttgggaaaataaaattgaaaaagactgactaaataattgggagtttcagaaggtacaaagagtcactgtcattaaacatcaaatattactatgaactcagaattcatcataaagataataaaagttactacagaaactacatatgtaaaattggcaactaagacaatatgggtcactaactcaaacaaatgaactattacaactaaccaatgaaaaaatacataatatgaattatcctatagctattaaaactttccccaaatttccagttccaaatgttcccactggagaattctacatttaaataattaacaccagtcgtacacactttaaagaattaacactaattctacacagtctcttccagaaagtgtaagtggatagaatgcttttgtagtaattttgtggcattgacactaccctttcccttatgggctgaattatgctcctcccaccaattcatatactgaagccccaacccccaacataactagatttggaaatggggctttacagaggtaattatagttaaatgatgtcaaataattcggactctgatcccatagggtaagcatacggtaaaaataagaaaagagaaggattcctttctccctggacacatactgagaaaagaccatgtgagcatggaacaggaaggatgctgtctacaagtcaggaagagagccctcaccaggaactgactattctggaccctgatctcagactttcagactccagaactgtgaaaaaataaacctgtatttcttaatccctggaacttatagtagtttgttatggcagcctaaagagactaagacactctaatatcaaaaccagataaacacagaaaaaagaaaaataaaataatgtctctcatgcatatagatgcaaaaatccttaaccaagtaagagaaaatagaaataggcaagatacgaattatacacgatgatcaaatggtgtttattagaggaatgttagaaaggtccaatctttgaaaattaatccatataatctgcaatattaatgggctaacaaagtaaaatcacaagatcatagtaatctatgtagaaaaaaacatttgacaataataatcattgaacatgagaaaagttctcagtaacatatgattggaaggaatcttctccaacttgacaaagaatatctctacaaaaataaaaaaaatttaaaaaagcctaaagataacattttgcttagtggttgaagactgaatgcttctgcctaagactggaaacaagtcaagaaatttgaacaagtcaagaatgctttgaacattcttattcaatatcgtgctggaatatcctgcaaatacaataatacaagaaaagaaaatatatgcgtatgggtcagataggaataaataaaattactactatttgaagttggcatgatgatctttatagaaaatgccaaggaatctacaagaaaatttgtagagctaatacttgatatcatcaaacgtgcaaggcacataatgaacatacaaaaatctattgtagttctacatactagcaatgaacacgttgacatcaaaatctgaaatacatcaatcacaacagctcaaagaaaagcttctgtataaatacaataagataagcccaacagtgtatacagaaaagtacacaacactgaagaaaaagttcaaagaaatgctaaataaatggacagatataccatgttaatagtatggaagatggaagactcaataatgtaaagatataggttacttccaaactgatacacaggttttacacaatttccaccaaaatcccagcaagaatttttgggtatatagcaagatctttctaaaatttatgtgggaaggcaaacaaacaaaaaaaaatagaatagctcaaacattttgcgagagaagaataaagcaggagaaacagttcacctgatttcaagacttattttatatctacaacggttaagactatttggtatcggcagattggcaaagacataaacccgtatgtcaatggatcagaacaaagaacccaaaaataaacctgaacaaatatctccaatttattttcaacagattcaaaagaaattgcatagaataaaccaacaaattatgatggatcaattggatgtccatagcaaatagtaagtttaacaccttatataaaaattacctcaatgtggattacaaatataaatgtaaaatgtaaagcaattagactcttaggaaaaaaataggggaaaggcttttgagtctagggctagacagagtttctatgcttgacaccaaaattacaaaccagaaaaagataagttaataaattggatttcataaaaattaaaaactttggctgcaaaagaccgcattaagagaataaaagtgtatgctgcagactgggaaaacacattcgcaagccaaatatctgacaaaagacaagtatctagaatataccatgaactctccagactcaacaacaaaaggcaaacaatccaattagaaaataggcaacaagcagaaaagtcaggtgacctaaaggacatccagacggcaaataagcccacgaatatttactctacatcaatagacatcagaggaatgcaaattaaaaccacagagaaataccgcacatgatatttcagccaatcagaatagctgaaataaaaataaataatgacaacatcacatgctggctagaacgtggagaaaattggttgctcttatactgctggtggaaatataaaatggtacagccattttctgtagaaaacagaaaacttccgaagaagtttgacatttcctttaaaaacgaaacacgtaactgccatctgaccaaacaattgttcttctctgcatttgccctagaaatgctcatgatgggaaactgtccctatcttcaccataatgcatcaatattcggttgtgtaattattataccatagttttgccggtggtttccacttgagaaactggtatacagtacacagaaactctttgtataatttcttttaactacatgtgaatctataatgatctcacattaaataattaaatacattggaaaggttgagactgagaggtactcaagaacatattaagattaaaataatctagtaaccaaaataatgctatttaataacaaaacattaaattctaaaagtaagttgaacaaaaactattgaggataatttagtaattgcccatcttgaagttttacatatatattcgcctaagttaggtacaaaataatgtgatagcacttaattaaatacaatttcatgtccctttaaattattaagttttataaaaaattgtgattacgaaggggtgtggtcaaatgatattagttcaggaagtaggaacaagatactaagggatttttaaaacgagtgtcataagactactgttcagaggtttggggtaatttaatatggacgtatgtagggaaaatatatgcatgtgatctgatttcaaatagctgcaatgaaatggattcattcttatttgtgtgccaaaaaaaaaaaaaaaaaatagagtccaacattagttgacagggatgcggaaggatgagtggatccaattgatcataaagagctttcaagagctaaatttgtgattaaatgtttatagccatttactccacactggctgcgagtaaggaatcttataaggagctggcaagactcactccttggtggctcacaaatgtgctcctgaagacatgaaagtacttctgtgagtatcctttccatgagggcccttgcgatacattttattcttgtctgcctcactttgaggaatccctgcttcttataagcaactggcttattttcaacacatagtaaattacgaaacattttgaagtaaaatggattttgaagtaaatcccaataatccacacaggtgtcttgcagtagcaagtcttccttctgtcattcatatttgatggtccagggtagtacgggaatattttagtatatgcaacgttactgataaactttgaatatttcaacaaaatatgacatatgttactccctatcgtaattttttagtgttttacaaaaaatacaagcatgctaaagtatcttcattttagagaggtagacatagcccaaaattaaagaggtatacattaaacattttaaaatgtgttttccaaatctccaagggattatgaaattttactgaagaaaactggccataaataaaaggaattattttgaaaaaaaaaaaaatcttatcgcctatggatgtgacagagagactgacattaatttccagacagcatatacagaggctaggtaatcaggaaatagactggaatctgtgaattaagaagccttttatctatagttaccggacaagttttccagtaaaataacttattttttataagttattccaatttctgttctagaattcatccaaaatttgttgtagatataaaaagtttttttaattatgtagtatatagcatataattttgaaaatcctttttatatattttgtatgtagtatatatagtaaacctttttatatactatatatacaatatcataaacatatactatatagagcatatatagtaaacatacagactacagtttatatatatgacatatatagtaaagtttttatatattttataaagactgtagtattttatactgtataatatataggatatttactatagtatagtatatatacacagtatgtgcagtatagtatatatactataaattatattgtttactatataatatagtaatattttgttattcatattttatagtaatattttattatataatatagtaatatttttattatataatgcagtaatattttattactatatacatttattatacaatatagtaatatagtaatattttatattacaatacagatgatattatataatatagaaatatagtatgtaatattacatgatacatagtatactatattatgtactatattatagcagaattcaaaagtgggaaggggtattagtatcagatgtcaggtgtttcagctttttattttatatagaagagaaattatggtagaagtattcggtcactggataagactggcctggtctagggatggggacaatttagatatcaagaagtgatcagtgatcatgtccccacgagaactggtgtagacggaacagccccagagagcttgggagatcaaagagcacaggtggctgtggctcctgggaggtcaccatccttatagaaagcctctcctgccaggtaggggtggtgaggacagaatctacacaatgggtaagtccagatgggtgtgcagggaccatctaacgattcctgagcccaagagaggcacacgccgtgccctgaatggtcctcagtccaagagatcacttgagttatgtggccttggtgagcaggtcttggtactgttgacaaaatactggatgcagtgagttacatgtcaaactgtgtcaggacacggcagagggtgatctggaaccaggtgctttatcaacccctaggtaccttggggtcatagaactctcttggacttagataccatccggggaagatgcaatcaagcaggcaaagttcagaagagacttaatcaaatacacacacacacacacacacacacatgcacactcaaacacacacagtgaatcatgtgagtatatatacatcttaccagattaaaatgtccgccatcatttggagagagactcgaagtaaaaattattgtaaattccatgtaataattacattatttttatacgttaacttttggcctcagaaaatagtacctattacatttatgtatttttctgttctattcagcatatcactaatttgaaactattaatataaagtatataaatctctcaatagaaacttcaattacagatttttatcacaatgtataacccatacaaatatatgcatgtttaacctattgaataattctttttcttaaaaccctgttgaattttaaagtcagggatcactacttaatataatgtctctagggcacagactgccctttatttaaggcactttatttaaagttatgttttcaaatgtttttctgactccttgctgtgacacctcattggcccagtagtaaagatattccaagtagctactgtacttgaagcctttcattgctattgttaagacatgaaggttacatgtctcgttttcatatcagacaatatcaagagtgaatgggatacatctctgatgcctgttttcctcctctccaaagcacccaccacatctatgtgaatctggcttcacttaaaaggaaaacaaacccatgttcacttgtactgtgtccactgaaccacacattctaaacacaagacaactaggagactatcaacttgatacaaggaaaatcaggacagcttgtaccaagacaactacttcacatctaacgagtcccaacacctttctctatcatctagtacctactagggattaaaagtaattctaggtagcttgttatcttccttgtaagctgtagttcaataggaatacctaaatgatttgctaatgcaatatggaaatggtttttcacattaatttctggagtaaaaaggctgcatgcctggcatatgtgtatctctctctacatgtcagagcaggtatacacacagaagtatgttaacatgtattttcctacaataaacttgcaacttaccttatgacactttcagtaatactagatgtgctcaagttcctttaggaaacacggaaactacagaacttttagggcttattaaaatagctgataatgtcatattaataatccagggttcattttaaatttggttattttgtgtattatttatttatttattgagaaggagtctagctttgtcgcccaggctggagtgcagtggcgtgatcttggctcactgcaacctccacctcccaggttgaaggattctcctgcctcagcctcctgagtatctgggattacaggcaccaccacgtccagctaatttttgcatttttaacagagacagggtttcaccatttggccaggctggtctcagattcctgacttgaagtgatccacctgcctcatcctcccaaagtgctgggaatataggcataaggcactgcacgtcggccttatcttaggtatttttttaataagagttttacatacttacagtgtacaatacaatgtctcagtatatatgtccatcataaaatgattactactggtaatcagtttttttctatgaaaactgatatataattggattattatatataatatatatttatataattggatagaattctaaaaggatcatgcctgccttacacgaatatctggttatgttttaaaaacatcatgagatttcaacagtcctatcacttcttgttgaagagaataatttctcatcaattttgcttcactgctcttcaagagctttacatgtgtatatgtgtgtatacatagatatacacacattttacacacacacatctacatatacaaactatatcggacaaagaaaaagcatcctcctttcacacaatgttttgtgaacagtggctcagtttggttctttggcaactcctcctgtcaattgggaaacagattagcttatataatttgtagaattcaagttggatcagaaaattgcaaaagcgtgagactcattacagaaggatttggtccatactgatttaggaggcaaagaaagtcaaagtttagagactattccagagagagaaacgaatgcacagaggagggcccttcatgctgggtaccccaagagatggaccccaataccccaaaagaacaggagctccatgagggcagaagtgggtctcctgtaacccacagccgtatgctgagattctagaagtgctccacccgtatttgttgaaatataccggcaatcccctcccatcatacccaggatctcattggctcgggaagaaatccacgcccattcagttaagttctatgaaatgagggaatcctctcctccatttttggccaagacttggggattcaatcagtggtcacccatcagggaatgaaaaagacaagaggcaaaggggagaatccactggaagctgagctggaagatgaggtctccttaagtgccttcccactgaaatgaaatcgactgcctgagttttcagaatcaaccaggaagtataaaagcagaaacaaaacttaatgtttaaatcccagaagtgaggtttataaataaagctaaatgtgctgattccacaaagcaaatctatgtcagaatctatcctacgtgtgctttcctaagcaaggtgcccctttatctcaggagttaggccccagctttctcatgccatgaatactgggtcggagaagaaattttctaaaatcacatcttatgttttggtgctgaaaaaatattgcagttaaaccactgcatattgctttaactgatagttttccttcctaaaaggcttacatcattaaaggcttatcagtttattcaaatatatcattgtttacctcatggttatgacatagtctaccttctcccgggaccctgagaggaatttcatttggttatggtgatttaatagacatggtatatcataatttgcactaaacaaaaatttcctcctaagaaattacactctgatagacactactctctaataaaagttactctggggaagaaaataaattttccccaaattgcattctagacaagtttgtcaagaattcaactgatcctcttttttttaatcaatgcaccaagttattttgggcaagttataattacagtgtctgtaatagactatcggaaacaaaaaatctaaagagattttgcccccaagcatgaaacagcatccacataatgtatgtttatgacaatcaaaccatttacaaatgacattaaaacagtaacagcgtttttcctgtcaattgtcactgcaaatacttcactccagtgttgtcccctccactctttgccttctgtgtgatcagcaccagcttctcctgaatggtaaggatccataaattatcttaacagtgtaaaattcactactagaatttttatatcaagatgtcctttcaatcttttctcccctcagttatgccacttttctctggaaagacttcgcataagacctgtgcttcttcagaataactcgtggagtgtccattttattttcttctatgatcattagtgttaatatatttaatcttaaacagaccacatgactgtagaaaaagaggtgaggctctaaatgatttgctcaaaggcaagggaggggagtaggtagtgacccctagagtttattccaggtctgttttcattatctcaacaacattaaaaaaatagtgaaatggctcaaagatgttaaataataatatgcaaatttattttatcatatctcacaaactgtatttttacttcgtgattttcttaagggtgaacctaacgtctataaaattgaaaccaatagttgggaggaattcattgcacttagaaccatacgcacaaacttagattgaaggaggaacaaggtgagaggagagcgagtgagcacacagtcaggagaggagggcagagagagaagaaagtagagagaccaagtagagaccaattgctactcagttacactttataacacccgaccctgataatctacaccagccccggccccatttcaaaactttgctctgaggctacctctttgtggcaaaaaccaaaaccaaaacgaaaaacagacaaacaaaaaacagaggctaactggaaaggaagaaaagatagaggaatgaaacaaaagaatcctaaatcctgacagcagaattaagacaatggaatcaattgttgttctaacaattttgaaaccaaacttcagtaacctggcatgtattagaaatgtagcaaatgcttaataagttggtaacatacacatccaagataaagtactacgaaatgtgggcctattttcttggtggaataaaatttattatatatactattaaaatatgtgaatgatatgtaacaattgggtaaatgggaattacttcaaataaacacagtattgttttaaaagccacggcagtaacttacatttatgcacttcattatatttgtcaatgtattctcaaaaggcctgcaaaaatgtgtaaggagatttggtagtgctcacagactaaaacagacaggattagaatacagaaatattggctattgagttcaaaaaggtgattatataaaataaatccttgctaaagcatgcatggattataaaaacatgattggcaattatattgcgaagtttgaaaaagtaaaattggaatttaaaaattttgtcaaatgggttatgagaaaacagtaaactcacacaggaacttaactgttttccaggtgtaggtttttatgaggcaagagcccagagactaggcagcttaagtaacttactcaaaggactgcttgtagaatccccttccctggctatgaacttagtgattaacctacactaaggcaggtttcatgttatgttgatttcctagatttggagcctggtgaaaagaaatggactaatgacacaaaaactcaagtatcaattaccctccttggggtgtctactaactgctggtaaatgctcggagtgtgaaaacactgtattctcacaacatccataaaacacccttatgacttaaagacaggcagtaaagctcactccttttgcaggtgaggaaacgaagcctcagagatccttaataactgacttaagaccatgcaggtggagagcaggagagacaagattcaaaccctggcgtctctctccagagcctgtgcttttaactcctgaaagttcacaggagatttcaaaccagggccatagaggaaataaaaatatatgaagccaagcagtaattttggttattgattagaaaccaaccaacaatttagatttctttagcactctgttgtataccaagggtctccaaccgcgagccacgaatgtggctgcccatcaaggggtgagcagcagaagccagagaggctgtgttgttttcacagctgctccccatggctcacgttaccagctgagctccaccctcctgtcagatcagtgggagcattacattcccacaggagcgtcaacactgtcgtgaactacgtatatgagggatcgaggttgcacactctttataactatccaatgcctgatgatctgtcattgtctcccatcacctccagatgggactgaccagttgcagaaaaacaagctcagagctcccactgattctgcattatggcgagttgtataactatttcgttgtgtattacaatataataatattacaaataaagtgcattataaatgtactacatttgaatgaccccgaaaccatttcctcccacaccctggtccgtagaaaaactggcttccacgaaactggtccctggcaccagaaaggttggggactgctattatatacaactcataatatcatggacatgacatcattacataaatttctactaaaagaatcaacctttgaaccaggaatagggcacattaaaggcaattccctgcgaggtcaacgcactggctatctgcaagcgcggccaagtgtttccctcattcccaaggcagccccagatccccctgccggcaagaaaaaccttgtggaagcagacatgtgctgcaacagagagatgaaaagcgcccttaaaatgggaaacgacaaatttgataaagccagttttctttatgctcaaatctgcccttgtctgaaagagctacactctcccacttgcagtcattcacctggcatgtgaatatataaaattcccatcttttgattgaaaaataacatttatttcctacacctttatgaatttatagatggagtttaaaatttgtgtctatttacctctgtcctttgcaagatacttttaatgaatctggaaaaaaagggaaaaaagactggaatctaaagcacacaggcacagccccatttctttgacaatcctacaaaagtcaggataagaacacagcaaaaaagggggaaacttgtagaattgaggtttattcactgtgggctccaggaagtgattttctcttcagcctcaagattaacagcttcaattcttttcaaagatatgacaaggaattttaaatatctggatctaggggctggacattgggactcacgcctgtgatcccagcactttgggaggttgaagtgggcagatcacttcaggtcaggagtttgagaacagcttggccaacatggtgaaaaccagtctctactaaaaatacagaaattatccaggcatggtaatgagcacctgtaatcccagctaattccatagggtgtggctgtaaaagctactcaggaggctgaggcaagagaattgcttgaaccttggagatggaggttgcagtgagctgagattgcaccattacactccagcctgggcaacagcatgagactgtctctaactaactaactggatctaagaacactaaatctgagtgtttggcagcacaagccactttttgaactcagcccttggctttgtgacccatcctatgaagtccccacactctaacagaaggaaagaaacaacaaaaagaaaacccagcaaaattgtctgatgaagcacttaagagcagcccaacattgactaaaacacaatagaggaggaggaagttcatgttacagtcaatgaagctaatccaaaatttccacccaattaaagacagagtaacaactgggaagacatatcacaaacccgatttactttttgactggaaaggaacaaagagtaacaaatgttttcatgcccctgacagtgctcatccggtgattttgggacttagctcttagactgtcaaatacacaccctttccacactccagaccctgcaccgcccatgaagccctacttcaccagggctcaaccatccatagctgtctcctgggcaaccgcaagaacaaactacatctttttcctcaagaaaatgctgtattttgtcagcacatgactctgcatgacaaagtgacaacagatgttaaaaccaattatttcctatagaaaaaatgatgtaatctaactcatattttgcatacttttgtctactcttggagacatttaagaagccaatactgttgaatgtctaatatagtttgtgtgtaatatatcggtgtaataaaaatggaagccattaacagtagatgctaaaaataaggaaaaactgtattttaaagtatcagtaatatattatttttataaatataacaatttcaatagggaatataaattgatacacaagtacatcagccaatctgatctttggaaaattaaaccttgaaaaaaatgtatgttttataagtactttgttaatccacctactgttcacaaatgattgttccacagccaaatgtgacacaggtaaaatgcaggattatggagttttgaggccttatttaattattaggagaaaactcagagttcctgcagtgtgatatcactccaaagaagtcaccatgcaggcccagagtttgtctagttttgttaaacttatcactggtttccacagaaaatctttggaagccctgttatgatatgatttgtccaggaaaactgaaaccttaactgcctgcctccttcaacactcaaaacattttcctatggctgtcatgctcccttccaggaatcatggaatctgctcttcacggcacatgagtgaatggtggaagctagcctaccacctccctgggggaaggggatttcctgtgaggtcacccgagttgttactgacaagtggaggtgcctctgtgtggggctgtggctgccttgagatctgtcttggccatgtggctacaataaaaagtaccatacctttgacagctaaacaagacaatagaagacagaccgtgtcccgaacaccttcagggcagggtgtgtgactccaaagctcaccttccaagtattaggactgtgtgaccctgagagtggagtgtgtgtcaaatgtagatttgacggaaaataattagaattttaaccaaaatctacattcttagcctttacatccacacatcaccatctacttttctgtcacaaacatattgaattaacttcatacgcagcagcttgttaaaatataagacccaatcaagatcattcacagatcttataattccaagtttcaagaataaaaccaacatgtccaactgagctaaatatattcttcatttcagcataaaaaatagaagtcatagatattgagagagttagatttcagtgtctcatcttacagacactggctttaggcttcttatgcctcatattaacttattgtaggacaaaattagttcatacttaaataaaaatattttaatacccaccttgtattgtggtgtttttttcatcttatctgtttttgtcactataaaaggatactgtcaatctctccttcttgtggagattaattgcctgatttatacatcaaacgtgcttaagtctgtttcaatttttgtgtgtacagagtagatgtgtgtatttgtggggtacatggcatgttttgattcagaaatgcaatgcataataatcacctcaggttgaggggtatctctcctctcaaacatttatccttcaagtaacaaacaatccgatcacactgtaagttattttaaaattgacagttactgttgattatatccatcctgctgtgcaagcaaataggtcttattccttcttctattttttttaatccattaacaatcaccacctccttccttcactcctactaccctacacagcttctggtaaccatcctactccctatgtccatgagtttaattgttttgatttttagatcccacaaataagtgatcatgtgatatttctctttcagtgcctaccttatttcatttaacaatgatctccagctctagccatgttggtgcaaatgagtgaatctcatcctttttgtggctgaagagtactccattgtgtttaagaaccacattttctttatccattcatctgttgatggacactgaggttgcttccaaatcttacctagagtgtacagtgctgcaatttgaatttcttgctcagctttctaggactatcctgattctctctatccctgagattgagactcagtgctttttcctcaaggtaatttaatgggacaggctatggaagaacaaatttccgaaaaaatgaatcctacagttgctacccaaaagaattcttttaggggaattttagaaatggcaaatccaatccaacaaaacaaagcaaaactttgttgtctcaacaaatcaaatcaatgactgaccaatgtatcaaattgaagaactggttctgaaattaggcagtagagaaaagtaaacttccttttaagtaactgaaatatgattatttagtttgagagaaaaaaaataagcttgttttaaaaagaaaatacattttaaggtattgctaacatccttgtatgtgaacaacttactgtaatcatgactagcaaagtgagccacattttctagtcatgattatccgtaaaatcagaaacattcaccaaaagttaattacatgaaaagtttcctctcaagatttttataacatagccgcgtatgtatttttgtcatttatttcatatttatattacagtttctgcagatatcttgagcagactatcaggtttaaaatgtttttatttcatactctatcagcctctgttcaccaagcctttccagatcccagagtcacacaaaggagttcgtagagtttaacctaatatttataagacctttagcatagaataagattctactatcttatatacttgcttaggctgccaatgagttccatgtttgtggtgtgaagacagagatctttgagttgtctctatgggaacttcataggccgtgtttggttgatgggcttgtctgtaaaactgtgcaggtctgcccctagttcacctgcctcactggtgtagaattcaagtggtctcacctgagaagccggctctcaggcttggacatcaacctgcttaaagtaattctctaagtgttttccatgtattttctcataaatgttgacagaaacccaataaagtggtctgatctgcatttaaaagggggcatggaatacttccaagcctcttagctatgaaggaacagccaatattcacactcagcttctttggtttccaagttcctgctgtttctagcacactacgctgcactcagaaaagaattgagtgtgcttcctgatttagatattgctgacttcttaaaaaactcataaacattgagatcgatctgcaagaaactcctgaaataatctcaacccaagccgtcttgtttttagagtgcagttctttaaggttgaagagacctggggctttcctgaatgctcatggaggtggtgtctgaagcagcaccaaatctccagtctctgaactctgtcctgcatcacccctttctcactggagcatgcagcttaattataaatacagttgaagttggtggatacttaaactctacccatccacatgacgctgaatgttaactgggacatgtggcaatggaccaacgcttgggttccacagcacctggctgtaggaagatgcaggtggaagtcccactcctttcacatgttttactttccatctctaagctgacgggagtgtggggagccctgcacagtcacattgtgctgaatcatgctcctattattttatacctacattatcccatggagtagtatttacttggaattcctgcaggtagagccacttatgcaaactcttgcggccttcatactcagttgagattacctgcagttacctgcaaatatttggttacaaatgagtccaaaccatgtgccctgaatcacaagtgcttgaaggatcaaaagatttgcttattattcaagatctaattctcaaaattgaaaggtgtattatctgaatctgtatcacgttcccttgaaagcattagattaccaaagaccaacggagtttaagtatgcataagtaacaatatatggtgtaggattccgtaaatgaattaatgtgaagtcatgagcgcttcatcagtcctagacgtttggggcaaattttcatttcagaactgaataataaactatattctttttagtaatcttagctgatataggtcttattggcgccatcctatttcatctgtattatatggttcacactaatcaatcaaatcaattaatcatctatatcaccttgttactgctgtggtaaagattatttcaattaagtaaatgagccattttattaaacacattgcaaatttcatttatttgaaatactttatatgaaatatattgcttctattaaacaaattaaacaactactaaattgaaaatgacctttcactgctgccaaaattaccttggtaatcaatacgttaaatataattattcaaaattaaagaaattgtgagatattactatacaactttgtgggttactaacttatttcacgtacgtttattacttaatatttaataatgtaatgattttcatctaactttttcctaacattcttatgttttcctactttcttccgtttgacgaacaagctgagatagctatatacatatatgcatacatttgaaaatgtatatttgaagtatgagtttactatctgctgaaaatacatatttctttattattaacatacttacatatttgttttaaggtaaagtaaaacagcaccataaggcaaaatggaagttggtaggagtgcgtactatgaaaatgtgtgcttattaaaggcagggtttaaatttagttaggttttgaaataagtaaatagagaacataaatcagttttgtgttactaatggagaatcctaagcctacaaatagtgactttgagaagagatgtaaattcaggggtgaaaattaaaggcactaatacagaaggcagcttcgaaagataggatggtgtaatgagatcccaaaagagaatcaactacacaacagttaacaagcttaataaggagtaataatatatgtttacagtttccacacatgaattaagatcctggcctgcacacttcaccagcctagacatggggggtatacacttaattttcctaagagttaagaagcttaatatatctaaaatagcagtgatcaacagtttaaaacactgtttttaactgtgttaggatattggaaaagaggaactcattctctttaaagtgcagctttggtgtaaatttcttgctaatttggacgtttctttctagattaataatgtagaaatcttttgatccagcaaccttttgaaatatgccctacctatatgtgcatgtgcacctatacatattgtatatatttataagatgctcacagcattggtactataaccagaaaaatggaatcagctggaaagtctattaactgggaagcatgtaaataaatcattacatatttatgcaattatacaatgaataaggagtcagaggattgctctcactcacacctatatctaattatcccttttcccccagcacaaaatcattgttcatcttgttactcacaaaaaaaaatctcagcaactgttctcatttccctctataatttctatggatataaagacatgtacagataacattgctgacatgcatatctatatgtaattttcaaagatgcaaaaccaactttagcattttctctggaaagataggtagtaccatgcaatgatagggaagaaaaattgattgcatacatttgtgctgcttgagaattttatcacatcaatgtattattttacaaattaattaattctggccgggtgtggtggttcatgcctataatcccagcattttgggaggccagtgcgagcagatcacctgaggtcagcagttcgggaccagcctggctaacatgctcaaacctcctctctactgaaaatacaaaaacttagctgggagtgggggtgaatgcctatagtcccagctacttgggagactgaggcatgagaatcacttgaacccgggaggcggaggttgcagcgagccgagatcatgccactgcacttcagcctagatgacacagtgagactctatctcaaaaaaaaaaaattaaaaatattaatgaaaatatatacatctattatcattttaaaatataaacttttttcctaataatttgactcgttaatcaaaaggtttttttttttttttttttttttaagagatagggtctctgtcacctaagctagagtgcagtggtacaaccttggttcactgcagtctcaaactcctgggatcaagcaatcctcgcacgtcagcctcttgagtagctggaactacaggcctgagcactacactcagttttttttttttttttttttttggtggggggagtagagagggaggtctcactctgccccctaggctagttttaaacagctggccccaagcaatcctcctgtctgagcctcctaaagtgctgtaatcacaggcatgagccaactcacccagccccagaagtcatctttaagattactttcttaaaatgaaatcagtgttgaatgttttattaggagttagacataaggtattttacagagagagaatgcattataaataactttcaattttcatgtgcaaaacatagaagcacatgaaagcctatctcatctatgcaaacattttatgttcaatacatttgataatgctgaagttcttcaccacctaggtatttaattttatttcacagaaaagtcacatttttttctaaaatatttacaggtatctttcaaataccaattaaaacgtttgaggtacaggagataaatgaaaatttttacttaaatattgcattgcagtccatttgactgactaatcttgggtgtatcacaagataaatcaaataaggttcaatcaaacactgaagtttgagtaataaaagcatgaacgaaaattccagaaagatttgagttattttaaagtatgctgctacaattttaggaaattcctttataaatcttatcagcttcttacataaccattgtactgagaaactcaggggccaaatgttccgaaaaccaaataataaaaggtagacttgccctgagtcatttctatgtccccccgcttttttctaagaggtctggaaacccattttgtttcaaaactgctcagagtttgagttgtagaaacacgtgacgaaatgcttatctcctcccactcttatctcctgtcctgattcagcaaaaacatctgaaacacagcttcaaatgcaggcaaagtgacaatctcctgacaaatctttatagcagacatgatgtcatacacagtgcagtgatggctgtttattaatctttaaaattttgtttttataacagtaaaaaaattattaaaagttagaaaagaaatgaacacaaagtataaagtagaagttctccttccaaactatcccattcccacacgtttgcctagagatttctaccattaacaaagcctacgtttccagtccccactgtatatatgaacatataaagcccagttctataaatacatctacttacatgcttatctacaagcatattacatctgttatgtatataaaagatgttattccttatgtctgtttacctgaagaacctctcaaaccatatgcaactaaagagattttatcttgtttcacttatagctcttccccaaattggctagaaaaacagaagcaagccctctggattgctggggattccagagtacttttaaaacttcattgactttcccttattcaatgtctccgaaaaggtagttccccgaaatgtgtatttgttgataatacaatcagtcactattttatgtttgcatataatccaaagacagtaatggtctgtgataacttacaatttttaaaatttgatttctaaaactgaaatatgtaagttgcctttatttacatgatttgagatgggactgtaaattaatgagattgcttgtttacagtgaacagatgtttatgtttatataaacataaatgatatttgtccctcaacgtaatgtatctacagcaccacaggtatctccaaaatagtgtcattgctttaactcttccatctcccaaaaacactgtctactttaaagatttcgattgtaattgtgaatatacaattatttgagaagagtcagaggtggtatctgcctttactttctgaatataaaagggctgtaaaaagtggtagctggtatagcaacagtatcttattcctccttttaaatggtagaattcttacagtgatatattactgagtatacaagaggtgttcaatttttatttgtaattaatgtgttttaagatggataatgtcaaatcatcagcatcaatcaatcttcgcctaagttttgtattcgctagaaaataaacttaacttattttagagaaagtctacccacaatatgcatacacactggtctttgaaacaacggctttgataacaaaggcaacaaaacacagttccaagaaaattgcaacaatctttattcattattcaacaacactgaattgtatgatgcaatcaagatttatcttttcatcttatgtgtttctttatatgccacatatattaacaccagaatacagtatagaatttcacgaatgatatgtcagccacgtgtggctcaagacacatgaataatatgcatttgcttaaaatataaagaaaacttcgcattcaaagaatgtactggaacagccatgccgttgacgtgcagttaaagaaatagcatttataccattcaatcctgcaattcccaacaaaattctagcagcagttggctaaagatgatccaaaatatgaacagttttatcaaactataaacacattctatctctaccaagtgtgatctgtgtcatgtccagaaaatcccttatatggtgatcacagtgttagtaacgaacttctgggtaacaaagttgacatgtgaaaacactcagctatgttttcatttcatcacatctacaggagtcctcataagaaatgcgtacatatacatgcatatattcgtgtgtgatataattacctgtgatatgaggtgaaaatgtacaaacggagtaagaatggtgacatgttaaggaaggaaaacacacactatctttgagaagagtaagatagaggtggcctggcacagtagctcatgcctgtaaccccagcactttgggaggtcgaggcaggtcgatcacttcaggtcagaaatttgagaccactctggccaacatggcaaaaccctgtgcctactaaaaatataaaaactagccaggcatggtggcacagacctgtgatcccaactactcgggaggctgaggcaggagaattgcttgaacctgggctgggaggtggacgttgcagtgaactgagatctcgcgacttcactcaagcctgggctacagagtgagactccatctcaaaaaaaaaaaaaaaaaaaaaaaaaaaaaagcagaggttcttggagtaggtcatgctgaatgtggtgctcaaaaatggacaacttttagatcaacagcatgtgagaaaaccacctgaggaagacataagcagtcgcattcaattaggatatattttgacagacaagtttttttagccacggagaacaataatgtccatcttttaggggttttctaagaattaaagcagctccagaacatgaaatgctgagcattctgcacaagggatagatgccatctgtaaacatggttattatcattcagggcatgattgtaattgtgatgacatgttgaaaacatcaaaaagcagggtcactctaagcacaggtgcatgaaggaaaataatgaggtaaaatgatatgaatatgtctacctaattttccctgatttgactaagaacatattattccagataatcagatgcttgtgacctcagccacaagccttcaggtgcaaatgacaacccagaggactcctgctgcagccaaggtaattgattgttcagactctgaccttgtccaggtcttacatatttgctcccttcttcatttacataaaataactgggaaatctccactgtgttaaagaaatgttatttcccttctcttgcatttgattttcaggtgttaaaatgaaaacctatacccatattgaaatcactgcacatttatgcactcatacaaaactacatgtttaacatgttacttctctgaacaacaaaaaaagtatgactggatagtagatacagtgctgttttaagattgggtgatggcactagaagaatctgacaccttttttttaatgtgcagaatcctggttaagactactttcttcattgtttgaccattatttttctcttgttctctttctagccatatgttctctgtcattacctatgacattccgttagttatatctgcctcattaaatcaaccattttctgtatacttcagaagtgtatgaagtcttttccttaatatctcatttgaggagctcaacaaattctatgcttttggattattctaatactatttcttactgtaccaaatcgtctttcaaaatttataccctccagtgagtcacttaagaaagtcaaagtctttgctttcataaagccaattttatacttcattggttttgttttcatttgggtagcttgtgtgataaaaatggcttcaatgaattgaaataatacgctggtgtttaagaaagaactgtgtgttcagagtcgaactgggccaggcatgtgttcctaggaaagtaaggttattgaagccactagagaacattacattgtcactttcccacaacttggaaggaatttctatttgggggcgtaacgttgcattaagtatccaataatagacggtcctgagaatctacactaagaaatcacagaaatgtgtcagaaatagatgattaacgagaatgtttaaattgcctacttagtaattaacatcttcaatgcagaagtgttctcccgctggagaagggcacaagaggagagagcacggatgcagggacgtgacctgggcctttcagctggtcagagaaaaagtatttcggtgttgaggtagacgaaaggatagcaacaatgtcagtgcctcttccctggcagcaccctgactctgtgccaactcttaggaacttgacacagcccaagaagaggagacgaggctgtttcataggcggaagggctccgtgttcactgtagacagcaagttgtgattttgttgttacattcgttacatacgtgagttttgaactgaaacccatacttcataaatgacgcatcaaagaaacaaaagacattttgttttttccacaatcatctatttctaggatacctttgggacagaagatcacttgaagagtggacccagctgggagtggtggctcatgcccgtaatcctgcttctttgggagcccagcatgggtggatcgcttgagcccaggagtttgaaaccagcctgggcaacatggcagaaccccaactccataaaaacaaacaaaagtagccatgggtggtggtgcacacctgtagtccccgctactcaggtggctgaggtgggacgatcaccgaacttgggagactgaggctgcagggatctgtgatcaggccactgcactccagcctgggcagcagaatgagaccccggttctgctttgttttgttttgttgtggggaagatggagtctcattctgtcacccaggctgcagtgcagcagcgcgatctcagctcactgcaaactctgcctcctagatttgagccattctctgtctcagtctcctgagtagctgcgattactcgtgcccaccaccatgcctgagttgtgtgtgtgtgtgtctgtgtgtgtgtgtgtgtgtgtctgtgtgtgtgtgtgtgtgtgtgtgtgtgtgtgtgtgtgtgtatttttagtagagccaagttttctccatcttggccagactggtcttgaactcctgaccttgtgatccacccgccttggcctcccaatgttctgggattacaggcgtgagccattgcgcctggcagagaccgtgtttatttaaaaaaaaaaaaaacattggccctacaaaaacagcaggagatgactgggtggagtggtaagaaactgttgcatggaagggattgtggagttaacaaaaaggatcatcagcctgtgtcaggtctgcgagcctagcctcagttatgacagcgtctctttgggaaaaggtacttacttaaatgtacatttgcaaatagaatgttaaagacaaacaacattttaataaattattgatcccatgttatttcccaattattatggataagggaaaacaaatatacatgacaaagttcttgcctgatggatgcttacgttatagcaggttagatacaactaaagcaaatcaaagtctgaggcagaccgtgatcattattattacaatgaattatcagaatgtggtcattcaaaatgctatacaagttaagaggaaatagaaatccctttcagctccttgaatgattgggaaaggaagcctgaagtggatggcatttgtctggacccagaggaaggagtagaatttatattattcatagacagtaaacaaaatctttaaatctaagatgtgaatgttctttggagaggctctaatccaaatccctcactctacagataacagagtaacactacaaataccaatgctctgtcaacagaaaacgctttcatgtaatacttcccacttgactaagcttgttcaaagtcgacaggtttacggaaaaggaaggaatggtttccacactctcctgtgacctcttgttttagaaagtgcactcatagttaataaaaccaaaattaagtctccaaattaagatttaagactcttttgcagttatgtatcaagtgttataaaaggagaagaaaataaacgaacacaactaagaagtcacaacgtttcaaagatttaagtgataaacttaaaaaagtgtaagtagaggaggctcgacgaatgtacaattttattgttcgattactcatctttcggaaatgacgacaattaccacactcaccatattttttaaaagacaatgctaatagtaccaaaaagcctcttggaaatttttgccaggggcaggtggtaaaactaaaaaactaaagtggttccgcatgaggtttcctggaatatcacccctaagcttagctgtccagtggaaattctgttcccttctctatgttcttgatctcttcctagttctcacttttaccaatgtgtatcgctcgtatcacctcaaggtgaacatgtaaccataatgtctatttttaaaagttttttaacactgaaaatatttttcatctttattcaggtgaaggaatcaaaagcccatttagcaaagcatttccaaatatagttataacacaaaaaagggtacattttgtttgccgatctaggaggatttttaatttaaaaagccttctgcactaactcaattaacagggaataaaacacgccagttgtccaactcctactttcagtaaccctgtgtgccctgatgcagattggaagacattttcactgtggagctattttcccttaaatactttcccagacaacagcagaaaggaagctcagtcattttaagttcagattagtacataagtttacataaatcatgggaacatcctttgaaatctaacatttttccttcctgtattgtgcaattttaaagtcttagtatcaattaataaatgtaatggtgggaaaatataatttattcaccaacatatgtcaacatctgactttcttctcagtaggaaaggtcatatatcttttttggcattgcccatttcatcttaatttcacttttgaatttttctgaatgacataatgacaaccatatttaaggctttaaatgatgtcatctgcagaaggagacagaaacctaattctgggacagggtaaaaggtaatttctctatcttctttctgatgtgtatccaattctcttattcaccaagtaaacacacacatgcacacatatttcatctattaagttcaaaatttccagataaattaccagtgtacctgtttctcttctggatcctaaggtacaaatggatagtagtcagtattatttattacttgtgtgcgttcagcctaatttatggttcttgagtaaaaggcccacagaaggatgctataaacctctttctaaggagattgaatagcttaagagatttgcaaaaataaaacaagctaatgaagtctaaccagactttgcaaatatttagcaatatagatcactcaaaagcaagtacattcttctacaatacagttttacttctattttctcagaataattacactgtctatgcttattcacactcaggttgtaactattgaaaggaaactcagaaatgttttaccaggagcagatgaaaagactcaaatgagcatctgtcttcattggttttaagcctccccctctctttttttccagaatgattctggtgtataacataagagatactgtggctatgtttagaatagccgtgtagaagttcatatttttccccaatttttgttgataattcagttattaaaaccatcatccttcagtgtaatatgaagttacttgtcattttttgtctttaggctgtgtctgtgagtcacaggaagttggatcccaatggactcatctaattatttagccattcccataatagagataatcaatattcactgctgtagccagaatacatcttggagcaatccacatagatcatgaacataatcagcctgagaggaatgggatgggaagagagggagagagagggagtatggggaagaaatgccagaatagggtcgggtgtagaaagagaaacaatggtggcaagcagttgggagcagctatgtttgggcatttttacataacagagccctgcaagcttcccctcctacgttccctatctcagtaaatgacttcatcctcacccagtttctttacttagcaatctcaacctccataacatatgtataaaacctgggcaccatgcccaatacacagaagatgctcaattttgctctttttcttgtttttccacattctgcctttcactggccctgtcctagccatctctcctgctatggcctgggtgtcctgtccttgatgactgggttccacttttctcccggaccaaggacttcctcgtcctgtctcacttctgctcaatttatcctgtacaccagcacttctttgtccattgttttccaaattacaaccccaaaatggttgatatacgtagagtaaaaccgaactgggcaacaattgaagttacagagtacctatatgtgagggagactaagatgaaagcaaagagacagtgtctgatcttcaggagcacacaacatgggagaaagctgtgcactgtttgctgcaactcagagtattttttctttgtttttttaaagatatttagtagccgggtgtggtggctcacacctgtaatcccagcactttggaaggctgaggcaggcggatcagcaggtcaagaaatggagaccatcttggccaacagggtgaaacctcatctctactgaaaatacaaaattgacaaaaattatctgcgtgtggtggtgcgggcctgtagtgccagctacttgggaggctgaggcacgggattcacttgaacccgggaggcagaggttgcagcccagatcgcaccactgcactccagcctggtaacagagtgacactcagtctccaaagaaaaaaaaatttggtactttgatgcagtatccactgtcttgcactgtatccaatgtataacacatcacagagttttaataaatgtcaaacatttaacagaatagcaacaaaacagcggtctcttcacaaattgaaagcaagtattgtattttcattttgctttcatttacgagaggcataaacatactgcacttgtgagtaagggtggtggatgtgagaggaacaattgttaatattcttccaaccagattgcgctaatataaaaattaaaattaaatcatggagaggaaagggccaataaaagaacccatacaactaagatctacagtaacgtattatatttgggtactgaattgacagctaagctttctgttgaccaacgtggggaaaaaaaaaatggaatttagtgaattctgcactgctcattcaataagtcagtcaagcactttgggaggccaaggcaggaggattactcctgagttcaagagatccagactagcctgggcaacacagtaagaccctgtctctatcaaaataatataaaaataaccaagtgtgatgaggcatgtgcctgtagtctcaactacttgggaggctaaggagggaagatggcttgagcccaggaggtccaggcggcagtgatccaaccaatcatgactccatcaatcaaccactgcaccactccagcctgggcaacaaagcaagaccctgactcaaaataataaggcaatcacaagtgtttatggaagataattattgaacatgtgctatgatcagtgttttccacactgaaaaagtggtcagaaaagcttatcactctcatcaagtcccactctcctaaagcttacccatagagaaatattaaacaagttttcttatcacaaaaattccagagacagtgactctggaaaggtaaagggtgagcgatagagtgaagacaaagaaagccttaaaaagaagaccattttagaggttatattcaagaaggaatctactagaaggtaatgttaggatacattccttagtcaattgagttcactgatgaccatgaaatatcagttcttccaggcaaagctttttaaaattaaaacaaattacaacaacaaggcatcgaatgatacagatagaaccatcagtagtatttgagcaggatccacaatgccatcttaaaggatgggctcttaccacagtgagttttgtttacgtaattcactcatttatgctttccctttcaaacctcatgtgttctcttttttcttccacactaaaatgatacctgcccagagatgtaaaatttaatgtatattattatatataatatataaatatatataatttgatatacatatagtttgatatatatataatgaaatattatctttaggcagcctgccttctcaccagaggggtggaagaggaagattaggggccagaatgatctcctctgctttctttagaaatttagggcagtgtgatgcttccagaggtctgtacaaacaccagctttcattgtgcttgggagtttccatgcctcttccttctcttcgcttagtgcacgtttctgctttttatcagtttgactgcctgagactgattccaacaacccaaactgaacgcctcagctcctccttgtcaaaggaggatgacttgtcttaacaactatttaggtgaattatttctacagtttttgaaagcaatggctctaaacaaattccactggggtgacaagtacaatacaaaggcgtagcctcgagggcttggggttcagaggttcatgttcttacacggtgattcttgacaaataaggcattaatcctgtcaggcattacccactcatatttgagcaaaccatgacctgctaactacagctttaattttagttcattaactcaacaattataaaaataattcactttttccaatcatttttatcaagaatattaaacatcagaaaaccggtaacgaaaaagataatagtttttatgtgaagtgcacaatgaaaaattcttgagtgaaacgtaacattgcatattttctccagaaataaagtctaaatcctgatactctcaattacatttaaatcaacacggacacagacacaggttattcatctttcaacatatcatccaataacacaaatccaataaagtttattggattaataacaaaaatcccccagtcctcaatatcaggtgaaaaaaactaaaggcaaaatgagaaggtgatataggaaggccgactgtgaaacaaattcagtagagaagcaacgatgggcacagtggtaacagcctttttattttagttaaatagcgttgatttttcaatttaagcttttgtttctggagttgcagagactgtttcccacagtcctctgaagaatacaatttaagggacaacttagattttcaagcatgttgtgctaggaccatgaatggtgataagctctcctggggctatagacagggagccaatgattcggaattccttggacacatgtgtcaccaatttgaggcaaatatggcacaagcccgttcccccctccatcccaacacacagacacacccacacagacacacacagagacacacacacacacacacacacacacactgaacctcctagctgtacctaatgtaaccaaaacatgaatttacactcccactggcaatcaactgtccccaagaattcagactcccactgggaaccaactgccccagtctgctgggattgggggtctcctgggcacagaacttggtgctgaagtcaggagattcccagaagacactggacagttagtcacccgtgtgttggtgcagcagcaagaacggtgatgcgaagtctggctgaattcaaagccatgcatccttcaggccttcttgcatcagattcctgcagagaacacagccgacagaataacttgggccacatgactggcttatatcgcttgaacaattgaactgctgtgaatcgacagcacagtgctgagaaatgtatagaactggcatgtgtatctctagcccccgacacctgcaggtcccgcagtctacagaccatgcctgcttgggtatgcacaggcatcacagcgggcttaaccatccccaaacgtaattccgggtccccatttgagcgaacgcctcagctttcacccaggttcccgaacaagattgcgcaattcgtttctttttttttttttttttttttttttgagacagagtctcactctgtcacccacgctggagtgcactggcgcgacctcggctcactgccagctccgcctcccaggttcacagcattctcctgcctcagcctcccgagtagctgggactacaggcgcccgccaccgcgcccggctaattttttgtattttttagtagagacggggtttcaccgtgttagccgggatggtctcgatctcctgacctcgtgatccgcccgcctcggcctccctaagtgctgggattacaggcgtgagccactgtgcccagcctgcaattcattcttgattcctcctactctgtgagcagattcagcctattatcagttcctaccccattctgcattaaaactccgtgtctccttatccacccccaacaccgccaccctccttacagtgcttaccgcctctcactgcctaactggactcctgacttcggtggacaccagacgcagcctcttcttccgcatccttgtcagtagacatgcagcttcatcttacttttcttctcccaacacatacctcttgattttcaaaatttggctctggtatacctctaggagatcttctttggataccctaccctagtctggctacaccgccgtttgagtataaactcttcaagtattttgttcccctagtcacatatacaatccttggaagcaaagaaaaagtgtggtttctgatttctaatacagagcacctttgcacagagtagacccaatgcagcactgatttagggctggctggggaaggagggcatagcagaaggaagctgataaagagactaaggcttcagtgcagccttccaggtcctattatcttagcatgttctctacatagcagctaatcaacctgaaactttcggtaagtaaatggataaaactatactcgtttagaaaggaagaatgtctgaaatagccattctaaaggcacttaagctacaactagaagtgaaaattatctcaaccataagaagagcaaaggtttttttccacagtttagttttaaagaaacttaatctaaatggcgtcctgtgatacacctacagaaactgaagtcttacaaacacatctcactccagactcatgacgcttctgtacgttgtttcttcatggacctgggatggcagagttaggagaagggctcctgtgtgttgctatcccagtgtgtcagtccgctgtcatcaacacaatatcaccatgtttaggctgggaaacttcgtgctatacaggaattttttcttaaggtctgacacgtaataaaggatgacggatatcaaagaggatttggacaacagccaaaaggaaaatggtatttcagaattaaagatgcaacaaaagctatgactctctttatcttactctgaaatacttctctaaaatatttgttggccttttccccaggttaaaaaaaataggagaaggagaacttcatgatggattcttgcatccattagcaaagaagatgatcacaaatccatgtaacaagcaaactaagtgacacccagaagctggaaaactggtcatcaactcagtacattttatacacagctgtcatgtgtatcattagaaggcaaatgatggagaaatgatacaagcacacagccaccttgcttgacagcacatctaagaatagaggaagctggtttccatttgtctctgcagctggaccagaaacacatcatgggcctcactttatagaatatgacctcctgcttgtgagatcaaattgacaaattgtgaatttttaaatcatcttattttctctttcaggaggaaaaacataaaacgcaattgaggccagatacagtggctcacccctgtaatctcagcactttgggaggccgaagcgggtcgatcacctgaggtcaggagttcaagaccagcctggccaacatggtgaaaccccgtctctactaaaaatacaaaaattcgctggatgtggtggcatgtgcctggaatcccagctactcaggaggctgaggcaagataactgcttgaacctgggagacaggttgcagtgagccaagatcatgccactgcaatccagcctgggtgacaaagtgagactccaactccaaaaaaaaaaaaaaaaaaaaaaaaaaaaaaaaaatgcagttaagatattagaagacaaacaataaattgcttatcttctccttaacacagtccattctcctcttcaagttcttcaatactatcattgaccaaaaaaaaaaaaaaaaaaaaaaatgtgaaagtacgtactgcacacttaaaataagaaggacattatgccaaatgctgagagggttaacagagagtggtccctgtcttttggaaaaagcatgacacaaactttattacaggtttttaaagcttgggccaattggttcagaaaatatgctttaaaatacaaagtatgtaacagaaaagatgttaagtgagatctaaaagctgaagacaatttgtaataaagacagcagtaataaaaaaattagtcatagagcaggaacatgttggtaaaaatactgtatctgtcactaatcaaatagctaggtatcaaagacaagatatcgacttcttagaaaaaaagtatttttaattgctgttaagagtattcttaacgaaaatcaccaacagacagggaatagtctttggaaaattgtaggttctaagtaaatgtttatagtgttggcacttcagtagtgacaccactttgggtagaactgaaaacagccctgtcttctcacaaacacggctgtagggatagaagagtagaggcaatattaaacatatttaatcatcagtatggcagagagaccctccaaccaatcatctgatctgatggatgctggctctggtggaagaaacaggcatgtggaccccctgctgcatcagtccttactgtctagttgctagatcctagggagaagacccatctgacaacctacgaggtaagctgaagaagctacctgtgaaggctgagccagtgggtacctgcaggacccatcctgaccaagcctggccctgggcactggcttcaaagggagaacacacccgtatttgaagccagtttccacccaccaactgtttatcctgagcatggcaattcctctgatttacaagagattttgatgagtgtggtttttttttaaaaaaaaaaaaaacaacaagaaaagaaaatcaatgttaatcgctgattcctggagcatctcagagaattaagccccataccaggtgtgtctggcacagagaaaaataatatgactatcgatgtgtttcttactgtgaaagagttattcctataccttttgataccatgatttgggttttacggacctagatgtgaaatgtgtcctgttaaacacatgtggagggaaggggggaactcatctttcccattctcaaccaagtggttttacctgtttgcccatcttacttacatatatcatttgaattgcatctttctaagactacttttgaatttgtagagtgcttgggacaccggagaggggtttgcggaggaagaagtgattggggcttcccgaggtctggaacaggaagggaatgtttactaaactcaggggagtgacagggaaaaaacaaacataatgcattgaaaagtcttgcttattggaaaagattacctgtagttttctataagaaatgatcatctggacatacccatgtaattaagaaaatttcaattttatactagatgggcctgttaatttattgtctctgagcttcaaatgcaccctacattgctacttaatcataatggagccaatcatcataaatatttattttcaaatagcatgatgttaagctcagacaatgaagagcactagaggttcacatgggagaggcagcttcccttcccggtccttcatgtgctcctctgtatgggatccagcagcataggacacctcttcactggctgcttctcccaagtccctcttagctggcttctcaccacctcagcacccttgcagacagctttgcagtgacttccgaggcttggcacctcccctgggacagcttgatgcagcaccgtagtgaacgtctccattttcccatacaccatggggcagagtctatgtatgtcaacccaggcagaaaaacccagatgtacttctttggttggtggcacttcccctgagaggtagtgacttctccctatatccggtattcctctattctttaaaattccttttacccctgaggtacacaatccttcatgtttttaactccttatatacttaatatttctttacatgaaactttctgtgtttaaattactttatggttttgctgtcttgagtggatgctgattaatatactaaatatcaaaatgatactaatcaccttgtaaagaaatatggaacttataatgatcggtcacacttaaatggttgcagagtaaccacaaaaaatgacactcaatgagaaatatctttctccctctttttttttgtgtgcgcacaagggatcgattagctgaaagttatatcagtaatcataataatgaaattaatttataaacctaaagttattacaagtttatggggattattggcagtgatttttatcagttggtttctaaaacagtctgaagttaaagttatgtgtaactactattgctaagcatgcatattatgagaaatagatgaaaattctgtatagtgtgaaagaggtatgtattttcttaatgttaactgttactctttgaaagacattgtaacagtaaatacaaggaaaaaaaagaaaaatcatcacccacacctcagcagcaaaatcaatgagaatgtattttgtattctcaaaggtccttgtctgaaactaaccaaaactgcagcaaaataattagattatttctttattagtgggaaaaatattctccttttgttacttacaaaaacattttatgcattgaataagataacggttaggaatatttaattttttttaacaacttttcaattagatccaaagacccactttcagaactgaggcaagcgtagcactgaatactcattccacagtgaaacaagcacaatgggtggagaatgtattaaaaatatttaagtttctggaagtgcattaagcttgtaaaccaacgaggaaacatctaaccaagaacatctcagtgaggattcacgtttgtgcagcttgggccacagcctgctttcttccccttatctccaatctaggtgagtatggccaggaaaactagattctctctacctgcagattccagccagggtacgcttctaaccaggagggtcaggccaccatcctttctcatcctcacaagcttcataggcaaaggataaactgcagatgagtttggccaacaggccatgtcgctttcaagttccacctatgtaggaggtatgggaggctcaactccagaataaaaggtcaaaatgctgcagttcctgtcacttgtgcaccagatggcatataaggtgaaggttctatgccaccaggagcaaaccaagacaatcaagctctcacctcagacccgtggtttactcatgaaacaagaatgtcagtccagcagaagctgagagtgtctctgccccacgtctgaagcagtggctcagagatttttcccaagaggagagatagagggcaggaaattcaaatccaaggttgctctcaaaaataaatggaaattgtgaggataagcaatttagaggagcctggtgctttcactagagctgcaggctaatccatggaatggctagtctaagataataagagacagagaagaagatcgcattgtgggttagaacaaacctcaaagcctggcctcaaaaatatctcctgcaaagaagtgtggacataagaatatggagcccagagcaagttcagaaataatgaagcaatcaggtggaaatttattagtgattcagcctctagcctccagaactatgagaaaattaatttttgctgtttaaaaccatacaatttgtggtactttgtgtcactgggcctagataactaaagcatgcccctaccagagcctcaaaatatataaaacagaacctgacaaaattgcatgccaaataaacaatcaaacaataatgactgttctactcattttcatagaggaacagaacaatctagccaaaatgaccatcagactagacaaccaaaatagtactataaaccaactggaatgaacagacatctacagaacattccagccaataacagaatattgttttcaagggcgtatgaaacattctccacaacagagcatatgccatgccacagaactactttcagtttatttaaaatgagtgaaattatataaataaattatctgagctcaatgcaagaaaattagaatttgagaaataatagaatacgtggaagttaaaaaaatttctaaaaacccaaaggagttaaagaaatcactagggaaatttaaaaataatatgaacgaaaatggagatcaaatacatcaaaatgtatgaaatgcaactgaagaattgcatagagggaaatttagagtagtaaataactatatttaaaaagaaaaaatcttacataaatagcctcaccttccacctcactgtcctggaaaaagtacaagctaaacttacggtaagcagaataacaaatattctagtgagaataatcaagtatacaatagaaaaaaatgaacgtaagcaaattcaaagaaatttttaaaccttctacaaaattaagaatcttttgctagactgttcaagaaataaagaagtctcaaattactaaaatgggggaaaaaaaggtagagaatattactatggaccttacagatatttaagaagaagactgtaagagaattttataaacatctggtagtcaacaaactggatgactacaaaaatacaaattacccaaaacttaagtcaaacaacatcagaatagacctcaagtaaaggtagtaattttaaaattatgctaaagaaaattccaggctcaaatggcttcactggtgaattctaccaaacattgagagtagaattattgtcagtctttaataaattctttccaaaaatagaagagggatcacattccaacttattttataaggtcaataccccaatatcaaagccagacatagttatagatagaaactacagactagtatttcttaagaatatgaacacaaaaatgctcaaaacaaatcaagaaattcagatccaacaacatataaagcattatatactgtgtccaagtgctatttatctcaggaatgcaagataggcttagcatctgaaaatctaacactgtgccataacaataaaataaagtcagctgattgtcttaccagataaaaagtgacaaaattcaacattctttgatgataaaaacaattaactagcaatggggaatttcttcaacctgataaaagtcacctgcgaaaagcctacagttaacattgtatttaatgaaatattgaacattttctgcctaaaatcagcaataagacaaattctattccacagcatactggaggttttagctagggcagtgatgcaggaaatttaaaggcataaagataggtaaagaagataaaaatataactatttacaaatcacatgatctagtatacagaacatcttagatatccattaaaaactattagaatttaagaacatctccagcaaggttacagagtagaagatgaatatgcaaaaatccatatttttttttggtgggtgggggtggggtgttgggggatacatcatcccgttgcccagtctgaaatgcagtggtacaatctcagcccactgcatcgtgtacctcctgggctcaagcaatcctcccacctcagcctgctgtatagctggggccatgggcaaacaccaccatagccagctcatcttatttattatttatttacttattttttttttttttttggagatggagtctcgctctgtcacccaggctggagtgcagtagtacgatctcagctcactgcaagctccacctacggggttcccgccattctcctgcctcagcctcccgagtagctcggactacaggagcccgccaccacgcccggctaatttttctgtatttttagaagagacggggtttcatcatgttagccaggatgggctctatctcccgacctcctgatccgcccacctcggcctcccaaattgctgggattacaggctgagccaccacgtctggctgctaatcttattttttatagggatgaagtctcactgtgttgcacaggctggtctcaaactcctgggctcaagggatcctcccaccttggcctctcaaagtgctgggattacaggtgtgagccaccacactcagccacaaaaagcaattgtatttatccacaatagtaataagctgaacatgaaatttaaaaagaaaacaatccctttaccatagcatctaaaaactccaaaataattaggaataaatttaacaaaataagtacaaaatatatattccaaaaactataagtgtttaaagaaattgaagacctaaataaatggaaaaatatttcatgtacatgaatcagaagacttaatatagataagatggcaatactccccaaattgattagcaaatttaacataattcctattaaaatctctgctggcttatttgcgtacattaacaagctgatcctaaaatgcatatggatattcaaaggacttagaatactcaaaacaatctttaaaaaagaaaaatttcaatattcatacctacctgattcagcactttctaggaaaccgcattgatcatgattccattatgcttgcattagacacatggattaatgaaataaaattcacgttccagagataaaaaccactgacattacccgtcaatttgatttttgacaagatgccaaaacaatcaagaaaaaaatagtttttcaataaatggtgctcagacaactgagtatccacaagagggtaccccttccttacactatccacaaaaaaattgataaatcatagacccaaatgtaagaagtgcagctcaaactctttgaagaaaatataggagtaaatctttgtaacctgatgttaagcaaagtcttcttagatatgacatcaaaagcacaagaaaagaattaactggaattcatcaaaattttaaactttgtatttcaaaaaacattagaacagaaaaagatctatagaatagggaaagtttgcaaattatataaaatataaataacttgcatctggaatacataaagatctcttaaaactcagcaataaaaagacaaattaccaagtatgggcacaataatcgaatagacgctgccccaaagaagatacacaaatggccaagaagcccgtataaaaattctcagcatccttagccatcaaggaaatgcaaatcaaagacgtactgagataccagttcatgtccactaaaataggtaccatcaaaaagacagttagtaagtgttggtgaggaggtgtatgggtgtttcacttccctatggctggtgagaatatagaatggtgcgtctattttgtaaaatactccggaagttcgacataacattgccatatgaaccagcaaatccacagctagttctatacttaaaatgtgtccacgtaaaaatttgtatgcaaatggttatagcagagttattcataattgcaaaaagtggaaacaatacaaatgtcagtcaaccgatgaaaaaacatggtctatatccatcatattaaataggatccagaaatacagaagaagtgaactgccgatttattccacaacctgacaaaccttgaaaacctactaaatggaaagagctagtcacaaaacacattttgtaccattgcacttacattaaatgtccagaataggccaatccctagagacgaaaataaattagtgtttcctttgggccgtggggctgagggaaaatagtgagtgggtactaatggatactgggttttttgcattaaacatcttccaaaaataactgtggtgatgaatgcataaccccaggaatatattaaaaagcactgaagagtacacttcaggtcaatattgtggtatgtgaatcatttcaatatagctctgattaaaagaaagcagcagctcaggactagagaacagagcgcaatatgggatattgaaattccatttagctataagtctcatttcctgttatatcacatgacacctatattaattcagtttacgaattaaaaaaaaaggaatatggtaagaagactgaaagaaacaggtttctcagttttctaaaagaatgagatagagctcagaaccttgagtcgaaggcttatccctccagctggaattctacttcctctctacttcacttacaggactctaatttagccttccaagacccagtttggatttcactgcctcttaacattcccacattaacatcttcctgcagtgattgtatgaagcacagggcattattatgtatgcatgcaatggacagacgctcttcaacttacagtgcggttatgttctaataaaaacattgtaagctgaaaagagtgatgaaaatgcatttaatatacctaacctgcaaaacattgtagcttagccttgcctaccttaaacacactcagaacacgcacattagcctacagctgggaaaaccacctaagtcaaagcttattttataataacacattgagtatctcgtgtcatttattcaatattgaactaaaagtgaaaagcagaatggtcgtatgggtactcaacgggtggtttctactgaacgtgttattactttcacgctattgtaaaagggtaagagtcccaagttgaaccatggtaagtcaggggccgcctgtagtcaatcctgtaatatagccaaactctgtattgttgtgttttaatgtatctacactgattggatcatcagcatccgttgctttaaggcgagtcctgctgagtggggtggggctgggctgagagatcaagaaaactgattctctttgaagttttgggaggaaagtatctatgatcccaatttaccctgctgtgttagttttattagttttttattagtttttattagttttattagcctctccattggggctgagcacgaagccatattcaaaccagatgtgcttcctcccactcatgatgccaccagaatgacttctttttcctgaacccaggagctaccttgggaaaggaagaaaataggaaaaaagggaaacacaacaaggccgagcatttcagactcagtttacctgaaacggaacggttttcactgggagacactaacagttaattttcccatctaaggctcagaatattacccccaaactatgtcactttatgtcaccagagggaataggaagtccaaaccaggaggatgccacataaagtatacacatttgctctgaagtttgagtatgtgtctctttcatctttttttccagtgcctgtgacccaggtgctaacccagacactaggatgtcttggtgaagatgacggtccctgtgcttgcaaaaagtgtacatcagtacatgtctactaaagataaatgagaaaacatggtttgaaagtctatttcatcatgctgaaggagccttgtacgttcaccattgacaccatcctgccttgccatattattttaaaataccaagatggttcgtcgtcctcccaagaggtgacttaacagtgggggatatggaagcacatacaactccactctcagaatggaagtcaagtaaagcaatgcctgtttttcagcaggccacttagaagtcagacgttgaggattattaagttaaggcctcagtagaacaagatttccaaatcccaagtactggagagatgaaattcactttattgctctgaccattaaaggaagaagaatggtaggaaaggatgctggtgtttggaggaactctagtttgtaggtcatctattattttctcacctctgagaatgggggtggttatgggtactttactgccaacccaccccacattcctgaagtatctcaagccacacattctatcctcttcacaggtgattgtatctggaagtggctgactcactgcactaacaaactcacagccatagaagaaggaaaagtcagtagagaaattatgtgcttccaataccttgtgggagagacaaggacagatgggaaaagactgagacattaaagatgtgcaatcacatttggattgacaaattacttttattaccatccaatgataacacaagtcaaacaagttatggagagattaaatatcatgacaccagctctcgagtaaatgggaggatagttttataaagaatgaaatattgtgagagagtcttactccgtggtcttaagagctgtttaagattgggcatgatgcttttataatagtgagacagggatctctcctggctatccttcccagataaccacagatcagtggaagaataagcttgatgaggaagaaaacagaggaggaggaggagaaacagaagagggaagaaagaaagggaagaaaagttgacagaggttgacaaggactagccatggagatgtatcggggagttgaagaaaaaacaaagccaaaaaaaacactcactttgatattgtcttcaaatgagtatatatatactcaatatataggcaaggaaatttagcctatatattgaacaaatgttgaagtttattgtttagaaggcaatggaaagctgtgtttggaaaaccatgagcaaaaatgggcaaacaaatgccaacagtgtcacaaagtttagttattctaagagttcataagccagttcaattttttgactttatttaaatgtttaatttttcagaacaaatataactctgagttgggatatgttctccagtcccagctttttaaaaattttaaaatggtgtacaacaaatacatatttccaataatactatatttatcaaattataatatgagaataccaccaactgaaatccatagaaaaataacaagccatttaaaatttaaattcagagagcaggggaaacattattccaagatgacttcagcgatgagactaaggttatttttaattatattgaaattttacagtgtgtttttacagcattgaaattagaatttcctgtgaacatttcttccttcccttagctgtaaggaaatgctcagctgtgggagctttctcaacatagctcaactggcctcaaaggcaacaaaagtctgtttcatggcagaacaattaaaagaagtgattagctttgatttcttttcaaatttcaacttagtcttgctctagattcttcagagtaaaaaaaaaaaaaaaaaagaaaaaaaaagaaaaaacaaatgttgacaactcgttctgtaaacaatgttcaaagtccttaacagtttccttgtgtctgcacaaagctcccagggacacattccagctaagaatctacttcaattcgtgttcaattaaaccaattcatggcaaggaaaggaggagtcactatacagattatttaattgacccattactgaatgtgtaattcctgcacctggatcaattcaaatgtcctcattccctgctcatctcctccatttttctctttttccgtcttagactaccaagcagacatccttctaaaccgttaatcttggctgtctttgtgccacccatgagtggccagaggatagagttctgacttaagcacagacaacttttttctttacttagcacattaaacctgttgaaaaattgttattttaagaaacaaatattttctcccttttcaagagtcagtgcattataacaattcttttcagttttctgaaatatcttgttttacctttcttgtccacatgaaccaaatcaaggtgcaaatagggttggacaagctattatctttttaaaaaaatctcaagcccaatggtaaagctaaagctaacaaaatatttaccgtagaaagcaccttgcatttactatttcttatatggggaaagaactagtgaaataattggacaaactcaatgaaataattggacaaaagtcagtgaaaaggagttccaaaaaaacagaatcatctagtgggttgaacactggtttttgggatccaaacagttggaattccattcctgaactaacaaagtaatatgatggtttacaaggcttgactaaggaccctgtcctaagctgtagatttgtgtagtgataaccccatctctcacatgggttactcaacaggccctgcctcctgtccgtccctgtcttctgaaattgatctgcactgttctgatgaaccgctttctaaaattcagatataactttttgactaaaaaaagcctacagctctctattttctgtgctctaacagcacttgtcacgctgtgtaagttgagaaagcagcagtgcctggggcatgcctggggaaaggaaggagagctggctgacttctgagactcctgaccccaccttcacccaaggaacttgagaaagtgttgatcttctgttattgactgggcgataggcctttttaaaggtgttatcacaaaaccttttaaaaaccattaataaagaggataatattttgattttaaacctttagcagggtagacaacacctactttgatgagactcaggccaaaacttcaaaccttatgatttaagctcttgatataccaactcattcttatcctctgaacatgtacttttctatttcttcttacatgaaggcatttacacactcttgtccccagctaaatcctccttccttgattcatccattcagccacaaatgatttttcaagattcaatttgaacctaattgttaaaatggtccatatcctactaaacctaggtagatctcctcccctggactgtatgtatcataacaagagtgtttagcataattcaaaaacattgcttagggagagcctactctgggcttgcttctatgtctgaatcagcttagcatgtcctgtgtttttcatataatggataatcaataattattgtattgaatttagcccaaacagcaattgaattatcaattaagctaattataaacttgaacactgcaaggaattttagaatattttggctaataggaaaggaatgctggaaacaagctcattctgtttgactccttacagaccttcaagagcatgatgtgagatgggtatagttctcttatcagagactctaaaaggaaaaaaagttcaaaagacaatgctatactctctaaatgaaattttaataacaagagcacaattgtgtcttacacagaagacctgtttgaagagtttggtgtggcctccctggagctcttttggtaggaaaatggaagaaggcactacttacttaaagacaaatacacatcagtggcagggacctagaaattacctctccaaggccaagacctaaggaaaggaaagctcataaaaggagctcaggggtcaggctgcagcaaagacactatgattgtcatagtcagtgggactttctcattctaacaattattttcggctttctgaaaagtcttgttattttaccttgtccacgtgaaccaaatcaaggtgcaaaacggctggtgtcagcattctgccgtattttcagattacaagtatcatctgggactgcaaattgtgttattggctacatttagagaaccaattcagatcaaaacaggtgagtagattttacctagaaccaaacctattccttccggagccttcctcttctcaattaacggcaaacctattctttcagtagcttgtgcaaacaccttggagtggtctttgactctgtgtattcctgacatccctaatgtagcttagaggccagtgtctccccacctcgtctggaaacaggcccagggaactcttgtcatcacaggcctaacgtcaccacttttgcccttgtccctctacatctctgcacaggaggcaatggaaggagcccttggaatatgccaggcgacagcactcctctgcttacagccttctcacggagggaacccaaagtccttaaaatgactcgcacacctacgtgatctggcctttggttttcctttttttttttttatttgagacggagtgtcgctctgtcgccctggctggagtgcagtggtgtgatctcggctcactgcaagctccacctcctggattcacaccatcatcctgcctcagcctcccgagtagctgggattacaggcgcccgctaacatgcccggctaatttctttttgtatttttagtagagatggggtttcaccgtgttagccaggatggtctcgatctcctgatctcgtgatccgcccgcctcggcctcccaaagggctgggattacaggtggcctttggttttcataacctcatctattcctctccattgtgatccttcacctgcctcctctggcctctgatatttttcagccctgccaggtccatttcccatcaggggctcctcctctatcccgagccttctccctcctctccttcaacctttatttcatgctagtttctacaacgtggcgtcacttgactacgatggttcaactcccaatgcttcctctctcttccctcttatttttatctgtagaattatcacctgacaatttcttcacagaagtgatagtgctgctatgtagacaggttggggtcatggtcggcagctcaatgcttaactggaaggataagtgcatcaaacacggaattccttacattaaatgaactcagacaaaaatgacatgccaaaggattcagagtgaatgtacaaccaaataatataactgccaaacactggtctaagagctcataaatggctttcctgtacgttaaccatttcaacagtgagatttctaaacggccattagtgctttttgaaaaagaatggtacgaaagagtaaagacaaaaagaagaaaggtaaaatgaacacagaaaaacaccatgaatgacttaattggacccagattatttagacaatatttaaggattgtctaacacattcttacaggttatctgaatcgatgttgtctctgggcttctttgattttttttgagttatgtaaaactgaattatttttaagtaactcttaatgtaaatgattgtttagtatgaatgtgtaaataagtatttttgggatttccctcaagtgacatgtcaattcagtgtcttttaaatatatttgagcattacatactttttatgtacgaggattctatgaaatatcttttgaacttgcaaggtctaatttcctcattaataaatcagttaaaatctttgacatatttgttttgtatttgtgtgaaatgtttaatttttaaaattatccttcaacagaacagaaccattatcacatgccaggccttactggatttaattccaacaacattattatggaaaaacaatcttagaaaaagtctcgtgttccccaagctcacaaaatggtgtcctacttaaaaaaatcaggaacaataaatttcacaacaaagtcaaacaggttggtaaaaagctggaaaaggcaatagtgatcactatatcgcagcttatttctagaagacattgggttagactatttctaatttactattttgacaaggttcctatacaggtagattacccaagtgcagcacgtagctgtcagcaagcctctcgacaaaatcattcacaagatgcatgtgcctaacaaaacatggctcagtgtctgggtggtcacaggacggcacttctgcttaagaattagaaccagtgcatggtgtttaataacgaaggcccgttttagagagaggtgcagggagaaaacaacccagaacattacacctaactctgcggcgactggttggaaagaactgggaatgctcaccctggttgaggaaggccagcgaacgcagagagaacacgacccatcttcaaagaaaaatgcagcaaacacgcggagaaaagaagttagacccatttctttagcgtcacaaaggagactgaggagcaatatatagatgttaacaggaagctggcaggtgtgtctaatgactacgctgcaaggaaggtgttttcaatgattaggctacaaaaaatggtgtttccagtgggtaggctacaaaggtgtttccaatgattaggaaataacagggactttatagagggtgcaaaacagtgaataggaagccttctaagcgatacgtattatctgctctaaccctaagaatcaacatttcttccaattttttaactagaaataattggaactcagatttaatgcttagctgggaaacttgttcgacacagtcagcagagatctgttctaaagaatgctttaattctttcttcaatatcgatgtgtcttgattgtcatactttttaaatattaattttacttttattaaaatgttattttttctcttatttaggaaatctcaaaaattattttaaaatcgaatagttcttacacttttgcacagcctcagatgcagtctcttctaataattaaaaaagtaaagctctaatttttacttgacaacttaccaatagtagagaaagcatgtatgtacctggtttatttcatccatcacttgatctgtagtaacagtgcttcactgtagtctcttaatacttttattttaaaggtatatgtcatttatagacatatatttaaggtaataacagatgaataaaatgagagggacccggggaaccttatttatgctttgtaaaaaataaaaggaaataccaaaacagtatttagaattatattccaaagaatagctattagaaagttattcatcatcactttgaaaagttaaaatatttaacaagatattctgcaaacaataagaaaaataattttaaacaaataatttataaaatattaattgctttgttatatcaagaaaatattgaaatgagcatattaggtgtaaacagcacttttactttcataactgtggacgttcacttcttttaatatagaaagttattttaaaataccattcaatatcattgatcttagatacttaaaaaatttggtatatataccctttctgtaagtgtgatgacatatgattaaacatagttattcacttttagaaaaattatagtagaaatttttgccataatattttgataatttacactccattctatgtaaatctacagtaacattacctatttatatttcatatatattatttttatatgtacacataaattatattgtttaaattcctcaaacaagtcaaaatattcaaattctgcattaagtgatattttaggatatgggcctgaattatgtaacattttctctacttgtgtttgaatttagataattacaaccttatagtaaattcctggaatatagattttaaaattccaatgattttccaaaccaatgacgacttaaaatttcaattataaatgattaaaaagttttaaattttaagccattttgtaaaattgtaaactctcatggttacattttcggatttagaaatatgacaatcaatgtgagttcttaacacaaaaggagggaaaatcagcagagacaacctgatgccattggggtatctgaggttgagaaagtggctggcttaccccattctcattgtaggtagtctttaatccagtcagcttacctgagtattattttgtttcataagcaaggatttcacaaagtaatacccagtgtctgcaaatccaaagaacccccactcccctcttgcacctgctttgcaattaggctatgcctttttcttgtacttctgcctctccatatcaatagtagttatgcacaaatacggacaagatgacattgtacatcactttacctaaacttggggagtttagtttcctttatctgtgaaaacaaagagcatatgactctaggtaactgtcaaaattaaatgatgtaaggtatgcaggaatgtgtagcatgtagtaacacataaatgttagtttcttttcaaccaaatggctttgggttttcttttaacctattatcttataaaatgacagaaaaatagagatagaattgtcaaataggaacacgcaaatgatcgtagcatatataagaatttaatatatgagagaggtagcttttcaaatcagtgaaaaagaacaaactaatcaataaataatattaaagcaaatggttttctactggggggaggatttaggtacctgtgtcaaaagagacacaaaaaattaatttcagaaagacccaatccattaaataagagatactatcaaagaaataaaagcaaatatatgcaaacgtataatgtatgcaattacaatctaaacgaacatacacaaaaagaaactagagagattgaaaatgataaatttgcctgccttacaacacaatttccacacatggaaataatcttcgtaagtgaaaatttaaatgtaagaacggcctacaagttgtttattataggtataacacgagacataaatttaaattatgtttatgtttataaatagttcagcaaggtgacagattaacgttccaaatagaaaaaaaacataccactcagacattataaggaagattttatgctggtgttgtctaacttgagctgattagaataagaggaggacagagaattggtctaagaaaggcagagggtcatagaagtgaaaaagaaattctgtagaatggagagagactgaaaatggaaaatcaaagttgctaagggctgcagtcttagagagcagattagtacaaactttgagcagatgtcatggggtttagcacttttgagagtgagagctctaaagagaacctttaggcggtgtttctgtgtgagctactacgtaacccattcctgggtgccctcaggaattacagagtaaactcttacacagttgacgttgaacaacaacgtggatctcaactgagcagtttactcccacgtggactttcttctccctctgccatccggagacagcaaataccacacctcctgtttctcctccccagcctactcagcatgaagaccatgaggaggaagaattttgtgaccccttccacttaatcaatagtaaatatattttctcttccttatgactttcttaacattattttctctagcttactttcttgtaagactatacatataacatacaaaatgtgttaattgacggtttgtgttatctgtaagattcctggtcaactacaggctgttagtaattacgttttgggggagttgaaagttttatgtggatttttcaatgcataaggggtcagtgtcctaacctctgtgttattcaaggattaactgtatttatttttaagcatttgaaaaatggatatgtgttttaggatgctttattatgtttaggctagtattaagcaagcctattgatatgattatggttgcctataatacagggctgtgaatatatatcttaaaagttgtggatggcattcaatactgtttatctatttcctccctccctctctcactccatttctatatccataatagtttgaaatctaaatattacaagcatgtctccaaattgtgatagcttcataagacagaagcagtatattaataaagagttaatgtatgaacaatatcaaatgtgttatgatcctgaaaacttgttgagtgtttctcttttttaatattcacctgtggcatcatatggaaggcaaccccatttgattctcgatacagagaacccagaattgtgttttttagagaaaaacatggactcagagataactagaaagtttcatctatcttgcaacctatacgtcttaaataccacccaggcacaacgttcttttcttagggttttttttctttttctttttcttttttcttttcttcgagacggagtcgccctttgtcacccaggctggagtgcagtggcatgatctcagctcactgcagctgcctctgggttcaagggattctcctgcatcagcctcccgagtagctgggattacaggcgtgcaccaccacacacagctaatttttgtatttttagtacagatgggatttcattatgttgaccaggctggtctcaaactcctgacctcaggtgatccacctgccttacgctccgaaagtgctggaattacaggcttgagccacctcacctggctcttttattatactttgttggtgttattgctgttggtttcattttgttgtctgtatttttgtttatttgcacagtcatatctttcattttccgtaattaatcagcagacaaaagcaatgtattatttagaaaatttctggttaagacagtgtgattttttcaatttaattatatatatttaatacataatagattaaatttataaacaagttacattaactattaaaagtctcttgtgtaatcttccaattaaaatatagtttgcttcaccagcataactgataatttctttttaacagaaaataaaacttttttaaaaaaagatatgctagaagatattatactttttattcatcatgatagagaccggatgtttataagcatgtatctattctaacacgaaatttcacatgtcaaatttaggatcataagaatatggtattagtattcagcacaattttggctttacattttggaattttggtagttaagtgtgattaattcagcttcttttaaatgtagtcatatatacatatggtaaaatcatataatttgggaatactcatctgaattaatactgaaattgaacatcatcactacttttcggagttctaaaatatgtatttataaaacagaaagggattttaaaataaaacataatcaaataggtctccacaacacttttagtaaaacactgagggtttgagactgcctttagaaatagcaactcatagtctaacaccatcccaaggctgtggactcccaggtcaaatgccagttcaagtcccgatttcaccactcactttatgaatagctttcttaatttctatacctccgtttgttcatatgtaaggattagatggcacagagagcacctgacacatgaagtcctccatcaaaacccatcaccgtacttccctggattccttacgaaaaaagcttcagtcaaaacataaactacaggcttttttgtgaaggaaaaatcccagggaatcaagggtgaaaagagaaagaaatgaagcagggaaggtaggtaaagaaaagcatgaggtgtgctgctgaatgccaattgctggctgcctaggatggacaggtggctgtggttacagggatttccctcccgcagggctggtgggaccccagccttgcagctgtgtcagggagagggaagagcaggtgtgagcactccttcccaccacctgtctcttaagagtcacagtttatccagtgggcattctgtgacccttccttatcccactgtcttcctgcgcagacacctccagctgagcccagcccaggtgagagggctcccagtgacagagctacctagggctagagccactgcagctcccactaaggtgtggacggtggaggctgagctggtcctcaccgtggggaagccgaggcgttggtgctggaaggagttaggctgtcatggcagccgaggggctctccacaagccatcggcaacgcctcgatcagtctcggggacttggtgctgagcaaaattggggggctcagaaactgagtctggtaaaacacatgattttcagatatttatatttaatcactataattaaaatgcagcattacgtgagtggcctggcattttcacacgatgctctatgacacacacagtttaaatgtacatctttttttaaaaattgcgagttgagaagttcctatttaaactgacttctgcacagagaaaggcactgtgagatatctaagaaatcgttgactgggtactggaagtgacgcaaggcatgtccccaaaggatagactgaaacaacctttgtcaattatgcacataccaaaagccattcttgtccaaacctcttactcacaatactgtattttaagtgagaacttttattaaggtggctacagatttggttagtatgtgctgtattatatttttggtttgtttgctttaactggacataaattctgaaaatctcataatcctcatttataactggtggcaaaacctgatacctgatcaatttttgcctggcgcatgatagctatgcaataaatattcatgcattccatccatttctatccatgcagaaaactgttaagtaccgggaactcagtgaattctactaccattcactttcatctcctctgtagcactccccgagttaaaactgattttaacctgtttttttatggggccataagacctacccctggctgttacgttcacaggcctagtgcctgtaacagcaaagatgggcaattttcttactttccttcttcccctctttttatattctttcactcgccaaatgattcacttcatgttaatactgaaaagcttccttagaaatgcttatttcccaatttgctcctaaggttgaaaatagtaaaaagcaactcaaagcaacatgagttgcctcatgtgacagtttaatttatttttacatcttctaagctctgggaaatattaagatttgaaacacacaagtccaaagtattgaaatactttgtaaagttatatatcttgtcagtaagtcacaaatgcctttagataaaaattgaatcaatagtttcttcattagctttcccccccaaaaaaactgaaagtagatgtataaatcaaagaaaatttaatacactgccttccatttaatgtaccgatattgatgatagtaaacgacattaataatgaagcaaaagaaagtattattggcagggcgttataaactatcagagaggaaactataaattttctaatgtcaagttaattttatatggccatggtgcatgttaactggttacttgtaaagctgattcttctccaaaatgcacactttttccttagctcatagaaattcataaaatatgtaacaaattttaatggcattcaaaatatttaaatattctttggagaatagtttcaacatatttcatatgctttgacatccatacttagatttttgaaaacagggctagacttaaaaagcagacaaatggaaatttaatttagtttctggcaattgtacttgactgaccttaattcacggaaattttctcaaccttagtttattaattcccccaaaaggaacgataattcctacactaaaacactgttgcaattcctagggaagataacacagagtatggcaggggctcaatgctattcaaatgtttacgtgtgtaaagaaataagacacagttatatctattttctggcatagagaaaattacaattctttaataaggttaatttataaataaatacataaataataatgggtccacaaccttgaaatgtcttcagagccctgagaagatacccctggaattacatattaatattgccagcatattatctcaggaataaatcaaagttgcatttgtttgcttgtgaatgtgtttttcttggtaagtatgaaaaaggaattttatacagttgaacagctgcactttaccacatatgtccggttacaaaattgattatagttagcaggtagagctttcacttcagtaattaagaaaccagaaaacaaaacaaaacaatatatttggtgcaacttaccatacaaccaaaataacaaagaccttaatggattctcagtagtttcataaatacctttgcctcttatttactcattgatcactcgtttcacttccagagcacaaataacatttttctctaaaattttagttgactgctttaaaaatgactttccagctgggtgcagtggctcacgcctgtaatcccagcactttgggagatccaggtgggtagaccacgaggtcaggagagagagaccatcctggccaacatggtgaaaccccgtctctactaaaaatacaaaaattagcttccttagaagctaattctctactgagaattagagaaaccccgttctctactgaaaacacaaaaattagccaggcgtggtggcgcccactcctttagttccagctactcgggaggctgaggcaggagaattgcttgaacctgggaggcagaggttgcagtgagccgagatggagccactgcattccagcctgggtgacacagcaagtctctgtctcaaaaaaaaaaaaaaataaaaagtcaacaaaaaaaagcaaactggataaagcaaacatacttatcctatcattctccctggagaatgtggtcgtgagttctgttagagaagtttgaagtagctgaaccatgaccagttaaaaggaactttgttctgtgctgtttcattgagaatctgttttctactattttcctaataccacgagagtgcattgttatctcacaaaaaaaaaaaaacaaaaaaaaaccgagaaggaaattactgctgtaaggaaaaagcaggacttctcatgtctagggtagctctgagttgacccccaggatgaatttgcacaaatcacttaacctgtgtgtttctgcagcctttgagaaactggttcacctgttagctgagaaaattacatttctcactagaatatttgagccttaatttaagtttgtaaagcgcgttaacatccttatctcgagtctattgcgagcataaccttctactctcataaaaaagcaggggcctcagctagttgtattagacaaccagatacttggtggacggaaatttctccgcctttttgcaccatgcgtcaagcggaggtcctgttactgcaatcagcacggtttagcttcaccttacaaaaccaagaatgcatgagaaacaaacacgtctgtgggccattctctaaaataggcttgcatttactaactccctatgggtccttgtgtagctgtgtatccatctctttctgacaaccacctggtatagaatccacttttttgaggtttcaaaatatactgcattatatgttgaagacgaggactcaggaaccaattaatattgagctgtgtttcctgaggccgactgccacattcaggttttgtcacaccattgtcattaatccctgggtccctggttaaagatctagattcctggggtacatccctagttgttgagttcatcatcttagtgactggccctagaaatctacctattaacagtcttccccaggtgattctttggtgcagtgatttttgaaaccttcacaataaaacagctatttgtttctatttctctcccaacccaagtagtgacaagatatgaatatatctaaatatcacctaagtaggaaactgccttttccactccagccttatttacaatgagcatctcaaggcttgagagccacacatgtaagattccgaatacacatcagttccagattatagtcaattgtgcttgtttagctttaccttcctatcagcagacctaagagtccaaatttagatttgtacgtgcccatgcacattttcctgctgtgccagccctatcacactgacccttatctttcccatttttaattataatgcattaaagtctatagcttaatctatcaaaagggttatttcaataaatataaaatgagacatctcaatgctaaggagaccttggatcacagttgaattggcagtgttttattttttcttagtgggagataaaataatgatgtgttcagcatgggaaggcatatgagatttgatcaaatatcttctcatttgctgttttaaagatagagaaggaattaacctgtttttatttggtgacggactaagctaatatttttcacgtgtgatctcatctaatccttataaaataaactttaacacatgaggaaataaaagcaccaagaggttaaatacctgagtccacagaccttgtaaatgcttcaggactcagtctatttggtttgttccatatattagactacttctttaagcttaaagaagtaaatattagatactgtgcctagtatatgccagagactattgtgagcacataatgggattaacttgtttaattttaataatcccaggaggtaggtactccacctacttctattttagaagtcaggaaactgtagcacaatgagatcaagtagcttgatcaaagtgacttgaggtgtggaaacaacagaatgcagaagcctggctttatgatccattactcttagctgctatattatataggctttatcagtacaagtctttccagagatttatgaattctcctgccacacccttccatggccacctttatgactgtatacaaaatcattgatacaaaggtagcaatacaataactctcttttaaaaaacttttaagttcaggggtacatgagcaggttacataagtaaacttgtgtcatgggggtttgctgtatagattatttcaccccccaagtattaagccaagtacccagtaattatttttccagatcctctcccttctcccatcctccacccttatagcccccagtgtgtgttgttcctctctgtgtgtccatgggatctcttcattcagctcccatttataagtgagaacatgcggtattcggttttctgttcctgagttagtttgctaaggataatggcctccagctccatccatgctcctgcaaaggacatgatcttatttgttcttatggctgcatagtactccatggtgtgtatgtaccatattttctctacccagtctattattgatgggcatttaggttgactccatgtctttgctattgtgaatagtgttgcaatgaacacacatgtgcacgtgtctttgtggtagaatgttttatattcctttgggtatacacccagtaatgggattgctggattgaatgttatttctgaatttaggtctttgaggagtttccacactgtcttccacaatggctgaaataatttacactcccaccaacagtgtaaaaggattcctttttagccacaaccttgccagcatctgttattttttgacttgtttaaaatagccattctgactggtgtgagacagtatctcattaaagaaatgcaaatcaatactaaaactcttaatttgctatttatgtttttttaaggaacttcataaagtaggggcatgtatgtaaaattttccaaatatattaatttttagtaagtatgggaggcgtaggtataaaacatgcaaaaatgaaaatagagtaatggagttaggtagtaaaatagtttagcaattgattggtttggctctgcgtccccaccgaaatctcatcttggattggactcccataattcccatgtgttgtgggagataattgaatgacaggggcagtctcccccatactgttctcctggtggtggataagtctcatgagatccgatggtttgataaggggtaatccatttcacttggttctcattctctctcttgccaccaccaagtgagaagtgcctttcaccttccaccatgactgtgaggcctccccagccatgtggaactgtgagtccaataaacctctttcttttgggaatagaccagtctcggatatgtgtttatcggcagcatgaaaatgaacaaatacaccagtagataaattattttgcttaatgctgctacattttctaaagctagctaattacatctaaagataaaaacaagtcattaccatttagaaaaccccaatgctttaatataacagacttctaatcgataaagcaataatgtatgatgtatgaaagtcatacaaacatgagtgacaaggacaccaaaacttatattggttttctctcaaggatattgaaatcaaataggtgattcattttcaatacaagcataggtgcagctaagactaatttaaaacagcaaaatgtgatttttgggctaaacacatatttaatccatttttgtaagaaaagcactgattttgcttgtcatgaagaaaaagaaaggttcaaacagttctagaaaataatcctgaacaaaataaataattaagaactggtttaccatttaaaattttattaatatgggttggtttgtgaaggtttcaaaaactctagaaaataacaaaatatttctgggtgtttcacaatacttagagtaagtcaaaaatgaaccgaaagggtttgcttattcaggccaagcatcatggctcactttgttgtataatgtcgttgtctctcattgacagtcctgcgttttcggagagagcacagccctgggagaaacatcccattgcctgttggatgatagggctgcattagacatttcttagtctgccaagcaatacctcagcatcagttcaaaatgaaagggtgtctgttaaacaggagagctggggtcatgaggttccacaacaaaggctagaaggatttgtggaggccgcttcccttatcagtggagtgattggactgcagcttggatgacacgaaaaaaaaaaaaaaaaccttgctttctgattgttttcaaaaattctatggaaggattttcttctaggaacaaggtttcattttgttttgtccctctgtcctgatcatttctaagttatctggatttaaaaaattttaacattgagagaaagagaaaggtggggtttacttacattatgaacactctctcattcacgaactatatcagaaccagaagacacagagagggatgggggttttccttctttatttcagtcagtacttgggcaatttgaaggaggcacaaaagagaacaggggatcttaagcaagtttggtaagtccatctcacaacaccccacactcagagtcatactgaatacacagattcatcactcgctctctcaggtatcaacttggagggctgacgtgacctgctctatgagagggaaagtgagacacatcttcctgcatggtccctacctgggaagatattgaaagaggaaaagtcaccgggcacgatggctcacgcctgtaatctcagcactttgggaggcagagacgggcggatcacgaggtcaggagatcgagaccatcctggctaacacggtgaaaccccgtctctactaaaaaatacaaaaaaaaattagccgggcatggtggcaggcgcctgtagtcccaactactcgggaggctgaggcgggagaatggcgtgaacccgggaggcagaggttgcagtgagccgagatcgtgccactgcactccagcactccaacctggttgacagagtgagactctgcctcaaaaaaaaaaaaaaaaaaaaaaaaaaaaaaaaaaaaaaaagaaagagtcactatgacatatggctttcttcccattttctactcatttctacccacacagaaaggagatgctgagagagggtctgtattcaggtttttccaaataaggtcttcggcataggctgtatgcatttccttagatgtctactgatttgtataaagagagtgtccttaatacttcttcacctctaggatcctacttttcatcccttgagaaaagatgaagcaccatcatgttcaaacttgcttggaacgcctgtcagctgagaacatttatccccagttgaaatttttaccaaccaaactcttcaaacaacctgtcttcatttttgtctttcacttgagttaacaccaaatgaaaccattgccctacagacggggcctgataaactgactctcacagagagaggaagggcttctatggattcacaagttccttcaaatatgtgtctgggctgggcagcaagcctgcttcttcagttcctgatcttaccatcaatagtcccttaatggaatggcaatattcttataattgggtgactttatttcttgccacttctatccatggatgttcaagctagaaaatggataatgctttctactattaaaattgatcttgtatgctatcgcagagcccaggtaaatgaggctgaccaaaatcaagctgttaacaaattaacaaaagaaatcccaaaataagtacataatcttaatcccaataaatccaatggctttacttttccaaagttggtgacatactgaaatgcatctgctactgacaaaagaaatggcaaattccaaaatgtggcaacatataaacgcaaatgtcaaaaaccccattatggtgacatttcactctgaccagggagtaagaagtggatttcctggcagccaggaagttcatttcaattattttgtagccacaaagttcatcactctgatattgatacacactggaagatctgcttgtgaatccctccttatgtaatagcaattatttttttctagcaatcctgacttcataaagtaataatatctaagtattaaaattaaatttctctttctctttcatcatacatatatatgtatgtatatatacatacatatatatatatatacatacatatatatatatatacatacatatatatatatacatacatatatatatatatatatacatacatatatatatatatatatatacatacatatatatatatatacatacatatatatatatatatatatatatatacgcacacgcaaacataggcacatagagcttttatccccctagctacaaataacagtaatttgcgacgattctaccaggttgcatcttaaacatgtatatctccttctcatttttacttccaggaatcataacatgatttatatttaattataatatagttgtgaactactatatattttaaaaatatttcttcctttatattagttttagattttaaaaattagtgatgtttatattgtacatttttatctgtttagtaatatttttgaagtaagcataacagaagcttatcaatgcatatataagaagtccatctttctgaaactttatttatataaatacgactcagtgacctaaacactgtgacatacatatagatggggaaactgaagtttggccactttgaattaagcaaaagtgaaatacaaagaaaaatgtacaaagagggttccccttcatggaagaaagccactgcctgatacgaagaacctgagtgataaacgatcctgaaaactgcctctgctctgctgcaaaggtgcctgcaaaagttccacttggctattgttattaattacacatcaagctcacaatgttgcacctaagataaaaagcaagaagaagggggaattagaatttaattaaagcttgtcaagcaggcagggtcctaaatggtagctcacagagagagatgcacagctgacggctacacacgccttccacatcgaggtgctgaggctaaacaaagttccactgaagagaattgtaatatctttccgctttctaattaagttggagaattttttttctttttgccatcttagcctcaaggaagaataccagatcatataaggcactatttcaagcaatgtgtaataatgatgaagtttctttcttttttattattattattatactttaagttttagggtacatgtgcacaatgtgccggtttgttacatatgtatacatgtgccatgccggtgcggtgcacccattaactcgtcatttagcattaggtatatctcctaatgctatccctcccctctccccacaacagtccccagagtgtgatgttccccttcctgtgtccatgcgttctcattgttcagttcccatctatgagtgagaacatgcagtgtttggtttttcgttcttgcgatacattactgagaatgctgatttccaatttcatccatgtccctacaaaggacatgaagtcatcatattttatggctgcatagtattccatggtgtacatgtgccacattttcttaatccagtctatcattgttggacatttgggttggttccaagtctttgctattgtgaagtttcaaaattaaagtagaaataaggcacacccttgattttgtttcaaaaaaaggatttttctgtaaaataattaagtccatttaaaaaattttgccaaaatgcctgtttagaggatataaaaataaagtgtactcagtctaactgccttaatcgtctaaagaaaatgtcctaaatatacttacaaaaattaattaacttaggcaagagagagataacaagggctaaacatgtctttatttccatttatctgtaaaaccagacacttaagattgggagggattaaatagacaaatgaaaatcaaatgaatgatatgaaaccctgtgtcgtagactgaatgtttgcgtccctccgaaatgtatatgtgaaaatcctacccattaaggtgatgctattatgagatggggctttctggaggtgagtaggtcatgaggatggagcccttgtctctttctgtctctgccatgtgaggacacagctagaaggcaccatctataaataagaaagcagggtctccccagacatcgaatttgctggcaccttgatcttcgacttacagcttccagaactgtgagaaataagtttatgttgtttataatccaacaacttaatggtattttgttacagcagctcaaaatgaataagactccctgggagctgaaatgccctgaaagacctctacttcatataaccacaggagtagttaacatgtgtaaagtgcttatgatatccaagtgtattctgaacacttgacatatagaaacttgtttaatcctcacaataacctgtggggggcttgatctcgttgcctctgttttacagagggcagaggtgaagtagtatgctcaaatgaatattcacaaaataaactagtggtgacagtagtcaccctactctgaatcaaacattggatttctacaatgtttttaaactggtggagtcggcagcagagccccaaaaatttatctccagatttgctgctttcaattcctgtgctttaacacatccaatctatagcaaaatactcccttacatcctctaaaaaggaacaccaaagaattacataatcatggcggtggggggggtgaaaagtgtggatatgtggcatctgtcagcatccccagcaccaaatgggccctcagaagtcagctatgacccgcgtcctgcgtatccaaaaaggaaatactctatgtccatatttcctctctgcaaagagatcgccagttccttcctgattcccctgtccttatgataaaacgacagaaatcctttcctgcagaatgtgcatgccttcagcaattactaaacatttttttatttttgagactgagtcttgctctttcacccaggctgaagtgcagtggcgcgatcttggctcactgcacgtccgcctcccagcttcaagcaattcccctgtctcagcctcctgagtagctgggaatacaggtgcgtgccaccacacacagctaattttttgtatttttagtagagacggggtttcaccatgtcggccaggctggtctcaaactcctgacctcaggtgatctacctgcctcggcctcccaaaatgctgggataacaggcgtgacacactgcacccagtctactaaatacttcttacatattttctacttaaggtgccctcctttttctaagaataagcaaggagctgcagaaagttctgggaaaatgtctcaaagattcaatgcataaggaaaaacttatttgagtattttgctgttgtttgcttacacacatccatgtatatttcacatgcaatccccaccaaaacatttaccattcttcaaagtgatgctcaaagtctttttatatgttcaaaaactataaaatgggtgctgaggggaacaccatatgccccaccagaaacgagaggtggttggaatatgtaaagaattactctcaatgattgtgtggcagacaggctatgaaggtgccaccctccccatccctgccttctggagtcataccttctctttagtgtggcatggcctgtgacttgcttctggtcaacaaggagctaaggtgacggcatgcgtgtgagcacctatgtttgatctggcaggtgagattgcagcaccctccctgctcacaccctggctggcagggaagaagcagctgccgcggtgtgagatgtttgccatgaaaagcagatccttctttagtaaagcctgagaggagaacatagtcaggctgccacctgacttgcagccttgtgaggtcgtaagcagggtgcccagccatgccttgcccagactacgacccacagacaccgtgagatcattcattcatgctgctttaagccactatgtctgtgatcgtcattaagtagcaacaggaagtgaatgccaattgcctttgccacaaaattgttgtctgtctttccaggtcaatttacgatactcaggtaccaattttttttttttttttttttcagaccgagtcttgctctgtcaccaggctagagtgcagtggcaggatcttggctaactgcaacctctgcctcctgagttcaagtgattctcctgcttcagcctctcaggtagctgggattacaggtgcccgccactgcagccagctaattttgtgtattcttagtagagacagggtttcaccatcttggccaggttgatcttgaactgctgacctcgtgatccactctcttcggcctcccaaagtgctgggattacaggcatgagccaccatatccagcccagatatcttgtaagtgcaaccattgcttaatgtcccctaacttagtttctaaggaataaaatgtgtatttcacatctgtcctatctactattggttttaacttttagttttttaatgacaactgattaattactttaacaatttaaattacatatttattcatcacattttttaaacaccagccacgttccatgaactgtcatagatgctaaggatatgagatgcagaattcttctcatcaaggagatcacaaacaagagaaagaaacaaagactgaaatcaggagagggaaaaatgcccatttgacccatgctcagaatggtcttaatatacagaagagacaaataagagactcttaacttcaggtgcatgggagacaacagaggccagaagccaggataacccagggtcagattgtgcactagctccactaggtcgggcatattaattcagttctaggtgtttctgttttctcacaaataaagtcggaaacacattatcctcttgcttatagtgttacaggacgtgatttaatacacacaaagcacagcagtggtttctaggactataacttatcacaggagtggataagggagagttttagaagaaacaagagaactgttatgtgaaccacagggaggagttcacaggctcacagtgtattgaggctagggacatgtaggcagctcctatggtacctggctgtggtgaggcggtcgcctgccaggacctaataagacatgagctattaatgggtactaggcttaatatgcgggcaatgaaataatctctacaacaaacccccaagacacaggtttacctatgtaacaatctgtacatgtactgctgaacttaaaatacaagttaaaataaatagatacaacttcaatactaaaaagaagaaagaaatgaatttagagagaccatcacggaagatcccaagaggagatgcctgacgtgccaaggagtgcagccttatctggaaggggacaagtctgggcgcacgtgtccaggattttctagcaacatccattatagcgatcagccctgggtttgcaatacagttaaccttacgccctagctgtgataaggtcagcaaaactgcctgtgaaaggatatgttaaacagctatggacttttgttggtgtatcattttggtaacttcacctccttcctcccacatttcatagtctgtctcctggaaaatgattttgcaatgtttaaaaaaagtgggcaaaaggtctgaacagacacctcatgaaaaaagatacaaggagagtaaataagcatatgaaaagatgctcaacctcatgtccttagaacatgagacaccactacacaccaatgaagaatcgctaaaatccagaatggcaacacaaccaaatgctgttgaggttgtggggcaacaggaaggctcactcactgctggtgggaacgcagaatggtagagtcacgttggcagacaagtggcagtttcttacaaagctaaacacagtcttactgtacgatccagcaactgtcctctttggtctttatgtaaatgagttgaaaagttatgttcacacaaaatctttacaaaatatttatagcagctttattcataattgccaaaaattggaagtaaccaagacattcattaatagatgaatggataaactatggtacatccacatagtggaatattattcagcaaaaaaaaaagaaaaaaaaagaaacgacctgtcaagacacaaaaagacatgaagaaaatatggtttccttattattctttttagatacagggtcttacgctattgtccacgctagagcacaggagtgcgatcatagttcactacagcctctgacttcaagggatctgcccacctcagcctcctgagcagctggtactacaggcatatgtgagcatgctcagctaacgatttaatgttttgtctacacgggatcttcttatgttgcccaggatggtctcaaactcctcgcctcaggtgatccaaggagaaaatttaaacacatattactaagtgaaagaaggcagtctgtaggatgccaaatatctgacattctggaaaaggcaaaactacggaaggtgaactcaaattatattttacatcacaagtaaacatgagcttagattcctcagtatatataaagttgatttcttttaaaccacatctgatcattataatatttctcacatgatttgctctagtttttagaagtgaaaacaatataatcgttttcagtaaagggattaaatattttggtttaattatgtccatgaagcactagtgccgcctttggatttatatttgatcaaaatatgtagacaactgaaggtaaaaggatttttgagaatgagtcgtcacatgtagacccatggaaactgaccatgggcacaggtaacacccaagcaactctatgggacacaaatctctttccatacagttcttgatccttattcagagcacacagtaatttactccagatgctgcttctcatgcatactttgttatacagaacatgcttgaaaaatacatttttcatttaacatgggcctgtgctatcaattagatggaagaaactgtcacaggcagtgaaaactcttattaaaaattgatttgagtctagttaagtctcaacacccaattccgatctgaagatcaaggttgtgtcagaataaaggccaaaagaaaaaagatcaatattaaatatttcagttctgaggttaatacatttgcttataaaagtatactgaaccatctgtattctggaagacctgctctggtaccgtaagaagactagatttttttttaaaggcagcaatagtattcttcaccttaagacagtaagcgttatatacctacattggaagcacaaaaatatattaggtaaaataatttaagattgtcttaacaaataattgtcattcttcctaaaagttaattttaaaatcctaagagagagagagtttgtgcgtgtgtgtgtatgttcactcttaactaggcacctaaatgatggttgttagtttggtaaaggattactactgatacaaacacattctaaagctactgatggtcgggactggtggttcacgcctgtaatgccaacactttgggaggctgaggcaagaggattgcttgagtccaggagttcaagaacaccctgggtaacatattgggatcccatctctacgaaaacatttttaaaacattagccaggcaatggggcatgcacctgtagtcccggctactagctgaggtggggagattgcttgaggccaggaatttgatgctggagtgagctatgagcgtgccaatgtactccagatcgagtgagagagtgcaactctacctcaaaagaatatcttaaaatatcaaaaacaaaaacctaataattcaacatttaaaaataatttaaatagaatcaactctatccctaagaatagtatttactaagctgaggaggagccactagaggacatcattcacagcaggacacagtttttatttagttccagccatgactgacctcatataaagaagcaaagaccaagaaattaaaatgatagacactaacaactgacttgaatttttaaaaattggttaaaaaggtcaacttggttctactgattaacttcaaatgccttaagcatgtacacatagatataggagaagacctcagaggccctgggggaaggaacatgaatggtattcttgggtcccatcctatctagtggacaacacaaggcttccaaagggaggtgtagaaaaatgaagagagttagagtagagaaaactggggtaagatattgttgtttcaaaaaccaatattcctgtcagccacataaatgttaagaaaccagctctatcttccttaccaaaaacagatttccatgtaaactgaacaaacgtaaaggaagaatgtcatttactttcttcttataactttcatagacaaaacatgtaggttagtagttattttcatggccatggtaaattgcaattgctcagtgacatttgagacttactaaagtgaaatatgaatagattttctattttaatattcacaagtcagtttccctacaattagtttatcgcatatattgcttgaaaacattattatactttcatgtgaagacaattctatccaagttttacgtttattttacaacaataaattgcttctatctaataaacattattggagatttatctgggctatggattaaaaataatgcaagtcaataaaacttcacaaattacactaactatgggttttaaaagaaagttcgcttcatccacatttttgttacttggcatcttcatcaccattcctgccattaaaaaaaaagaagcctttgaattccagtcagttgggttaagtatgcaaaaatggctgcatagattgtcttgttgattacctattctctatcatgattatatctttctataattttgtggaaaatagactaggaaagagaataaacttagaaaatagagtcagggtaggtagcaattctacctgaaacatggaaacaaaagcttaaaattctcattgttaggacaaattgaaagaagaaaaaatacgcagtgatatacataattaaaaggcagcagaaaaaaacagtggagaaaataaagaaaagaagtactaaagagggagaaaataaataaaagcaacaagagatcacttagaacgtggcagaaaagcactagggacagggagacaaggaaagaaaccagattcactattcaccctgcttctaaaacacatggacaacaggcagcattattataaacaagtgaggtaggaaccgggacttccattatacttagcattacccagaatttcatgagaaatcctgggatttttataaaaggattaataatgggaaactacctgaaaactataaattgctgtcataaaaatgtgactaatacaaaatgatttctcagctgggcacggtggctcacgcctgtaatcccagcactttgggaggctgaggcgggcggatcacgaagtcaagggttcgagactagcatggccaacgtggtgaaaccccatctctactaaaaatacagaaaattagctaggcctggtgacgtgtgcctgtaatcccacctactcgggaggctgaagtaggagaattgcttgaactcaggaggcagaagttgcagtgagccagtatctcgccactgcactctagcctgggtgacagagcaagactccatctcagaaaaaaagaaaaaaaagaattgctttttagggcacaaatattaaaatgtatgctgcagaccttgtggaagaatagatgagataaaaatgtaagtaaaatactatcaaattatctggcccaagaaaggttagcttccctccttataggagagttatattgttgatttggtgagatctccactaaatattttaacattcaaatatactttcttaatagcccattctagctaacatttgtcatagcctctttatcaacaaatattagaattattaatgtaagtggatttcatttaatttttctgtgttttttgctccatcttaccctcctaaccccaggttaggataaattctatatggcaaatgacaagaaccaaaggtctaagtactccaaagtgcaaatagtctggccttcagcaactgcgactcgtgtaattcctacagagatacttaatgtggtcttaattggcactgttttctttttcttttgttccacttaaatgatgccaatcaaattttggcatacatgagctaagttaaagaaaagtagcaatgcctagttttgtcgactcgcaattcctttgaaaccatactatgaagagaaaatttaaattccatgtttatcctgctcattttcacttttgcaaagagaaaaaaacaacctgagttttgctatctgtgcaccacagcagtccgtggctgggataaggtggattgaagtgtgaacaatggttcaggatcaaaggactccttaggttctgctcagactgcctccagtgatcagcagcgcaggagtccatcctgacagggggctggagagagctgatgagattcatgtgccatctcagaaagaaaacataaaagcctggacattctatggaaggcaagccaagagaacgtggaatctccgtttgcggaacttgtaagtcgggtaatataccagggagtatgttaacacggctgaatgacctctgttttgaacttcgcctcgcctcctgccttctctctgctccttgtggctctcttgttattgttattcctggtttgttcctcctctccctgtctcatagctccttttggtctccccctccctttatcctgccactctgacaaagcaggcacagcacttgcattcaatcatcagctgaaaatgagtaaaaagctacttgcctggaacaaagctgggagtaattttgaaagcatttccttagagctgagacatcctgagacatggacttttgatgggtaatcaaggtttagaaaaatgagttcacagaaggtttacaatatcaggacagatctttcccaggctttccagaccatttaatgcttgttttgtgaatcaaagagcgcaggcacagaggctggaggaagcaaactaatagcttacaaagctacaaaacgaaagggagacaataaggcttgaaaagaaacacttacaaaaataaaataaaatacccatttcctctctgtctctttctcctgcttctgtgagtactgctagacagacgccatcgacatttcagcagcagtgacatcccagacagcttgtctatagcccttgactcagttttttggtatttcttttagtagaatattccagagcatgtggtcttttacctttccttggcctccagactgtgctactcctggatgatcacttcctctaaactcatcttcatcatgatgttgaatatcattacttctttgcaacccaaagcaaggaattttgaaacgattatctctcacttgacaaagtaaatctatttatatagccactggcctggcactacaaaaaaatcaagttcttaataaatgctgtcaatgattgtattttggggggaaatattaaccgcttttcaatttatgcataacctttccaggcccaattgtgtttcacagttataacctgtcatctctctttagtctcctttcccaaatccagcttgttctgtatatagtagctccactgaggagcagggaggaaagacggatgagtggagtacacatggtggatgctgccatttaggcaaaggcaggcatttaagtaaagacaggtaagaatgggaactcgtgccccagtgaggaaattaccatactccaattaaagggaaggcagagcataaatagtgtgcaagctaaaaatacacaactcctttcagcacaaagctccccgaaacaattctgcaagaaatatgtgtaaggtctgaagcttagcagaaagattggtagcaagcacagctgtccagaatcaacggtagaaaaataatttctttttctttggtgcagtcgtagaaatgctcaggcatcctgttggcgtttgaatgcatggtgccttcaagaagctcacggacacagacctgcaactgcccgtggggtttcctaaagacacaacaggagcgacgtctgcgtgtaaaatgacaagtacagtaaacgtcccgcagccccaggcttcattgtcatctgctggaagtgtcctccatgtgtgtgagataccctgcttatacatctattttagtcctcaaacatggaaataatccactttgtcctttgtgggacttaaagtaacctaatcggggagggacacgcagttatctttctactgttaatgctaacccaatgcttagcagacggggttgaacgatgattgttggctgactcaactcttgcttagcttccatcaaagtacaaactacttgtttccaaggttatttgtgagtgaggttgatttctattttatttaactatttagacacacacacgttaacttatttcttatgtatttatataatcttatatagcatgtgcatatttttgtatatatttctaaatcagttcataatattaatgcatgcttcagaggcatttacttaatttttaattttttaaaatgaattttagttcaaacttttaattttaaaattgatttaaatcactaaattaaattgaattttagggagggataggagaaaatgtccagactcgtactgaaacttgcagaaagatgattcaattataaaatagttcattcaaaatagtgttgtcaaggtaaaataaagttacttctttctaattttatctgcaaagagggagctcatgtttatcgagtacctactttgtggttccagacagttagctaagccctctgaatgcatcaactgtaatctctaaaagtagtcaaccttcattttatagaagaggatgttggccaagctaacagagttattaccgagattccccctggagacttggcagctaagggtaattgtctttggtttctatgcttactacaccccagaagtcaaaataatagcaatgaagatgaaaatgatttagatcacagggctcaacattacatacacatggccagtggttctatacaaactgtaaagctaaattccttagaattaaaaaaaagtaattgaaacattttctaattaattacccaggcatagaaatatctagtacagatctcttaagaatacagcactgatgaaagtgctaaaggacacagaaatgaaatgttaaaatgcagtcatttctgtttagggatttaaaccaagataaagaaacaaaaccaacaggaagatgccatcaaaggaaagcaagacagaaaattgaggagcctcagaaagacttcacaaacaaggtgagtcttaaataaatcttgggattctggataagcacaggaaagaagaaagcagcccaggtaaaagacgtcatgaaaaacgcttgggattaagaaccagggagatgcccatatggggaagtgtgagctcttcctggtacaatacaagcaggcaagtctgcagagaggggtcaggttcttattactttattgaggcatgcacacatctgacagacgaaactgctcttccacaaagagtgattctgaaggtcctgcttggtaaattgcaagaaccagcaagactttcaaggagttactttatcaactagtttaaacaaggtggataagcgataacatataagagggcaataataaaacaaagatattaattctgtaaaaggtcaacagtggaatacattattacttcattatatttatcgcccctgcgagtaggtatgttataaatatcagattttagtgaataactttaataaatgcatttgaagttaaagtgaagttgatatgggcattgacaagaatattagaaaaataagaaagttagtaaaggtgaagagagggaaggaagggaagtaaatttgcatacaagagctatactgagatctttaaagtaaatgtatttgttaagcaggtaaatggaaaatatcaagggaaagtaatggttagtattgtattcattgccacagatgtgatggctgagatgtgagaataaattatctagggtagtatgcatggaaagaaaaaaagcagatatctatgaactaaatcccagaggacatccacaagagagaaagaagcgggagaagttgtaggaggtgaaaagtataaagaggctgggagaatacaatgtgtctgaagagaagttatactaggtgaaaaggtataaagaggctgggagaatacaatgtctctgaagaggagaagttatacgaggtgaaaagtataaagaggctgggagaatacaatgtctctgaagaggatggaactccagggagaggttggcttagtgaatataaacatcatgtaagagagatcatagaaatggatcgtcagcgagtgtcaattatgccaatttttgtgcataggttaccagggatattctgtaaccaccacacagtagaatcactaaacatataataataaattgagacaaatgtgttcatatatcacagcccgaaaaaataatgaactattactgtagacaaaaacttgcgtagatcgtgtaaacaaactattgaacaaaacaccagaaacaagagaatacggagtatgactccttttgtgtaaattgaagcatttaagatgaaggaatctacagagtttatcttgggtgccacagactgttactaaaaagaagaacaggatagctgttctaatggcattcggggaactggttgtttttgagcgggagagagggacgaaagtgagaggtgttagtaaatgttctagctctggacactgtgggagtggtggaggttttcctcttgcgataaagaattgagctgtaaattttacttttggccagtttctgaatgtgtgttatgtttggcaattttaaacaggtttctaaaaaggaggcatgttgacttacggaaaacatgggtagaggtccattgcctggaggatttctatttatctgtctctggcgtaaccttattccacgttctctgcactaaacaaaggtgtttgtataaccagtgatcttttacaacttgagaacgagtacccttgtttttgaccctttgatttgtatgcaccaagaggttgatgatgtccaaatggaagttattattatttgtttgggagtaactaccttgggttatgacatctgagacagtgggccaaaaaagatataataacaacaacaaaataaaaagggacaaccatgaagaaaaggagtatcatgacacataatgatatctcacatatatgtgtatatgtttatgtgtatgcatatatatgtatgtgtatatatacacatatatattaatatcctctataacattgctgggccagagatagaatttactgctagatagtttattcatattgtgatccccgaacaggatgcttaaaaacatgaatgattgttttgtcttaatgtaagattaacggtcatcatctcatttaaggtattctttttatttttattaggcatcatttaaacaactattttaggcaatagaacgtagagcaaagggaagactttgaagaagtcgaggtggatatttcaagaatacttttctcatgtcaacataaactctcttaaatgtttcacgtgttctcctcatctgcagtttcactttctgtggtttcagttacctaaggtcaactgtggtccactgaggtctgaaaacattaaatgaaaaatttcagaaataaataatgtataagttttaaattgctagctgttctgactagcgccatcccactccatcccagccaggacatgaatcattcctttgtccagtggattcacactatctacattagtcacttagtagccatatggcttttcagactcatggttgcagtagtgcagcatttgtgttcaagttgtcgttatttgactttataacatgcaagcgtagtgggccttatttataaatgaacctttatcagaggtatgtctgtataggaaaaaacatgctacatgcaggctttggtgctgtcaaaggtatgaggaatctactgggggttttggaacatacccccctagaataagggagagaactgtatttagaggtgtaactgaaatgcattttaataatgggcatgcaagactcaggctctaacctttgcagtctgaagttaagaataacaattatgtccacaaacaagttaaaaaattatttctacatatgttacctacaaacctacaagcctaccaatctctaaatttctaattatgggttatatatgataaaaataacttcatgattactcctaaaacagtaatcattcttatgaacagaaacattttttttttactattgcagtagaatgagcagaacgtagaactagaaagttctgggtgcacattcttgcactcgcatatcattttagattctccgaggctcagtctttacagtaatacgaggacaaatgcatagatacaatggcaattctataaagtccctactgcagtctctggcatataataattgctcaaaacaaaaaagacagagagaacaaattctttcccaccctttgtcagtgattatagctgacgaaatagtaatatttctccaacaacagtcattaccaaattctgagggccatgaccacgtcattccatgcaaacacacattaaaccccataagtgctctacattatgttatttcagacaaaaaacttgtttaaccattgccactcctcattttaaaaaaggactctatatatcctgaaatctcgcatttacttttattaatttttaactatagcatttcttgttgagttttcttttctctttgactttagtttcagcctcatcagtatattaacagcagatctttgcttttatttgtgtatgatggttgtagacagtacattccacaagagcatgaccaatctgttggactcaccagtaaatccccagtgtgtatgacggtgtgctgcccatagtaggtactcagtttttcttttgaaagaaaaagtttgattgaaaaacagatcaaccaattccttctggtgtcttttaaattatatgtctgtttggtctctctgtctctaaatggtataagagattaaacagcctgaaaatcaatattttctggcacaggaaataaaaaaagctatcataattgaaacgtttatgaaaataccttttacttaaagaactatagttctgtaaaggtgcataaatgaacaagaactgtgaatttgaatcttagagaactatgtgtaatggatatgctttttttacgtgaagtgtgcttttaatatatagtctctcttatcatccgtctaagccaggtaattcctcttgtactgtaaaagtctacagcgtcatagtgtctatgatcattgcactttgccatggcagcctgcttgacatttatgataagaaggtgttgaagtatttgctgtcattcattcaataactattgagtgactaccatttaacattttttatgcctaccatcatactcaacttttgctcaactgttttgaatgtatcagctaataaaataagtcgagaaaatacatttatattcgcaatatgtttccaaataaatttagaaaaagatacttacctatacatattattatattcttagaaaatccaagcactcacacctgagacaccgttaaatccaataaatgattttgtcaaatggattggtatatgataaacatataaaaataaaaataactgcattgacccagccagcttgagtaatgatcatcactgcaaccgaggcccaacacatgattttttgctaacttggcctgatgcattaacctggactcgtctaatgaacaagtgggagctggaaattaggggacagaaatggggagattcgggaagctggtctgtcctatgtctcgggaactatcaggcactgtgacaatgtgaattattgtcatcacctatgtgcggcttttaaaaggcatttttctcagagaatattcttgatggaatcactggtaaacaagagattttcctctcctacctgattctgcttcaaaattaaaccgaggtctgtaatggaatcatcacataatccagcaacactacttgcatattcaaaaaaaaaaaaaaagaaaaaaaaaggaaatcaggatgtcaaagaggttatctgtgttctcatgttcattgctgtgtaattcaaaacagtggaggtacagaaaaaatcctactatgtccactgattgatggataaagaaaatgtggtgtatatatagcccatggaggattactcttcactcttcaaaagggagatcctgccatagcaacaatatggatgaacctcaaggtcattatactgtgtgaaccaagtcagttacagaaagtcaaataccgtaggattccatttccatggggaatctacaatgcacagaagcagagaaaagaatggaggttgccaggtgtagggaagaaaggaaaatggagaattgctatttaaggggtacatggtttgggttatatctgatgagtatgttctggagatccgatgaacaacattgtgcctacagctgacaatagtgggttgtacacttacaagtttgttaagaaagtagatctcatgtgaagtgttctttatttaagttctggaatacatgtgcagaacatgcaggttcgttacataaatatacatgtgccatgatggtttgctgcacctatcaacccatcatctaggttttaagcctcgcatgcattaggcatttgtcctaacgctctccctccccttggcccccacctcccgacaaaccccagtgtgtgatgttcccctccctgtatccatgtgttctcattgttcaactcccacttatgagtcagaacatgtgatgtttggttttctgttcctgtgttagtttgctgagaatgatggtttccagcttcatccatgtccctgcaaaggacatgaactcattattttttatggctgcatagtattccatgatatatatgtgccatattttctctatccagtctgtcattgatgggcatttgggttggttccaagtctttgttattgtaaacagtgctgcagtaaacatacgtgtgcatgtgtctttacaggagaatgatttataatcctttgggtatatacccagtaatgggattgctgtgtcaaatggtatttctgttctagatccttgaggaactgccacactgtcttccacaatggttgaactaatttacactcctaccaacaccaatataagcacaaatccaaaaacagaaaaacaaaaccaaaccccacaatgataaaaacctggtggctttagcttgcattgtttcctctagatttaaataatccagttagaggtcttgatttgtagagaaagtttttccttactttatgaaaaaataataatgataaatgtgttctttagaacagaggaaaatcaccaacgaggtaaaagagaaacagaaaactgaaaataagtaaacaattttactcagagatcactgaacctaattctgtaaataaatttctaagatgataaataaagatattaaatcaataaaactttgaaacaaaatatctcgatttaaacagtaataattggtattttatttcagaactaatatgctattataaactgcttaatcatttaatttaatttttctgattcctcagaatcttgatattcatatactatcaaaataatgctattggaatggatttcttacttaataacttagccttgtgcttttcagagagaagtttctttctttctaacatgaccaaaacttgcagtccagtgtccatgttgctccagttttgctgagggagttctaagagctttcatttcttcatctgccaatgaagcctttggacagaaccctaagctacaactcagtggcttgtaagttttgttcttaccaacatatgagttccacactcatgttcaatatttttttttttttagatagagtctcactctgtcacccacaatagagtacagtggcgcgatctcatctccctaacctctgcctcctgggttcaagcaattctcatgcctcagcctcctgagtagctgggattacaggtgcatgtcaccacgcctgggtaatttttgtattttagtggagatggggtgtcaatatgttgcccaggctggtctcaaactctgccccaaacatatttttgaacatctaacatgtaaagcaatcaaaagccattcgaataaccaaaattaattaccacaatagtctttctaggagttgccaacagcccagttactgctgtattagattggtgcaaaagtaattgcggtttttgctattgaaaataatggaaaaaatgacaattacttttacaccaacctaatagaaattacagctattggagcacctcactaatgtgttccaggaacagacggattcatggaagcttcggtgatgaaaaaggaagagtaccagctacccactgaaacccacggtgggttagaccgtagcacccagactccttttccatgagcccaagtctagtgcaaaggggagagagagaaagtgatgaacgccgcacttcaggcctagcccagcaaacttcccactcccctcccctatgctaagggatctgcagcccctcttcattcagaaacaatggcggatggcaggaggcggggttggggatgggaggacccagtggaagggacctgggtctctaaatattacacggagaggaagtcactaccattctaaacactacccaagactttcacatgagcaacaaacaaccttgttttacataagaccctataatttcagtgtgtttttcacagagcttaacctcctctgaataaggagtcagcttctctttccttcagagtgtattgtttcatcagcttatatatggttaaataagcataaatgctttaattttcctgaaagagccacctctaatttacagaataactacacatcttttaaattaggatagaaatccatgtcttatatttgtacgattgataagtttataacataaataattagggagcatttaatttctgtatcttaggtacatttttctgtctttaaaatataaggagaaaggtgatcgaatacatttttttcataaacaaaattgaatcggtgaaggaattcctaagaatgcttttccaggacattttcaaaattccttgccttttcaaaaggaaataaacacatatttagtaatgcttattgattaccttgattcctgtttattatcctacactttgatacatttcataagattaaacttttacattcttccatatttctgaaagtttactgaaaaaaagtattgccatctgtttgttaataagacacaataaaaaacctagatagtagatacccatgcaaaagttagctcagtatattacttattttctctaaaaactattttcattaaattctagctcagcacttaccttgtaaaagaataattgttcaattaacgccaccctaatctgtttacaagactctcccattagatagttggtgctatatataacatagactccaaatatttgttctgctcacattatccagtgttttatgggtgccaggctgtccttatctctggctattgattacaaataagtaaaatacaagagtctaaccctctagaggcttatgatttttaggggagaaaatgacatagaagtattcaattcttatgcatggacatgcatgttatcatagtggcttatataatgggccattggtggaaacatctatttccaattgtgacaaaaaagaaagtttgattaagtgggagatatctgagcaaggcaatggaagatacataaatactcaccaggctgaagagaaaatgacattttcaagctaagaggtagatcagtttatctaaagacatcttgatgattgtctataagagttgtaatgaaacagaagctttatatgagaatgtctgcttgtatgaccaaaaggtttctttggagctgaaggaaaaattatacactggtcaatttcagtttaacatctttgaaatgaaagtgaaagatatttggaattatgtgaataggcagtgaaaatagtatcagcaggaggggaccctcatagtagagacaagtgtgagaatcctacgaacacagacaaaactgaacgtttctcagtcacaagagagaaattaaaattgtccctattaaatgagcatctggagattgtgagctatgtagaaaaaaaataccaaaaaaaaaaaaaaccccaaaaaacaaaaacagtgaaattgcagatgtaggaggcaggggaagaggtaatatttttttttttttcaattctgaggaggtgtcattttaagcatctccctgataccgcccatactcagttcatttaacaaacatttatttttcatcagctgtgtgtctcactttgctagatgcattggagtgatataaagataaagatgatatgtttttccttcgagaaaactacaggattgtataagatgggacttccagttagttcaaatatcagtgttaattttgatattgaattttatacataatctttgccatgcttcaaagtcaacccacttagataccaatgaaacaagtaagaattttattccagaatttaatttagtagtattttctttctttttaataaaatcatccaaacgttataaatttgcaagatgaagtttactgcatattaaagagatcaaagagaatcagaatatgccatattttcttttataaataaatgagtcaggagattggaagatgtttcctccttaccaacccccaccctctgaaaaaataatgcttgataacaaggcagctggtagtgggtctggaaccatttttagctgcttcaaaggggaatcagatgtactgaaatgtaaagatgtaaaacactcataaattatttcagtggaatgtcaaaacagccagtcataatatgtctactatttaaaaatattaaattttagtggtttttttttggaatgtaagctttctggaagcttttagtagcatttcttcctagaggaaaatgcctaaataggatggtgcacaggggcataaatcccacaggacaggtccaatgtgagggcagcctgagctttcctgcggctgtgacatggatgtgaagtctgtgttaccagggtgagaaaagacaacatgagaagcaggaattccagaagtgtgagtgcaaagatgatagaagaggagagtgaagaataaggcagagggaaaaaagaaaatacttggaatgataaatgaagtaaaataaacaatagaccttttagggagaattgaagtattaattctttctttttaacaaaatcatccaaacattataaatttgcaagatgaagtttactgcatattaaagagatcaaagagaatcagaatatgccatattttcttttataagtaaatgagtcaggagattggaagatgtttcctccctaccaacccccaccctctggaaaaataaagcttgataacaaggcagctggtatttggtctggaaccatttttagctgcttcaaaggggaatcagatgtattgaaatgtaaagaattaattaaagaattaaatactgtgttccagcaagagcagtaaacctaagccatgggattcttactagacgctgtctacgtctgctacctcctgtaatagagaggaaatcacatggaaatggaaaggatgctggtcaggaaagccagtcctgcagagcgaaagcagacacaccccagccaagtcaccctgcagaccattatcatcaagttctttgtgaggaggaacagtgctaagtccataataataatcacagtcatgctgataatagacacttttgacacttattaagcctcattctaagttctttacatgtgatgatttacttagttgtcacacacactaaatatcatattatcattaccacccccatgacagatatggaaactgaagcattgggatgttaaattgccccaagattcacagctggtgcttagtaggacaagaagccagctcctgtcgccctgacagggtgtttatgtggtttacctgatagaggtatatgaaagccttaaatcactattttatgattttgctgtgtctccacccaaatctcatggtgaaatgtaactcccataattcccacatgttgtgggagggacccggtgggaggtaactcaatcttgggggtaggtctttctcatcctattaacttgatagtgaataagtctaaagagatctgatggttgtataaaggggagttctccttcacacgctccctttgcctgctgccatggaagacgtgactttgctcctcattcaccttccgccatgatagtgaggtctctccagccatgtggaactgtgagtcaattaaacctctttcctttataaatgaccaagtcttgggtatgtctttatcagcagcatgagaacagactgttacacactacaactaaatatttcccaggttagccatacaggtattcttatattttttgtagacaattaaaaagcataatgcctaaaaaaaaaaaaaaaaaaaaaaaaaaaaaaaagcaaatactttgttccaaacatacgctttattaactaagggacaagggaagagacttcctcttctacctcagataataattagcttcatgaacttaggtgagtctcttccctactcaaagcaatcttcccttccctcttcccttccctcttcccttccctcctcgcttccttccttcttgccttccttccctcctcccttccttccctctccccttccttccctcctctcttccttccgtcttcctttccttccctcctctcttccttcccctttcccttccttcccctttcccttcccttccttgcctcctctcttccttccctcttccctccttccctcctctcttccttcccctttctcttccttcccctttcccttcccttccttcactccctcccttcctctcttcctccctccctcctccctcctcccttcccttcccttccttccttccctccctcccttccttcctctcttcctccctctccctgtccctctccttctccgttcccgttcctttccttccattttattagttaagagaatatacttgacaatctctaaggaatgattcaaagtgcctttaacctatgtggctgccttttatttttctcccctctcttgagctttctttctcagccatccttcagcctggtcagcactctcctgttcaattccagatgtgaacagaataccaacataaaattgaacaagttcccaagagtttgttaattttgtttcccacatagcaagcctgcaatagtcatcagtccatgtacagatccatttttaacctgtcccaaaagaaagtgtgaattctcagacttggcggccgatttccagaaatagtcccagggctgggagcactcagcctcacctcatcaactgccctcatagacagcacaggaaagtgaccagaggaggggcatgcaggcttctccttcgcaggagaatacaaatcaggattctttgcaaacttgctggtttctattttctggtttatacagattattgttttaaaaagcagaatacagtttcttctggtttcctgttcagcatgtaagaagctggaagtcaccactctgtcctaagagaaagctccacaaactgaaagatcaattcttcttagatcattcagagaggtgggggtcataggacaatttgctgctcccaagattggagacacatacagggaactacagaaagtgatggtaccagggcagaaacccacaagcacaaagctccagagtgggagtagggaaggcagagccgtaactgatgaactgctgctggctcagtgttccccaagagaactcagtcattagggggcccattcatgacattagttttactccaagaggactcaatcatcaggggtctacacattatgagttttacttcctggagcttcactaggttctcacaaggaatattggagaagagcctcctcctgcttccagcttggggaggggaaaaggaaccatttttgcagagcatttcattcttcctaacaagataggcccacattaccctaacatcaacaccagacagaggcattccaaaaaaagaaaactgcagaccatcgtttctcatggacatggttgcaaaaatcctcaacaaaatattagcaaaataaattcaacaacgtataaaaagaattatataccatgtttcactgggattcatctcaggtatgcaaggctggttcaatactgaaaaattaattaacatatcacatcaacaggttaaagaaaaaatcacatgatcacatcaacacatgcagagaaaagcaattaacaaaatccaatacatatttatgattcaaaaaatatcctcagtaaaccagaacaagagggaaaccttctcaatctggtaaagaatatctaccaaaaaaccctgcagctaacattttacttaatgaaaactcaaagctttctcactaagagcaggaaacaaggcacaaatgtcccctttcaccactgatttccaacatcgtagctaatgcaataaagcaagtagagaaaataaatggaatacagatagagaaggaagaaataaaagttgtttattccctgcaggtgacacaactgtctatgtataacatcctaaataattgagaaaaaaaatcaccttcctagaactaataagcaattatagcagggttgtaggatacaaagttaacactaatgcacaaaataaattgcttttttatataccggcaatgaaatggaattcaaaattaaatataataataccatttacattagcataccccaaaatgaaatacttagatataaatctagcaaaatacatacaaaatgtatatgaagaactctataaaactctgaattaaaaaaataactaaacaaagagatagcccatgttcatggatttaaaaaaaaaaaaacctcagtactgtcaagttgtcagctctttcgaactttaaatacctattaccaagtgaaagaagttaatttgaaaaagctacagagtatatgattccaactgtgtaatattttcgaaacagcaaaattagggaaacagtgaacaggtcagtgattgccaggagttgagggagagaaggattaataagcagagcacagataattaaacaatgaaaattatctgtatgatactataaggatggatacatgttattgaacttttgtccaaacccataaaattgacaacagcaagagtgcgctccaatgtaaactatgggctttggttaatcgaaatatgtcaaagtaggttcattgattgtaataaatgtaccattcttatggggggatgttgataataaaggagatcctgtatgtgtggggacagggggtatataaattttttttaaccttccccttaatttggctgtgcacctaaaactactctacaaaactaaatctagtaaaacataaagcagcaaacatcgaagctactatagcgatgctaatttaaagagaaatcctcaagtagcacctgtaaaattttaattctactaatgatcatgttcaaagcatgttaaaagtagatcccaattctttcatacccacaacaaagatgaaatgtcggactgtaacatttactctttaagttagagaagaactctcgtttcatgaaatcttctagagaatcatatcaagtgacacactgattaagcacatttgtgttaaatggagcatgtaaaagataaattttgaagatgaaacaatgaagttaaaggaagagttctttgcacttgtactcataattgagaaaggtaatttcattttctgggggactttaaagtccacagatacacacacataaacttgctactttggcaaaaatacataaatttcgatgaaaataattattccttatgtacagctggggaatattacttaagctacgctttctctgtgatgtactgctctgacaaccataaaattattttcctctctaggtctgatttttgtgatcagtggttcctaggtattgctaatttgaagtgtgatgtcaaatttctcaaacctgagtgatccaaagaatcacttgggactctttttaaccctagattgtagctaaagagcctcctcatttgtgttagtcagctcagactgccataatgaaataccacaaactaggtagcttaaacaacaaaatttttattttattattattattattttttacagttctagaggctgaagttctagatcaagattcacacagagtgagctcctggtgagagctctcttcctggcttgcaaaatgccaccttcttaccgtgtcctcataaggcagagtaggggatggggaggtttcctctggtgtctgtgcttctttttatacggatataaatccccttggatcaggccccactcttattatctcatttaaccttaattacttctttagagaccctctctccatatacggctatactgcagatcagaagtaaaatacctgaattttagggggacacaggcagtccacaataccattctagaaggcagatctgaatgccacaggaaaagcctgatatgcatttttaagtagcatcctgatgattctccaggtgacgcacacatgggaatcaacgaagagggaacatcgtgagttaaagaactcaaaacaactgacgctaattccaactcaaaacttagctactgagaccgcttgacctaatctacattcctgtatcttggtttttaaagtttttataaaagcaacatcagccctgttaaataaaaaagtagacctcaactacataaatagagtacctggtacctaatatagatacaaattaaacctgctattagtaacttcctccaaatatgattgtgaacagtggagaataaagaagatacacactctggtgattacatgactcataccttagtgctggctgctgttactgttttccaacttgtacaggtagagaaagtctacctcctccccaaaataaacaaccacaccaaaaacaaagatggctcgagaacagagtaagcaatatgaatccagactcattcattacatatctcacccaagatttttggccttttaagcctcagtggaaatgatttacattttatttccatggcagctttccattctcaaaagaagaagcactttcagaactacactccacacccagaaggcaaatgatactttataatccattctttgtacgatttacagcagctcccttggaaaggaatttactggtcggtgtggtgtggctgttattatgtctgagtttaggaactgcttctaacttctcttcattaagtagttaaaaaatatttaatgagtctctattacgcgttaggtgctctgctaggaaatggaattatatgcagagaccacagtctctgatctgatgtggctcatgtactcagagaaatagcacatgtaaataaacaatagttatggcctcgcttgataggtgccatgacatagtggagagagatgttaaatgttatgggacccatgaagaggcgtctttgtctgcttgacaaagtcaggaacgctttcagaggagagttaatatctgatctggatttaaaagaacgtctagaaatatgagcttaaagaaatacacggttttattaaaaacttcatacagttattcaaaattgagtaaggataaacccagttaaattcaagtctggatatacttgccttacatgagacatctaaattttatcaatagcaacaacagaaacaaaataaaaatgagaacggattccctctagggtgtttgcctgtggtaagcaagatgaggctgtcctgcagtgctggggtgaatgcttatgagccctgtagagcccagggtagtctggacgtgctctgcaactctctgttttataaatgagccaaagacggcctgtgtgcactgatgcccgggttgtttatttcttcattgcaggctgagagctttagctcataagcctgctggcaccaaactcaaattttacacatccaattattttaaaaatagcccaaactagcagacttgtagccatttagagcctgcctgctttgcataccctgcaaaacttcacctgacagctgttacccattgataagataagactttggagttgtaagatcctgttgaggactgagttctgtcttcccaaaactgctatgttgaaatctcaaccccaggtgcctcagaatgtgactgtaccgggggctgagttctttagagagtaattaagattaaaagaggtcatgcaggggccctaatccaatatgactggtgcctcctaataagagaagataagaacccagacacacacagagggaagaccacgtgaggacccagagagaaggggccttctgcaagccaaggaggggcctcaggagaaaccaaccccactgacaccgtgatcttggacttctcgattccaaaattaagaagaaacagatttctgttctttaaggcatccagtttgtggtactttatcatggcagcctgagactaacacagactccaagctgctggtgtccatggaaggcctctgccccagagacgcctcaccctccaggctgctgagagacaacggctggaccccgggcccttctatgatcccccttccttggggagttgatgtgccattctcccctgcttggtgtggcccccagccactgccgtaagcctctggaagagcttgtgttgtatggggtctcccttctcatgcaagcatcgcctgataaaacctgttgtgtgatcctgcctctctcaagttcttatcttttccatgatcagccccagattcctccaacccctacacactgcctggggtctttgcaaatcaatgtcttactaacaacaaggtccctttgcatttggatcaactcatgtaaagttcttgttgaccaacccaggaggtatttattaaatatttattttggttattttcagcatgatatagccaattttttttctttatactagctctagggtgaatacaaatataatataatatttttataagaatatgaatctcatgactcagaattattaatttcatgtgctattacttttcactatgaaagatgaaaacgctaagagcagtgttaacggactatatcagatatagtttaagatttggaagactaattatttagatctctgtttttctgtgttttactgtgaatgcagaaatttaaattatgttttcagcttttcctgtagaagactgcttaaatgaaataaaggaaaacatgattataagtacctactgtatgaactaattcatataagaaaacaagcagtttatgagacataatgatatcatattacaatcaaggcctatacataaacaatgaaataatcattcagagagtaattttagactaacgtagtgataaaagctgtatgtcgtgagggtcaggcaggccccgctgtgaatgtgattgcaccagttgctaatttgctgtcagtgcagtcataggttaaacagctaatctcccagaccactggcttcctcgcctataacacgcagataataaagaagagtctgtatttcacagagatgtgatcattcagttagacacatagataatgttcctggaacaataactgtggcatactaaatgcttaataactactgatttctaactccctttactgctttattctacagcagtttcattttacagagttaataccaaatatgtataatgtatttaacatgcacgagcctttaaacacctaagagccacgaagttattcaaactgaataaatgggtatgaatatatgttaataatcaaacactcaaaatactaatacttagttttaaataactcgtttatcaaaaagttcatctcaatgcttcaagtaatggctaccaaagccaaacttaaatgtaaataataaaaaatctactttaaacatgattgtcaaacatatattcaacagttgtcagatgcaaaagccacacgtattttgtagttgataagatttgcatttgagtagggtgtctagtaacagtctaagagtacatatgacatttccatgttttaatgaatttcaggtagctatgataaaattctaaacctgttctattcaatattgatactcattaaattgatacataagctgtttaagaaagataaatactgcacagctcacggaaaggtttattaagattttcaaatgtctaatatcatccaaaaatctagggggaacattctgaattacagtattatgtttttactggaaatataacttgccataagacaagaagacagagtatggcacgaatgatattcatgtgggctgactcaatgcctcatgttgtcataaatctggccttttcatttctccctcccacagacacaaaacagcagcatccgacgcccagcagcagcagcagagtgaggtaaaagcgcaaagcttccatcttcaggataaaagattcttctcataagacaatttgtgattccttaaaaatatgaggacttcataataaaaaactatattgaacactaattttttgactgtgtgagggaaacatataagacataaacgtgatatcctttactgagatgaaaacataccagtaatattttaatattctcagaaaactatcgcaaggacaaaaaaccaaacaccgcgtgctctcactcataggtgggaattgaacagtgagaacacatggacacaggaaggggaacatcacacaccggggactgctgtggggtggggggcggggggaggaatcgcattaggagatatacctaatgctaaatgacgagttaacggtgcagcacaccaacgtggcacatgtatacatatgtaactaacctgcacgttgtgcgcatgtaccctaaaacttaaattataataataataaaataaaatttaaaaaaagaggaaaaatagaataattaaaataaaatctaagtaaattataggagattattcggcatggtctaaatacagagccaatactcttcaaaggttttcaagtaaacattccccataaaatcgtgtcatgagttaaagaatttatcagcctaatagacacattctcccttttttaattgcaaagagactccccactttctcttttgctgcactacagtataatttctttttacccaaacactccttatggctagttttttcacatcttttagaacaagagtccattcccaccaatttaatctcattccttatcacaacatactgtttgcgacgctaatagtattttacattttgcattaatgtgttaaattatttacctcttgcagtcaggattccctaataaattactagatctttgaagaacaggaatgagtttgttgccttctcaatgcatactcaatgctggcctggcaaattatatggaatctataaaatatcttttaaatggaagagtacctaaatgcatggatgaatgaacttatggttcaatgataaaaatgataaaaaagaaaagaatcaaaatgaaaaagtaaacataaaaataaatacatattcaaaattaatatatgtataaaaatttttaaagtagttaatcaaatttgctaggggaagctgggcatggtggctcacgcctgtaaccccagcactttgggaggccaagcagggtggatcatctgaggtcaggagttcaagactagcctggacaacatggtgaaaccccgtctctactaaaaacaccaaaattagcccgacatggttgcaggtacctataatcccagctactcctccagaagctgaggcaggaggatcacttgaacccaggaggcagaggttacagtgagctgcgattgtactactgcactccagcctaggcagcagagtcagacttcatctcaaaaaaaaaaaaaaaaaaaaaaaaaaaaaaaaaaaaaaaattcttgccttttggagccagggatagctctatgaaagaggatatggctgagctagatcttataggatgacgaaattcactagatttggttcatgaggaagtgaattccaaacagtaatgtattctcttacattatgtagtgtgtgtgtgtgtgcgtgtgtgtgtgtgtgtgtgtggtgtgtatacatttttcattcaaccaaaggttatcagagaaattatgaagggatatttagaaataaattagaataaattctatgcttgtttaacactcaactttctctttagataattttacagtattgcatttagtcatgatgttctggtttttatttatacattcatctgaaagagcaaagtggtagagctaaaatcagtaagcttggctctgtttccaaactcataaaaatgcaatatcgtggcagaaagattcttgtcctatttcttattttacctgggcttttgggatttcacatggacatagttgcaaaataatactccccaaacttcagtttcacatgactaatgtagaacatttgctgtagataatagtcaatgaatttggtattacacttcacagcctagagaagacgacttttcttcatataatgttggctagctggtagcaaaatcatgtctttcatagatctccatttgtagtggataggaaatttggatcttaataagacatgggaagatgaaatgggtcacacagtactaaagcagagaaagacatcccgataggtgtcttagaagccagaaaacctccccatttttaaacagataatcagagtggttatgtcctgggggcgaacgcagagccaaactcaggagttcttggtttagataagttatttccccctactagcaatgatacgccatgaacagacttgttctgaaagtcttgtttgtatgtgaaagtcagaatcctgaacttttgttccaattatttaactctaattgaattaaatttaatttatgaattttaaatatagattattgcaatgaaaatttgaaattatattggagtgccctgtaagtataacgtatataccaggtttctaagacttcttttaatagactctattataacttattgctgatgacatgttgaaatattttggacacatgggttaacattattaaaattagtcatatcagttatgaatttttaaatctgctgctcatttggaattacattcatggctcattatattgctgttgcccactgctgtttcaaccatcgcatataaaattacttacagtcagaaaatttatgaaagatattaaagagttcctcttctaaaatgattttgcaattttccctacaactgtttcttcaaagttcatcaattttcaaaatgaacagtgacttacaaaaagaactaaataaatatatacattaaaaattgttttctatataaaaatactaaaatgtaacaaaaaagaaccagaatgatagtcatagtgtcatggggtcaagacatagctgtgaaggaagaatgaattttccttccagataaatgagtaaagataggaaatgggaagatgagctgggaagccttaagaacctttaagcagggctaaaatagaaaaagaaaaaacaaaacaaaacatcgataatagcctgtattatttgtatttttaaagaatcatatacctgctgcattttatgttgttcttgaagaatatgcatttatataagaaaattctacttcgaagatttaatgaatgaatgtttccttcttgtctactatagcagtgatacatgatatgatagagtaatgctttttatttcattgatggatacaaaaataaagagacaaaaataacagaattgcaaggtaactttatggtagaaaaaggtggccctcaggtcctattgcgaagaaaagttgcctattttattgccctcctctggtataagccaaacatttcaatagacatagctcataagaacagaaggcatagattagagaaagctcttcactggatacttaagtgtgaaaggaaaaccaagcacctgggtggcctactgtatggttactcaagctccatgtaggagaaaactcagcgctttagctcctgggaaaactgtcaggtcaaattgcacgccatggcaggcacaccatgagaagatgtgtacattttaagggatcattatgaaagttcccagatagcctgcctttttgtatcctagtttttattaaattttgaaaatcaagtgaactgtgaaaaacctctggagtcattgatacggtttggctgtgtccccacccaaatctcatctagaattgtagctcccatgattcccatgtgttgtgggaggagcctggggggaggtgattgaactatggaggcaagtctttcctgggctgttctcgtgatagtgaatgagtctcgtgagagctgatgatttataaaaatgggaggttctctgcacaaattctctctctttgcctgctgccatccacataagacgtgacttgctcctccttgccttctgccataattgtgaggcctccccagccatgtggaactgtgagtctaatcaagcctcttgcttttgttaattgccaagtctccggtatgcctttatcagcagcgttaaaacggtataatatagttatgtatcagaaagttcattacaaatctcacccacaatcagatgagcaaggaaattacagaacaaaatggcaagacacaaaatggattaattaagaatatctgaggtatctttttaaatgaagaactctcaaagctcacataactgataattctgttgcaataattttcaaaacctgtcttttgataagagacagaatttagcaagtggaaccagaccctttctgactataggttcggattttcttctctgtccgcagcccgtcttgctgtgtgatctgttatcatctcactttaccaaagcaggccaacccctaccctatccacacgtgcctgggagttggactccatccttcatgaaggagtcctggtagcagtgatgtggcaaggactgcagaaataagaacagtaagaatagcacacactaatagatccttttcagggaaccatgccctggctacgtgttctccaggagcttacttccataatcctaaggatcctacaaataaggacattgctgttatccttgctctactagggaagaacctggaaatggaaaagttaagaacatgttcaaagtcccccaagtactaaggagtagggcttgtgttaatgacaaaatgagcaggttttcataagctctgcagagctgcaaaattcacagatatagaaactccaaccttttggtgggtggtagtgggccaaaataattctcattatacatcctttggtgctaatttttgctaatggtaatgatctcgtctatttagtaattcaaaataggtccttaatacttgacatgttcacagtcttctgtgggagcaagggatataaaaacaaacatagattgaccctcaaatcatttgccatacctggtttttacgttatctcttttgcagttctgaaactgtatacataatagactcagcctgggctgctgcttcatcaaagtgactttttgttgtagctgttgtttttttcattccagatgaattttcctacttttgtattaagtacactggttcagaaggtgtaaaactcataataaagtaaatattgaaacacatatgttatgataagaggagtgtaggatggctgttgctagttttccttctctctcacacacacacactcacacacatgcagacagaatatgcaattgtggttgcctcaaataacagaatattagtgtggtagaagaaataatgcaagtcagaaaaccaaggttccagtccggggcctgaaggcaactctaatccaggtctactaaaggtctgcttatgaaatgatctgctgacacctcctgttcacacctcatggagttcttgtaggaaataaataaaataatgcatattaaaataacataattgtatgcagagcaatgtatacaaataccacattaccattaaaccatgtcaaccatactgtttcttaactgtgccatcttgacctccaactcctttctccttctttggtctttacaaagccaatcatgatgctatttctaatcagctctgctcctcaatgctctgtgaaagtccaggtgtttccccagccagcagttcctacgctctcctcaaatgggtccctatgttaggttttggatctccaacattaaatgtagtttctgatgtggtaaatcctccctgtgttttttagaatgaacgaacaactagactctggaatagtcccaagaaaaaactccccaggcattgaattaaaaaggaaatccagacctatgcatcatatttgtatgtataaagaaagcagtgggggaagctagggggaaattaaaatatatttatatattaaacattgaagtgtataaagaatgaagacaacactcaaaaaaaaaaaatgaaatacccatctagtggacaaatatgtgttaacaacctgctagtaaaaaggtactattctactgttaaaagcaagaaaaacgcaatagaaagaagatgtattcctctgttttcaaacaatagcagaaaatatacactagtattcaagagttgatttctgcacagatagtaggtgatgcttgtggctgaaacaggacagctgagtgaggccacgttggtgaagcccacgggatatgtgatgggaaaacatgacagcagggtatgaaccctgcattttcatgaccatttttcatcacacttggtcttttttttttttttttttggtttggtttgggtttttcagtgccacctagtgaagtatttattacatatagtgagtcatgttgatgaaataaatgtctttatctccttagacaataaatacgcccagagtttttaaaaccaaatctgatatttgatcctaaaattctttcaaacaaattatcatacatgattctatcgacaaagtatttagaaattatccagtaaattacggtgagtcaaaattgtgcatttttttattttcaacaatttatataataaaaattggaattcattcttttaattttaccatgacttctaagtattcttaaaaagtaaaactttaacagcattgccacattcaaagccacactatcagaaaactgatggcatcacagaacaacttgccacgtattttttttactaggtttgtgcaaaataattgcagtttatattttgaatcaagacattcaatattttctgttaacgatgtcaattaaactgcaagtcaaatacatcaacctttctgaaagatgatccagatcatagtgctaaattttcaatctactccaacattattatttgggaaaagttgaccaggctcccaccttccctctatgccacaacccccacctaccaacaaaaaaggaagaagtggtcctttagagaaaagcatcattcactcgaacagagaggaaaggaaagacaacactctgtagtatggtctgtaggtagctatgtggccaaggctcccggcatggggatttctcagcagacagtgagtgagaaacctccaatcttaacactccccttccactcacagctgaaccaccaactgtcattcccaacaatgggaatgctctactttaaccatgagctgtaacatattacaaattatgcagataacacattgatttgtcgtaagagcaatttagcgccattcctctagtaaaacagtatttactcttccttgtagcaacccctaaaggaaatgattgcacataagaaattgtaattatctggtttatacatgaagtatgaatttggtgcaaaagtaatagcggtttttgtcattacttttaaatgccacaaccacaattacttttgcaccaacctaaaaaataatagaagtctcccaagctagggatggtcaggtgtcacctcgtcatcacatgggcaatgcttatttcacaaggacaatcaatagccagcattccacacagggacatgtcaattactatctagaagcagcaggcttcccaggaggccctcttgacatgtgtccacagttccatcgtgattcttccagtcccacatgcatttattgaatgataagtgcaggccttagtaaccacctgagaccaggggcagaatatccatgatagatctgggtcctgaacgctgcctttgcccgttgcttccagaaaacagtggggagctctgtttcagctctagaaggagtggagcgggtgatgaattatctttactctaggctattcattttccctgggacacattttttaaatagagatttggaaaatgagacaaactaaaaataagaacataaaaagggagaaagtgttgttaagagagaaccaacatttgtgatttttgagtagaaactttgtagttcacagtattatttcatgcgctacatttgattataatactagacaagagattcccattataaagcaaacatcctttgcaattaccaagctctacataataggaaatgtattaatgtcagaaatacttttgcaaaatactatggtattaggttcacgctgaccatgaagatcgtggtctcctccttcaacaagaattgcatcttacttatgtatgcccaagggcaaatgcctagtactaaaaaactataaaataattgctagatgattttttacatcaggtaattattgtgcaagcaagaatacacactcatgaaaaagacagtggaaaccaactgaattatagaactgtgttgtggtctattacgaaggtagctgacacacacattggtaaacactgatcatgtctctttcaccaacttgacatcactcttgggaattaacaaaaattgtgtaatttttgcaaaatatcctagaagtattagaaaaccagaaacgtagggttattataattatcattgcttaaatttgctttcatatttgataaataacaggttacgttagcagggactatgattctccacaacctgaattttctttcaagatactctaaccctggagaataaatttaatcgacaaatgttttttttctccccccaagaagacataggatatttagccatgattccagaagactattgtgaatgatcaaacatgacttcgtcaaggttagacaatcctggttttcagggaatggcttctaacccaactgtagataccatctatccacatcctcttacttacaaagtctttatagagctattgagctgtataatatttcatatttttctttccctttctttgtgtgtctggatccaagacataatttttttcagaagcttcggaggattctaacttgcttttacttaagatatttttcaagaaagttaagttacccaatgacataagtgcacatataattcttcctagatgcttcccaaatcagatttagttgttttggccagttgggttgctgtaattacatcaaacattagcattaggagtcttttttgtagcatttatatgatcaggaatgagctgtgtagctggtatattgttatataagtcttcctctgccctttacccaaaaaacaataaaatctcaccagaaagtaaaatttgtttttatacggtcattttataccttttttctgaacttattttaggccatgcaattgcctttacctatccttctggcagatcctgtttgcaaagttggtgagttgtcagtgtcaagatataaagaatgagtatcacttttccaaaacgcaggttatccgtaccagcaggtgtttgtagagataagtgttcttttgtacaaagatgcatcttgtgcttaagaagttggtagggccccatattgcagccatagatcccagaactatagataaaatttgaatactgaaagtacatagcagagagtggaactttatacagtacatttctttctattaataggtacactgataatgaaatgcatcatatacatgactttagacacactacaatcgtagctattcattctttttactgatgaatcctggaaagtctaatgcagaagttagaaagattaagttttcagcctgtgtctttaaatggaatgacgtcttagttctatgaaatcagacttaacaggggaagataaggcaacctacagggcgtgcctgcttcctgagggtgtgctgactggcccagggcactctggattgtattcagtctctatagaatccatggctctcactcagagccctgggtgtgggatcatgtcagtgctttggaaaacatgcatcaaagcctagagcctttcccaccacattcagcagcatatgcttcagatgggtttgcattttgtgttctggttctgactttcatccttttaaggactatttctaaatacttctcaatgtccttgtttttgacctgtattccttggttcatggctgctgtttccaactttctgttccatcttcagtgataagacaatatctagacaggagtagccccacaagtccaattaatccctacctctctagagagccatccatgaacagcaacaacaaaagttattttataggaataaagaaggtgggatccaggaagtcacagaaagacattccaagactctcaatcatgccagaaggtaagtggaatatgcaaaacacatgtggacttttaccatatctaccacagatatgaaaatactccataaaatgagaatcatgtaagacttagaggtcagctgtgtagcatggcgcctagagttaacaatactttgctgtgtacttacatttgctaaaagggtagatcttatgttaattatttgtatcacaaaataacaataaacataaagcaaaaggaaattttagtgttgatgtataggtttatggcatagattgcagcaatggtttcatggtgtacaccccacaaactctccaatgtatatattaattatgtacagctttttgtaggtcaaaaaaatgtttaagtaagatgagaatgctgctgaattttcacataagagctcactttctctctctctctctctctctctcatacacacacacacaccatgaaaacttctgtcttttaagaagtgtcctaagaaaaggtatagtactaaaaatgtcttaagctttccatgtttgagacgggattagcttgagttcaaggagtcatctaaaataccccagggaacatactgtatttttgttaggtctttgtgagatttattaacaaaaggtgacgtttgtaaaatcattttctttgtgatgatatatgtgagacggtgtttttttaaaaaatgatgatctgaaaagttgatcagaggataaagaactctctctcatgagtaacaaatcagaagccaccaaacagtgattctcaaagtatgttccagggaccctttgggggatccctgaggtactctcagaagccatgaggtcaaaactcttatcaggacaatattgagaagtcacttgtccctttcttattctgttcggagtggacaatgtggttttccaaaaggtacatagtgcacaacattacaacagattgtatgcaaaaaaaattacaagaatccagctgtctgctgttaaagcaggcattaatatgtttgctcaaatgtaaatcaataccacttctctggctaaattgttttcttctgaaaaaaattactttccttaaaaatatgttatttcttataaatatgcaactcataaaatttaatgatttataactattatttaattatgaataaatttctaaaaatgcctctgtcttcattattgacagggtaaatataagtagataaaacttacataagcaaaagctccttgggggcagtgttgccagatttaacaaagacaaaagacaaccacaaaattgcaacaggatgttaaattccatattaacagcaaattagtttttagtgtaagtataattcatagaatatgtggcaatcctactatggggttcttacaaatttttcagactataaagcggtcctgacagcaaaagtttcagaactgctgccgtagaaaatctttaggtacaaatttttcatttaaatcaaaattcgtgcataggttaccgtcaggttgctgcccatgctgctgccattgttttttttttttaaatttatttaatttttttatttttatttatttttgtttgtctgtttgagaccgagtctcgatttgtcacccaggctggagtgcagtggcgagatcccggctcactgcaagccccgccttccgggttcatgccattttcctgcctcagcctccagagtagctgggactacaggtgcccgccaccacgcccgactagttttttgtattttagtagatacggggtttcaccgtgttagccaggatggtctcgatctcctgaccttgtgatctgcccacctcagcctcccaaagtgctaggattacaggcacgagccaccgcgccaggcctgccattgttatttgtgactgcataccatgctccattttgtgtcttcatcatccggatttaaataagcaaatattgttcacagtttatcgtacaggtagtgcttttttttttttttttttttttttttttttactttcagtgctgggatacacttgctgaacgtgcaggtttgttacataggaatacatttgccatggtggtttgctgcatctaccaacccatcatctaggttttaatccccacatgcattaggtatttgtcctaacactatccctcccctttcccccgaccccctgacaggccccagtgtgtgatgttcccctccccgtgcccatatgttctcattgttcagctcccacttatgagtgaggaacatgcggtacttgattttctgttcctgtattagttttctgaggatgatggtttctagcttcatccatgtccctgcaaagggcatgaactcattcttttttagggctgcatagtgttccatggtgtatatgtgccacattttctttatctagtatatcactgatgggcatttgggttgcttccaagtctttgctattgacccagcaatcccatagccaaaggattataaatcattctactataggcagcgctttcttttccttatttccttttcacaaagaagtaaagtcagcctcattcatcccattataccggaactacagctgagcttcgttaagtaatgcatgcacacaaaaagacagacctagtatctgagccataccctccggcaccaagatgtgaggcaaatcacatgaactgccaccccatcctctctgccgctctctgttggattacgttgattgtatgatactctatcattttttgttactataaaactgattaacctggctgaatcatcgcgagtagaatacagatatgtaacttaactgtgtgagtaggacattttttgtaggatctgtcaccaaatgtatatatcgccatgtaatcagtgacgtacagttgttttgccatttttagccacactgatagatgatctccttacaggccatatgacaatccattaattaaaacaacaaaaataactaaacccgatgtgccgtggaatgtattcaggtcatttaatcataagcttcaagaacagagtctataatttgtatcttgggtattggaaaaagtcttgaagtcagatgatttgggttttaatctcaactctattgattgctttcggtgagtaatttggttactgacaatatctatgtggctttgtttttgtcatccctataataagtataacgtcacctgccctacacacccccagaaggttggaaggaaggtgtaactacatgttaaagtgttttgccagatgtaaagtcctgtataagtgtaagatgcgagctttctgcgctcgtcaggccctcatggtgcaccatggccccacgctagctctgtgtgcttatctagtttgtcagaatcagcacttcttttaaacatttttgtaataacagctttgagatacaattcccataccatgaaattcactctctaaaagtatacaatctggtgctttttagtatatgtgcagagttttacagccaccatcataatcccttttcagaaacttttatcactttgaaaagaaatcctgcaccgcattcagtcactccggaagagaaatcctgcacccccattcacagtcactccggaaaagaaatcctgcaagcccattcacactcactccagaaaagaaatcctgcacctccattcagtcactccgaaagagaaatcctgcacccccattcagtcactccggaagagaaatcctgcacccccattcagtcactccggaaaataaatcccgcaccctcattcacagtcactctggaagagaaatcctgcaccgccattcacagtcactccggaagagaaatcctgcaagcccattcacagtcctccagaaaagaaatcctgcacctccattcagtcactccggaagagaaatcctgcacccccattcacagtcactccggaagagaaatcctgcacccccattcacagtcactccagaaaagaaatcctgcaagcccattcacagtcactccagaaaagaaatcctgcacctccattcagtcactctgaaagagaaatcctgcacccgcattcagtcactccagaagagaaatcctgcacccccattcagtcactccggaaaataaatcctgcaccttcattcacagtcactctggaagagaaatcctgcacccccattcacagtcactccggaagagaaatcccgcacccccattcagtcactccggaagagaaatcctgcaccgccattcagagtcactctggaagagaaatcctgcacccccattcagtcactctggaagagaaatcctgcaccgccattcagagtcactctggaagagaaatcctgcacccccattcagtcactccggaagagaaatcctgcacccccattcaatcactttgaaaagaaatcctgcacccccattcagtcactccagaaaagaaatcctgcacccccattcagtcactccggaagagaaatcgtgcacccccaatcagtcactccggaagagaaatcctgcacccgcattcagtcactccggaaaagaaatgttgcacccccattcagtcactccggaagagaaatcctgcacccccattcagagtcactccggaagagaaatcttgcacctgcattcacagtcactccggaagagaaatcctgcaccgtcattcacagtcactctggaaaagaaatcctgcacccctactcacagtcactccggagtttctcctccctagatcccaggcaaccactcacctactttctgcgtcaaaagattttttggttctagatacatcatataaatggccatccaacatatggcattttgtgactgggcttctttcacccagctaatgttttcagggtgtacccacgtggtagcatttgtcatcgtagtactacattttaaacatgtaaagagctcagtggtgctccaagaagcaagactttggtagagacggccgcttgctcccaaatatcatgctgaggaagccaagttgtcatgacacaaagccaaggattatcagtagtttagagttaattcatttggaaaggcttctgtatttgatcccagagctgtgagatccatatgaccaggatggacggacaaaaaaggggacttttgctgttaatctacgtgagccctgatgggcagaggcctagatcctcctattatgctcttggagtttatcaacccactcttgaagaacatagtacagaccttttgggaacacaatattcttgggaatttttttttcagtttacctaaattattaaccaatccgagaagaggatgttaaacaagaaaataacccactaatgatgaagatctggcagaccccaaaacgatgtcattgcaaactgaagatttttaaaaacatcatcaaaaagtttacaaatgactcacagagagaaaaacctaaaaatacaatggaattagcaatagtattacagtgggagtattttaataaaagtacactgtaatttttctgtgcttctatattttatatttatataaagttttatgcctataaagtgacaaatctgcccttttggagtgtatgtatgtgtataaataaatatatgtaattcaatagctagaatataatatacatacacatatattaatatataatatacatatttatatatataaatataaaatacactacaagagggcagatttgtcagtctataggtataacatttgtggataaacagaacagtcttccaatttatagatattgtaattcaggcatatgtaaggacacaattatctcaacagattatgtacacatgtacacaatcttaagctatcttaatggcatttgtcagaacttttgagctgatatcatcagaaaagagaaagcattcgctagggagcacaatttaatagagcacacctgctatctcagaaagaaataccttctgcgtgggcctggccccaaggatgctgaaggacgcccaaggatgctcaaggaggccagcccgactcatatggctttccttttcttccctactctctggcttactttgaagcaatttttgctataaacctctgcctttgcatggatggtttatcaattgaaacttgttttcactcattcacctttactctcttgccagagtatttacaactcattaatatttttgttattgttttaaatgttgccttttatttcagatacagcggggtacaggtgtaggattgttacatgggtatattggatccaggtggtaagcatagtacccaataggtagtttttcaacccctcccctcctccctctttccccattctagtagcctgaaatgtctaattttcccatttttatggccatgtgtgctcagtgtttagttcccagttataagtgagaacatgtggtatttggtattcggtccctgtgttagcttgcttaggattatgacctccaactccatccacgtacaatttctttctttctttctttcctttttttgaggtggagtcttgctccgttgcccaggctggagtgcagtagtgtgatctcagctcgatgcaagctccgcctcccgggttcatgtcactctcctgcctcagcctcccaagtagctgggactacaggtgcctgccaccacgcccggcttatttctgtatttttaatagagacggggtttccccatgttagccaggatggtctcgatttcctgacctcgtgatctgcctgcctcagcctcccaaagtgctgggattacaggcgtgagccaccacgcctggccaatttatttctttatgtgttttctctcttataggactagggtagaagatacaatattaaaaacataatctcccatatataacaactttgaaaattatataatgcagtataatctatataaggtatataaagaactgcttgaaatatcaataacatagtcaataactacattttaacaatttttaaataatttaaatgaatttaattttaaccaaaatcacagggggaagtcaattatttgttatctgaaaaataatatgtagttatagagaaagtatcttattttagtttatttattgctatttttagaataacaagttacttttgtagcgtcttccaaggatgaacaatagaattcatttgcttatctgcttgtagatttgctttgcaatcattataaacttaaagattttgatgaagtatatgtgtttcaatccattgccattatcattctttcgatgttcaaattttttatcttgtaacagtaagagctctccaagttactcgtaggttaaccctaagtcatccaagatagcatctctgttctgtgaaattataatatagttccaaatcattctgttcatgatttgccaaagaccttgattcagccattttctgaggagccctgatctctttatttacaataaggtatttggagacaataatctaaatgatcgcagtagtactcattgttaataggttagttcatgcttctaggacttttcagtggagctataaaaatattttccctttctttaaaggaaatacatcgtgagttcacactcctgcttccaattcaaacttagggttactgagcttttacttctttacttttataattaactctttgttgttgatgtttataataagaattgagaaacttagatcttaacaatgttgatgtaattatttgttttatcttaaaataaataaaagtttcagaatatcaatgccaccattattaacattatttttgaaaacagctgaaaatttcctcagtgttttcatagggcgtgccccactaagtcagtaaatctgattaccatgttcaagattcacttgacaaggttcctttctgtatatataaaccgcaactcagtaagtaaggagatttgttttatttgactgcaaatttttaacgatgcttttgcatttcattttaacctattcataattatgtgaaaccatatacacatattttaaataaaatctacaaacatgttctattaaaaaaaatctagttttctccctgttttcagcacacacaacttcccatttcctgtgtgtaatatttatttgcttgtattttttaaatttatccttacaattttaaatttaatcatatatatacatataggtatggatactctcagccatttgtatacgtgaagtttcagcctaggtgcatccttcttgtactttctctaccttgtctttttctcttaacaaatctcacatgtcatgatattgtatacagagatattgcattctccttcttacagcagcatcggacactgttgtggatatcctgccgtttagtggctgcacaagtggatactgagaataggtacaggttatttatttattcctttatttgtactttgttatttatttatacttttatttgtactaatgccagaataaaaagttttgagtatatgccacttttactttcaacagcatatatttttgaatagattcctggaacttatctgctgtgtcagatcatagcacctgtatcattttattaacatgcggccaaatttcctttcacaaggggtgtcaccttttgcattttgcacaatagtgcatcagagtgccagtttctccagactctcagggagaaattgtaaaactgtgtaaaaatgtaaaatgttacttattggaaaaatgagaaatggcatatcatgattatcattttcatttctcttaacatatcatacaaatttgagcacggtcttatattaaacatcaatagtgggttatttaaacctgcttagacaatcaaagacagaaaattctatcaaaatagggaaatgtgaactattttcaaatatgcatttatatgtaaaactgtattacaatttgggtcctcttgtacttttctgtcatgagactactatttatatatcagcattaaagggaaatataatttaaaatatttgatttagaggaaactgacaaaatacagtaggtatttttagaaataaattatccatctggtaaaatgcttatctttttataaatgctgttaaagatgcgacttaataaatgctaaaatgagagattattatataaagaaagttgtgctaattctgtagggcaatgtaatattgcatatagcttttctgttttgtgattattcctattattgttattgttattaaaagtcatattactaattgctataaggctaatagtcatatattccagaatttggaactgtatgttattacagactagttttaattgactctgattaaaaagattagttttcaagttgaaaacttgctgaacatttcgtggcctgggcttttctcggacctactgttatctgacactattctataaacatttcaaattaagcattgatttgcattactttcattcttcctcgaagactccatcagggtgtgctcagacaaaagcatggcttcccccagcgaagccacgggaatacgcagtggaagacctacctggcctcgaatcaccaggcatgcagccgttgctgactctcagggccgtgtttatccaacagagctgcgtaagatccagcagaagcagcactttttgcattgctttgatcacataggatttagaatgcttattttctcattagttattctctctttgtgagaaaagcattaacttcattaactggctctgacaaaccaatttgcttttaacagctgtactcaaaaccagacaccatgctctgcgtcatggttttcatctgaatcacataactgagtataaatatagctgtcaattgcttcatctctccaataattctggagacattttcttgctaggtatcaataaaacctcaaataaaatagaccagagcctgtgatgtcatttggcacaggtataccatgactccggtgtaacatgcaactggaggtggctacattttttttttttttgcctgctatttactgccttgatgtatgtggcacccttatatttttctaatccctcttctgcatttattttgttatcctaccactacgacattgcaaatattataacttctccagagttcatattttctcttcaggtctaacttttttttttaaaaggctgggtgcgatggcttatgcctgtaatccaagcactttgggaggccgaggcagggagatcacctgagatcaggagtttgagaccagcctggtcgacatggtgaaaccctgtctctactaaaaatagaaaaattagctgtgtgtggtggcaggtgcctgtaatcccacctacttgggaggctgaggcaggagaatcgcttgaacccaggagttggacgttgcagtgagccgagatcgcaccactgtactccagtatggaccacaaaggaagactccatctcaaaaaaaaatgaaatgaaatgaaatataataaaataaaatgtagtaccaacctggataagacacttgtcatacatcctagcaagtaaacctccaaattatttgatgaagggatttgatgaagttagtgtttacccattttacagataaggaaacagaagctcaaagaagtaacttgttttgggtcacaaagctggtgagaaggtaaaactgatttctcaaatgtacagttcttgcttaccaaagttccccttttatggaatctttgaatctaaaagcccatattgaatgcagaaagctttattttttcagcaaaatgctaattctggcttcagttctaatctcagccaaaataaataaaataacctactcccttgtcaggcaacgttatcctccattgccagtgttaggtgccagaaaaatgtgtggcttttgtttttctttttagaaatgttacataatgacctttagcttagcatattctgtggaaaaagctaaaaatggatttttttgtgggtgaattaacacacaatttgaattattttgcagtattactgtatttgaggtttgccactgccacaagtcagcagacactaaatattgcattcagctttcatatgcagtatttctggaagatagtatgcatatgtgggatgtaaaatatatcttttaagacattttcagtctaaatagacttcccaatctctttcactaagcccatggatcagcaggaatgtttttggagtgttcccacagaatcatcatttcatttatgatggcattacatttttagtcagtcttcaaaaactcatctttgaaattgtgtgaaaaaaatataagcaaatatctttcccccaaaatcctctaatatttcattagccttacagaatgagttaacatatttagcaaacttccaacatttttctcatgttacactggcttataatgttaaaagggacttaggaaaaaagagtttgatgtaccacaggtggactgcaaatttaaatggtaaaataactgagaatattgtttattaagattatagtaggggaaaatatcctagctctatccttgaattattgtgattttacggaaacaaaatgttttatctttagtcacttagaatacaatactttctgatagttttaatctggtttattttccatatgggttaagcattatgtgtatgaaatagttttcccaaactcttttctgggtcaccttctgcctcaagacaggaaccccagagaggttgggtgtgcggaaatctcagggctggatttctcttcccatctaccccagcccaaactccgccccgtccaggtgctgcctgcagatgcccatggctattgagccgctcaccggggccctcttcccctcctcactcgccaagcagcaagctgaacctcccccggcttctttctgtcatattattttcaatacgattatcgtgacaccatatataagccctatgaatatataaacaccgaaagtggttggcgtgcaatgtaaagcatgatggactcaagttaggaatgaagtttgacaggaggggctgggatttgctttaaactgctgctggtttgctcagataatgtggtagattccagcaagaagtaaaataaggaaagatttctgcccataaacatctcaccaaaatttcagaaatcaccactaaaaaacttttccatgcaaccaaacaccacctgttcccccaaaactggtgaaataagcatgaaaattaaaaaataacaacaaccgcgaaaatctcaaaacctcaggccgggtgcagtggctcatgcctgtaattccaggacttaggggaggctgaggcaggagaatggcttgagcccaggagttccagaccagcctgggcaacagagcgagacctcatctgaaaacctaatggatgggaaagaaatgaaaacagattattttaattaaagataataagcactataacagaagtgaaaataaaccttgagaggggccagacatgggagcacctaacagtgtacaaaggtcaggaaaggcttcttggaataatcctgagttcactgtaactgcggatgcttaccaagtgtctaagctgtgccaggtactaagggctgtccacttaccttaatcatcccggaccagtgaggtaccttctgttattatccccattttacagatgataaaactgaggcaaaaaaaggtaaaggctcacccaaaccagcaacacaggaagtctgactctccgccactctgctagtctgctatttaattttatgaggctgtagactaaactgaacagctatgattcttgcatacaatagggttaatagcacaggtaaagggtctgaaacatgaaaagctcaaactctttaaatgcctcattttacttagcaaaatgtttcacaaactcgattgttagaaactctaaggacatttttgtgtttccccaaaatgctattgtctggagagttgagaattatgagaactgatttttttaccaccaatttaagccaatagtggtgccagggctcaatttcatgaatttccagctgcatctagggactggaagtcccatctctgctttgccagtaactactgtgtgacttagagtgagccagttcgtctctctcatccccaggatctactggcacgtgctgatcataactacccccatgcagttcttacagcaattacagtgggtactgcctttgaagattttaatgtgttaaagtgtttttatagttttgcttattttgtaagcactgccttcacctttgcacttctaagtgggctccacttggatcaaggtgtcccacgttatcaaaaatcggtaggcgtcgtggctcacacctgtaatccccacactttgggaggctgaactgggcctattgcttgaggtcaggagttcaagaacagcctggccaccatggtaaaaccctgtctgtactaaaaatgcaaaaattagccgggcatggtggcaagcacctgtaatcccaactactcaggaggctgacttgaaccaaggaggctgaggttgcagtaagccaagatcttaccactgcattccagcctgggtgacagagtgagaccctgtctaaataaataaataaataagataaagaaaaaaagaatcactcttatatcaccatgcttgaccaaaaataataataataagtggaattctcaataaatcctgacaaaactgtacagtcagcaatatgaaatgccagggaagggatggaggctggaggcgccgcacctgtagctgcactctgtccatttctataggatgaatgttggcaggcgatgaatttccagatgaggcctgactgacctcagatgtggaggaagaaatgctgtgagccacactctgttgccaattgaagcaaatgtggtcccagagcctgaagtccccgtgtgcaatgggcgccctctagcttcttaccaagtgaaatatatgctcatttctggacaatgaactcaacagtttgggcaagtaaacactatactgaatccacattcttagaactcttagttctaagtcttcctcaaactttctgaataaaaatatggcacaacttgtttcatggaagaaagaatcaagttaaaataccttttttttgaaatattaggataaacacagtcaacaaaacccatgaatatgttaatataaattgtcgttctccataacagaaaataaaagatacaaacttactaacaaaaaaaaagttttaatttttaagttttctcttcagaagaataaccattaaaaatctcactagacactgacgttttatagaacacagttctgagaacaatgggatatttgaatagatcaccaaatcaattttttaaaaaagcacaattattgaagcctcctttatgaatgctgttgcaaattagaagataaaagggtgctgtcatttttgcccagtattttatgttattgctaacgcaatttttttcaatgtaacttcttcactttgctccaatgcaagagaatggagattaacagactatatcaccactgtatcttatgcggcagaagatagtttgaatctatttaaattagggaacatataattcaatggatggtcatgaaaaaaataagtgaaagtacaaagtaaacatatggtagccatacatattttaaaatattcaagaaatataacatgattatattattaaatatttgtaaataaagaaaaaagtttttttcacagtatatttctatcactctaatagaaatatattagcatttttgaatatttatctaatgtttcttcagggcacctgcctccatacagttataatcatggcatatttgcaatttataaccagtgttttacaaattgatagtctatattttagagtaggtttaaggtgatggtaaaatgtagcagaaataagatttcatatatacccctcacatgcctcccatagttttccctattatcaacatcctgcattagtgtggcacatttattacaattgatgaatactgatacattattgattcaagtccattattgacattctatttctttgtgttatacagctgtgtaagttttgccaaatgtacaaagtcatgcatccaccattacagaatcacatctgacggtgtggactgccctaaagatccccaaagcttcacctgttcatccctcccttcctccaccccctggcaaccacccatccttttagcgtccccatagttctgccttttccagaatgtcatatatctggaattatacagtttgtagccttttcagattggcttattttacttagcattgtgcagttaagtttcctccatgcccttgcatgaattaattgtttccctttagccctgaataattttgattatctgtatggaccacagtttatacattcaccaaccgaaacacatattggatgcttccagttttgactataaacgttcatgcacaggtttttgtatgaacataagtttcaattcatttcagtagatacctatgatggctggatcatatgggaaggacacgtttaattttgaaaaaaaaaaaaaaaaaaaaaaaaaaaaacccacaccaaagtgtcttccaaacgggctgtaccattttgcattcccaccgctaatgactgagagttccagtggattcatattctcaccagcatttgatgtcaacattttgaattttaaccattctactaggaatgtggtggtatctgattattgtttcaatttgcaattccttagggacataagatgtggagcgccttttcatatgataatttgacatctgtttatcatctttggtgaggtgtctgttaaggtctttagcccatttattaggttcattgttttctattgagttttacatttaattatatattttcggacacaggccctttatcagaaatccgtttttgcaattacttttcccagtctgtggcttgccttttattcttttaacattgtctttcttagggttcttaatttgcataaagtccaacttaaatgattttttcatggatcacacctttgatgttgtatgtaaaaaccattgccaaacctaaagccatctgagtttcctcctttgtcatccttgtgtggttatatagtctcgcatttcatatttaggtctatgagccatttttagttactgtttgtaagaggtctattgtcaatatctaaatttatttatttaattttggtaggtagatgtccagttgttattgaatcaaagtttttcttttaaaaaatctattgttacttttattaataaaaattacagtagttataaaattttgtaatagttatatgtagtttactctttccttgtaacgttacataaaaattgacttttattttagctaatatatgttacattgggatccactgctgacttttaaaaattacttataaggctttagaggacacagaaggaaaaatttatatattaatcttaaaaatatacacaaatcttcaactataaataaaataatacaatttaactatagttggtaagatgcattaacgtattccatgtccagctttaagccagggtgtattacaatgtatccttgaaaattcattctcaggcatgggtcaatgttacagtgtcagagcaaatccatttttgaagggcagcactgctgttcacttatagaccaaaaacctgaattagctacctgtaacacattaatgcttcactgcttccaaaaatagggaactggaattgaataagcagcaaggaatcttctccatcacattggtctttaatgttccacttacattgaaattcagaaatatatttgagaagtttaaaaacataatatgtcacttgttgtctataagcatattcgtaatgcattttactctatatttatcacgcacgtatctgaatgcatgcacccatttaaacaatatacgtgtgtgtgcacacatatgtgtgtatgatgtatataaaaggcatgttaagaggggacatagtaacttggaaagagcacaggttttaaagtgaaacagacctttcttaaaaatcatatttgtgagaaacagctatgagaacctgaacaatggaatttgcattttcttagtcataaaatgggaggtgcagtaatgtatagttacttcacagtgctttctcaatgaaagatgaaatacttgttgcaaaatgactcaacagtttctaacaccagaaaagcccttcataaatatttattattctttcgttttattctcctccaaatatggagttttcaatcaatgaacactcaacgtctgccttgattaataagagtcctacatattaggagagaggtaaaaataggaagggctcgtttacctacttttcaatatatctttaaaaataaactagtgggtagatctcacgaccctacgaaagaatctacatatataaaaatgtaacacaaaaatgaaaggttctttgggtcacagtgatactggcaacagaagccctggctagagaaaaagtggttggctggttcgtggctaggagtaagacaccctaggagtttcccagtgtgcagtgagacatgctcactattttctctgttaaagctgatgccaacggatagcaaattcctcactttcacaggcatccatggaaaaacgcatctgtacctggaatcatgcaccatgttaaaatccattgcagagcaaactagctcatcatctaggccacacaggagacagtttctaggaagatcatttcatcaggtgtcctctatcccctatattttacatttagttctctcttttctccatcatctaatcacattcttgcctattctttctcagaaagaaactttctcccatgtcgcctgaatccccttcttatgacccccttctactgcattccatccacagctgcatctacagagacttttcagcttccctccacttaccacctgcaagtcaacttcatcagacaccctcacccaggtataaatggaaagatttctactgaaactttcttcagctcatcagaggcttctagaatcaaaatccaatgaacatttttcagtttattatgtccttgttatatctacgggccttggccctggtcgcacaagaccacaagcccctgctcccaccacttctttccctctggagggtcctttccatgttcttttctgtcttttcctctccggccatttatgatggtaaattttctgtgtcaacttcactggggtaagggttgcccagatagctggtaaaagattgcttctgagtgtgtctgtgagggggtttctagaagatattagagtttgaatcggcagactgagtgaagaaccacccttaccattccacgggcaccgaccaacccatggcaggccacaaagaacaaaagataaacggtgaattttctcttttccagagctgggacctccatcttctcctaccctagtacatcagcacttctggttctcaggccttcagattcaggacaggactttgaccactaactcttcttgctctcaggactttggccttggctgagttacgccaatggctttcctggatctccagcctgtagatagcagatcatgagacgtctccgccttcataatcatagctaagtcaattcccataataaatatatatgtgtatgcatataaattatacatgctacatataatatataaaaatatatgcatagttatatttataattataatatttgtatataatacaacatatgcatatatatgtatatcctatctgtacactgctagttgtctctctctggagatccctaacacaccatccctgagatgttgattctcctctgcccctacaggatagcctcattcacgtacatgaagtaggcatcaccctgtgtgccctacatccttatctataattcatacccagacatcttctttgagctccaaattcatacatccaactaccttttggacttgtctatttgtatatttcatagtcacctaaaattcaatatatgcatcccccagacctgtttctaaattatttcatcagacctgctgttttctgtctctatcccaacccgtccacttattaaactaggcccccgttatccagcaagcctgggttctgcctctgtggtttccttcctgcggctgctgagtctgggtgttgccatctttcagattactaaatgtaaaggcattataactaggcttgaattttccaatcaattttccacgttgccacagcagtgaactttctaaaacacgtatctgaaaatattactttcttcttttatatttgtgagtggattttagaagaaaatacaacttcctagcatcagattgaaaaagaaaaaaagaaactttcattatatgcagcagcccacatttctggcctctttttttctaccaggtccctatgcacactctgctctcactgtatttacctgttcgtagatacttggataaaccatcatctatctctcaagtaatgcctgtgtcattctttactgtttttccacaattaaaaagacttaaacattatactcaatgaatgtaaaacgaatgattgagttctgtatgagaaatggtaaattaaaaagtctcttatctggagtagaagctataagcagatgattctgatacaaggaattttgaatgaaaactcttgtaccctggaaatttaatgttcaagaaaatagagtgttaatgtggcagagagaaacaagaatggttaggttttgttgttgttgcacggggattggacgggatatcccagaagaaatctgagcaataattcagccatgacaaaataaaggccgagaaaacaactttgttttgggtctggaaaacaaaagaagggtaattacatttattgagcaaatgtaggccaggcactcccaagcaatccagtactccctttaaaaaacattgtgggttacagccaacccttgcaatatattaaataaaaggcacagtgtaaagaaggaattacagcttgttctcatagtttatttgctttgatgatgatactgttttggatggtaccgaatgtctaggattggagactcctacaagagcttatgttgggcctaacatagcgccgtcaaaaattggcatttaataaaaaatgtacgttgagtgcaaaaatgaagttatctttatgaaaactatcgaaaaaagttcactttttaatttagtcatgtataagtctcatttttattttaataatatcaccccaagaagcaaatactctatcgtattttgtcgttcattgaatattcatgttgtatatttagacgcatagtctatttctttgttatgctataacattcctgactttcatataaatatgaaatcaatgtaattgcattcatataaagcaagacataagccctcagaatgaaaatgccatgcaaaaataaaaaatgaatgcctttcatgtcacactgaattcaatgcacaagcttttctttttaaatatataattaaatatgatttgattagtaatagatgcaaatggctttttttccccacagaatgatttcaaaaatcatcacaattaggtgtttgattttccatctacctgtctacaaagcatttctcttttttaactgatctccagttgtcaaggtaattacagaaccgctttgaaagcagctgcattcccaggtgccttcctgttagttcacgggaaaccatgcaacaacctgatatatggagagcatactgccttggtcttggggggacatgtgatgcgcgcaggaggtaaagtatttctctgtaccttaaaatacatttagaatcctgttaccttggaaatttctcttacctccatatttgatctatctaagttaattttgcataaagttttgagacgcaattgtatttttttatttccaagtttatcagattatgagtaattaagtatattttgttgacttttcacattcatttaatgtttttaacttcattaacttcattaaacttccataagtttgacttaagaaaagtggtcattaaaaaaatagcatcttgccccaattgtctttcttacacagactgactcaagggattcctctcagctgacttgatttctggaaatcactccattggcagcaatgtaatgttatcaaccctaccatattccagaatgccaaagaaattataacggaagaccaaacacccaggtgacttggaatgcgaggggaaggaaaagggtaaaagaaattattccagaaacaagaaaaatgactctctaataatggggtatattggttaacctaaacaaaacacagtaacagttttctaattgtgatttatttctatccatcttcttttgcttttttaattgactctgttaaataggtttccactgattcccagtcttccaataactctttaacctacagataattttgcaattcctccctacccaagaaagacagtcatgtgcacagcctcccgcattacgtgatgctggcactcttggatcaacaaagacatgaatggccgggcgcggtggctcacaccggtaatcccagcaccttgggaggctgaggcaggaagatcacttgagttcaggagttcaagaccagcctgggcaacatggcaaaaccccgtctctactataaatctataaatacaaaaattagctgggtgtggtggttgacacttgtaatcctagctacttgggaggctgaggcaggagaatcgcttcagcccaggaggcagaggttgcaatgagccaagatcttgccactgcactccagccagagtgacaatctaagactttgtctcaaaaaaaaaaaaaaaaaaaaaaaagaaaagaaaagacattacttaggtgaatggccattttcaacattctcttaaaatggtaacttttgagtcacatttctgttaatcaaggacaagagtggaggagaaaagtggctgcagcattcctttttgtcatcctcagaattggaacacccccatgtttggataggcgtgggttgctcggtagaaacggacttttccccagttctccttttctgcttggtgtggccacatgacgaaggtctcagcaaaagaagttcatgggatgtgctgtgtgcaactttccctgtacctcttgaaagcacatttctcagccttcacttttgcttctcatttccatggttgtggtttcacggccaactttgatcatgaggaatacaacacatttcattggaagaagcatacacacacgcacacacacacacacacacacacacacacacaaacccggtccctagatggcatagaaagctgaacatcaccactagcttagatgactcatttcttggctattaaaaaaactgtaaactaaaggtattgcatttttaggtcactttgatacatcagcttattctctatctttaactgtgcggaagctgttaaccaaaaactcctatttttgcaggataaagtttattttttgaaacattttttaaaaaccagaaaacacaaaagcaggtgatttttaaataggtaatgaaatcatagatgttgggatttaaaaggatctctaacagtttacctagacaaaggtgacaaatatactctcctaactcaccttgtctattatccagtccacagtgtcacatgtttaaaatcaatcttaacaactttttcttctgagcccggaggcagtttaatcatctttatcaacacagtgctctacaaaccaccaccaattggtccaagtcgacacagaaatggaaaactatttgctctccttgaaatactttgatcctatcattttacatactagaaaacggagacccaggacttggctcaagttagtttcctgagtatctgactatgagcatttcaacgaattcattaaaaagaaatacaccaaacaaaggctgcccaaattaatatcaggatttataaaatcctgccttttgaagtagtccttgacaacaaattctcaaaactagattcactattttgaatgttttaaaataaaatgtggttataattacctaaagagacactgacctgggtctggcaacatctatgtggagatcctgtgtatcttaccttccacggactcagctcagaaatgtccaccagctccaccaaccctcctgtaatactgaaaatcctcgaatgcagaggcaggctatctttttatagttaaaatccaactgactcaaggctgtatgtgaaacccaatctcttgtcttctcatggtcccccggctgtgagtgcctttggtgtgctgtgtacaccatttcatccactacccttaattctcctccccaccaaaccccatgcggactactgtcctttcttttgttttcacttagatcctctcattcttcacgaaggatttgacctgatggtgatattttagtttgcagaaaaacaacttgaaattgaatgctacctgcccaaccatccctatggtcttccctggctgactctctgcaggttccaggcaccaccatgtcaccccacactcaagatgctgccatcaaatccaggcttctcagtttaacatacaggacaatgttggtcccaacacttctcaggatcaatttatttatttatttattttttgagacagggtcttgctctatctcccaggctggagtccaggctggagtccagtggtacaatcatagctcactgcaacctctcaggctgaaatgatcctcccacctcagcctccctagtagctgggatacctggcttatgccactacacatggctaattttttgtattttttttttttttgtagagatggggtatcaccatgttgctcaggcagactcaaacttctggactcaagcaatctgcccaccttgacctcccaaaatgctgggactacaggcatgagccactgctcctagctggtcacattctttagcaaactaaaagatctagaagtagctttaacagtttaatttcaaaattactaatcaaattattgtcaattgaatgaaataaggaactgacatatgctagcactgacattaatggggtgtcttagaaggcacaaaatctaacatgcattgggattttaaacatcatttgttttttaatcttaagatacaaagcatgctattctatgtagcttggtctcaatgtgagcctccctttcaaggttagtaactcatctgctgtgtttctgcttcagaaggacctgggaaaatccttccctgaaacgttatgcatatccctacactcaaatctcacattcttttttttttcttttggcttctgtgaactttaaggaagagcctactcaaatcccgaatcctgtctcaaagacttgcatccattcccatctcctattggttcaacaatgtgaaggtgtagaaatagtaccaagaacagatttattgggtgggaaatttctgcccagatatatgcagaactctggagaagattaatgaagtcagctttccattccctgggaagcactagtatcttgggcatccggttctcctgaaatggacttctggaatcacagtgagtttcaattggggaaaaaaaaaatgaaagctgttttctgaggtaccaagcctagcaatcgatcttaatgagatgggtctattaccccatcacaagatgctcagaagctttaaaatttaaagtgaaactagataggcatcgtttgaacagtcatctcagaagggtggtaaagtgctttacacacctaaccccacctccttcacaggatagcccactgcaattatgctctagctggatgtttgtgaaaatctagctgagaagctcttcttttaaacctcttccctaggaacaggtgagatggcaagttcctattccccagaagggccaggccttccctcccgtctctttctgctctcttgtaccttgcttatgtatgctggctgcttggtgacatttcaccgagtcagaacatgaagcacgttaataataagctcacattttcaaaatgttaaaataacaccactctctaggtaccaattacttctttcaaagatagttttcgaggtacctatgagccccgtaccttgtgaacacctcactgttgctttgtacgttttcagttgtcgcctccctttcccatgtttcacatgtgtgtctgtggaactcagctctaaaatctggacagtctgcaaccatcataaatgtaacagttcctcattccacttcactccaaagactaagatttcatatatcagctctgggtaaaagtgcttcattttgtgtaattttcattaattactcctgacaggcatttataaacatttataaggcttcattttgtattattttcattaattactcctgacaggcatttataaactgaaaaagaatttttttttttttttttttacaaatgaaagcaaaccattttattcaaaaataaaggagggagagactgcttaaaaagagttttgatgttctttatgtgatttttttagctatcatatttaagaacacattaaacattctaaattagattatttttgatctagcactttagaaaccagcttagctctaccaatatagcatgaaaagcatcagtgagatcataactatcttcagcacatttcccactatttttaggattctagagtgacgttaattgtgcctcatggcaatgctattagtgtacagaatatttctaactgctcagagtaacgtgtaatcgtcctatgtctgccatgaaaagacttctggatcatctatttacaagggacatgattgggttagctgggaagacacaggactgggttagcataaaccaaaacaagctgcctaaaacaagcacaaaaaatctgatgactggttcagctggaattgacctcaatgtgaaggagtccatttagcctgtcacgctgatgtctgctggcatgagacagtctggccaaagcttagtagaccttgcgatctaaccgcccagtgttccacattatatccctgctgtctcgtcagtaccaaacttcaggtttttaatattgtgtgtaaattcaacatatttattatattagtcacttgtggaaacaatcgcgatttatttatttttttgaggcagagtctcgatctgtcgcccaggctggagtgcagtggagaaatctcggctcactgcaacctatgcttcccgggttcaagtgattctcctgactcagcctcctgagtagctgagactacaggcatgcgtcacgatgcccggctaattttcatattttcagtagagacagggtttcaccatgttgcccacgctggtctgaaactcctgacctcaggtgatctacctgcctcggcctcccaaagtgctacgataacaggcgtgaacaggccaccgcgcccagacacagtcactttttaacattagaatgttcacgtaataatttgagaatctggaacaaatttcctgtttaatttgtggctttatagaaattactggagtgataatagttgagttgtatggaagttaagagcgaagctgtatatgacatttaaatatcatacaccgttctcaggatgtgttgattttaccttattgctaagttgccataggcaacatttaccataaatattaaacaatgtgataagaatcatcataaatacctaaaaattaggtttgcaagttttactattgtagtgatgtattcgaactttattgagtgctagtcattggccagggaaacccatgagccagcagcgtccgtccctgttgaggcagtccagtattttctgagtaagcattgatggggttaaaagctgaagataaatagaaggttgccaggcccaggtggtgatgatggtgttcatggatgtgggatgctgtcttctaggcaacgaattcctgtgggatggagtaagccaagcctgctggaggggccaccagggcccctgaggaacacagagccagaaggagagcacgcaagtaagactcagagatgctggtaggagccagcccacgcaattccaagtaggccatggcaggaatttagctatttatttttaggaatgataggatgctttttgaaaggtttcaatcgatgtgaaatatgatcacttttacatttgaaaagatcattctgacttcagatggcagattggtaggaataagaatgaatgcaggaagaccagcttacgggttattgcagaaatctgagaggagatggctgttcggtcagggaagatgccagaaaaaagacaggtgcagtggcatgtttgggagatgctcagaaggaaaaaacaaatggacctggcaatggatggaacatgggagggacggggaatgtcgtgggccatttgggtttcctctccagcgcaggtgcatggagaccagatttggacatgctgttgtcaaggacctcacaaatcagggggcgattctgaaacaggtgaagctagccttcctgcctggccacttggttttctactctccatctgcatcccagttcctttttcctgttacaattgcctccaggaaggatcattgatacctcactttgggtttcagcagcttatatctctatggagtgttttaattcttcatgataaaaatgctgcttttgtcagaattcaatcagcaatggagaggaataagtctctttaggggtgagattcttcacaggagcctgcaccctttcagggaaaccataagaaagttccatttcagttaacaaatgcaaaataatactgagattgaaagaaaattagaaaacctattagcttttaatatactttaagccagagttataaaatacgaaaattatatctaaaagactgaaaagactttctttaaaaaaagtcaagtgtatctttactgtgtaaaatatgaagaaacttttcaacagttccttactttaggaagtgaatttctttttctatataaaatgattgattttctgtaagtatatttttgaacctctaaatgcttcccttatactcaatgaattaaataaaatataattattttagtttaaatttctcgaatttacttagggaatgtttgcatcaaatggaaaaacaaaataacgcagacattaagatttaataagtatgctatgcatagatccaatttttgtattaattcttttgaatttacgacaacattttattatggggatactttatatcagaaaagttaggatttctcccaggaaaatgaaagttattttatggttcttttaaaattaatcttgaccattttcataaattttaattgtaaaatagtatagaatacctattttaaataatgtttaaggttatgaagatgtccaaaaataactgtataacaattttaagagcattgtaagctggcaagactacacggagaggccagggtacagaggacatatcgcatccacactgtgctcatattgcttgctacagtctcatgaggaaagtctcgagcagcaccccgaataatcgaattatctctcaacctcagttccttctcggtacaacagagaaaataatacctacttgtctaaatagcaaagaataaacgaatagtatatggtaaaataatcctgttcattttttcccataaagtgtttaataggatagtgatagtgcaatgcaaacaacaaaagtttttttccataagtttaattagcggaaacacattgccacaaaatattcacaagatgagcatcgcaaagtcgaaaacctcaaatccaaaatgatccaaaacacccaaactttctgagtgctgacataaagctcaaatcaaacactcattggagcacttaggatttgggatgtgtaactaatacgtataatgcaatgattccaaactccctgcaaaatcaaaatttatgaaataattcttgccccagcatttcagataagtgatattcaacctgtatctgctttatgcttctttatgtaagctaatgtgcattctgaatttctaaaattgagattaagcaacatttttcaagtgtaatttttataaaggattttttaacaatcacttatgggtcatgaaacatactttataaaatgctgtcaaaatgcaatctctgccatatcctgggtgatttgtaaaggttaattttgcttttccttcctgcttagctccatcagttagaatttggtgacggattcgaggctgagttcaaacctgctaccagacagctaccctcagtgctattcctagaatttcttagctcttacaagctaaaggcatcaaattggtctatatttctatcaaagaaaatcactaggttctaactgaaaagaggaaaatgaaaatctagcagatgccttgatatgccaagatataatttgatagcattatctaagaattcacagcatagtaatccatctgaaaatctgcgaggttttttttttttgaaatgagatgaaatacatttttaaaagcacattgattctatcatttaaatgactgaagaaatattatcagttgagaaataaaatacatctttaacaacgtgagaatgaaggcagaaaaacaacagtattaagatacttaaaatgtgtgtgtgttttggggaggtgggggaagggggacagcagtatcccagaacagaaaggaaggatggaaataagaaagaaaggaagcaaggaagaaaggaatagaaggaaggaaaaaggtcagatttaataaatttctatacagcaaagggtcaatttcaaaggtgtttgacagcattaagatggcacgtaagtctccgtgccccacgttcaggttagatttcttttcatttctcgttacgtttcatagctctacatcagagtcacactctttttataaatgaaatgggagtcggacagtgtaaagatgacgtgttcagtttttagtttttcatcatatcttaggctatgcatatttttcaggaagctgataaataataaggtggccttatttttactacagtgaccagctgcctttgactgacccaaaatacagaccactgagctatggctaacaatgccttatgtcatactgactcagcgatgaatcaatcaattccacaaacatttactgaaatgtaaatggccaaggcacccaggaccttaaaaatcataataagaagttaatctgtgggaaaagagtaactacaaaagcatctaaacaagagcaggatgtgatgtaatgtgtccccttatcactttagtcagtaaagataagaaagccctggtgagtatccacttccacaaacacacagaatatacacttttggaagatttccacttaaccacttgattcttcacttttttatgatttaaaactctccgtagtattatattatgaagcaccatcactaaaacgtatttttcaaattaataatcttttttaactctaacaaagtattttttaacctaataatcagcttaagtgagggttgcagtttgacttcaaagtaacaggtaagtacaattattctcatgggattccactgagcttaagacaggaagactccgaaagcaagtaccttgctcaaacactagtccctaataaacaatagagactttggccagacacatggctcacacctgtaatcccagcactttgggaggctgaggcagctggatcatctgaggtcaggagttctagaccaggctggccaacatggtgaaactccgcctctactaaaaatacaaaaaaattagcccagcatggtggtggcgcctgtaatcccagctactccggaggctgaggcaggagaattgcttgaacccaggaggtggacgttgcagtgaatggagatcgtgccactgcactccagactgggcaacaaagtgagactccgtctcaaaataaataaataaataaatcaaatcaaaacaaaacaaaaaatagagatttcaactgatcatgtttttttttctgacctcctgtatttgatactttccctgactgaactggcttaaggcagtattgtttcttgattgtacattcatcgtagagttctttgcaaagtccccctttggagccctcatcttgtatttaagcagttatgaacagtgaaaactctgctgctgcatgtttatacttcactggggttaaatacgcaaataggcccttgcttggaatcaagatctggtctttgtattattgtcaacttatgagcatatgctggctttagtctcttatgactttaagttggataaacttaaaatgttggataaacttaaaatgaaaacaaaagtccaaacttaaatgtgtaaataataacagtttagagttgaattatggaattacagatgatttaattttcagttttctgtttccactctctggttatgttataaaatattaaaaaaaatcttcatatactatttcaccaaatacactgaaccatggcatttggaggctttatgaataaagaaggggttaaaatatataaccatggagtagaaaagtaagagataaaattcctttagaaaggtgagagacgagggttcatattaagttcttggaaactgatattcacttttgttgtgtgtgtaagtcatccataggaacttacataattaccccaatgttgtataaaattataacctctataaccaagcatataataaaattattaataattcatatttatgtaacctatacctgaaggtcagtaaaattgctaaacagcaaagatgctgcgtagcagctccatcagtctttctgttatttcacaaatagtgagtcagttgttatcagtgcagcctggtgcattttccacctgagacacacgtcatctcatgttcacttcgtgaaattctattcatcttacctttctccacttcatgccccttctccaggaaaacgttctagagcctctttgggtaacttgggtttctcatgaccctgggtttcctgatcataaaacaccagccatccctgtaatcacacgctgtggtcataaatgtgcacctcctggctgtgcttcaagagaaactgtggtcagaaatgcagttgacagacagcctccacctgccacccttggggtcctcgactgcatatccacagaggcctcgtgcttgggccacctccacgtggtgactgcaccctccaagctgctccaggaagcagcatatgctgagaaaaccgcgctcatctcaccgcactttctcagttccatgctgcaagaagcagcagcagcaaagctaagaagccatgtttgctcatttcctgccaaagtaatttcacaaagcccctgactatgtgacgatgtgcagttctctagaaagttgttttgaagacaaaacaggatacagcacgtggtctcctacatgtgttgcctgagtcattatatttcttcctgaaagataaatgttcctagtccttgccttttcctacacaaaagatcatgtctgatgggcttagcaattatgcttctgcaatctataaccaaatgtattttagtaacctataactgaatatcctctgacacccaaactttaacatgattttgcatgcatggaaacctctgctacctgtagatacagtgtgagctaaaacactgtgctggagcggtatggcagagcctccctgaaagccttctcccacggtttagtcctcatgtgacagtcctcagcaagacttctgaataaaacaaccttaactctttacaagcaagatttcattttttgttagtcgacaacactgtggtttgagactcttcggttcccatctttccttcctcctattcttcagagtgctgcacctgcactgtagcctgaagacttcctaatgattctgcctgttcctcttctgtccttcacaagagatgttcaccagcaaatctcttggacatcaaatcccacagtggtgtctcttcctcctaggactcaaacaggttcacttatcaaagatccgttttctctattacattttctatggacaaagattaagtcttccactgttctaaatatttcccaagtcttacacagtgctttgtgtgtagtatatattcaacccataccaatccacaggaattacaaatgataacaataaaatgatattattaaatgaaaacatcgaccaggtgcagtggctcacatctgtaattccagtaatttgagaggccaaggcaggtggatcatgaggtcaggagatcaagaccatcctggccaacctggtgaaaccccatctctgctaaaatacaaaaaaacaaacagtcaggcgtggtagtgtgtgcctgtaatcccagctacctgggaggctgaggcaggggaatcgtttgaactcaggagctggaggttgcagtgaatcgagatcatgccactgcactccagcccggtgacagaatgagactccatctcaaaaacaaaacaaaacaaaaaaaattctggccaggcacagtggctcatgcctgtaatctcagcactttggtaggctgatgcaggtgaagcacttgagtccgggagttcaggaccaccctgggcaacatggtgaaaccctgtctctaccaaaacagaaaaattagccagccatggtggcatgcaccagtagccccagctactcaggaggctgaagtgggaggatcccttgagcccaggagattgaggccgcagtgagccatgaatgagctactgcaatccagcctggatgacacagtgagactctgttaaaagaagaaaaaaagagagacagagagaaaagaaagtaaaagaaaaagagaacatcactgaaagcttattattttgcagacactttacctgtgatctctcatttgacttgatgaggcagaggttatgaacatacctgttgactgctgaggggatggagtcccagagaaacacagtgacttgttcaaagccacacagcgcatatgtcatgaagccagaatctcaaccaaagcagttcatccacaaaggccaggcgtttagacactgccagcccctcacaacgcccatccggtaaacgaagagagttaaggaagctttaaaatcacagaaaataaataaatagaaaaggaaggccgtacatattcaatgcagccagcaaagagacgtcaattacatgaagaagatggaaatatgttccctgatagaggagggaagagtgtaggaaaagctgcaggtatcgttaattaagagcagaaaacatacaaggaagcatgagcagtaggaagaaactagaaacagacacttgagccaagtcctggaagaaacgacacaccggtgttccacacgggaaatacacaggcatcattacgcgagcagagagaggacaacctgctggagtggaggactcagcaaggtcagtgggaggcccccaagaaatgggaaatggaagaagtggcacaccagagcccaaaagactgaggcatgaacctagccctcaaattagtaaattattttaattctttaatcagaagaagttgaagttataattcaactcaaactgtagagattgaattcattagaaatcttatcagtcgtaaaacaaacctggagtcagtaagaaaagataactttagttattaaataagtatacatgaaatggaacaaaaatgagcatatcctgactactgaaataatatctttaaaaatttaaatttcagaaatttaggacacatcagaaatgtcagattctatggagatccaactcaagagcaagtcacgccactggtgttcaggcccagaacaccatcagccagaaatcctacactgaccttcagacagatgcatgctggtggctgttagcagagtcaagaatatatatcctaaaaggtatatcatataaataaatacagcagatcatttattatgttagaatatcaggaagaattcaaatgcctccaaaatacccacaaaaaccttagtaagtaacctcctttccttcataataaaaataaatgtatatataaaaaaattaactctactttcttaaacagaagttgtcacaggtaagcaaaatctatcctgtaggtatggtagcactcacatgcaccatgaaaattccggtgttttaaacagtgttttatttgtattaaccaactccaaatttgggagatttctcatatgaatctgggtttctggaatctcctaaaaaataaaaacaatgggccgggcacagtgactcatgcctgtaatctcagcactttcggaggccgaggcaggcggatcacgaggtcaggagattgagaccatcctggctaacacggtgaaaccccgtctctactaaaaatacaaaaaattagccggacatggtggcgggcacctgtagtcccagctacttgggaggctgaagcaggagaatggcgtgaacccaggagatagagctttcagtgagctcagatcgtgccgctgcactccagcctgggtaacagagcgacactctgtctctacaaaataataataacaataataaaataaaattaaaacaatgatcatctcacattcaacaatgccaaggcacaggctctcccgttcagtattcctgtgccggctatacctgccctgccccacgcactgatactcctcaccacacatcctcactccaactgtagtgctttccttataaatgagttgaagacaatgacacatctctttaaaacaattaaaaccttccttccttaaaacataaaacctaaaagtgatgtaaaactttacacattacaaaatttaaaggaaattcctccttctttaatatgcaaattgcaactgtagaaaatgtgacctgttgacatgttaacatgactagaccatcggtgcaagccctgtcctaaatgtttctgtccccaatgtgtggccctgtcctcaatgttcctaagtataagaatatctaggatatctgctgagaagacttggagttgcgaagtaacaaaagaagtgtcactttatttaaaatgtttcttctgtagcacagttccacagaataaattccagcagaagactaaatatattgttttagctgttgaacatctgcagattcccaggaaaatgaggagttacgcccatggagttgcaactcatggaagcccagttagcgaacattcctagcatatcttaagtatgtcataagcatatttaaataaattgatgagataatggtcttccaatatttatattctataaaatgaacacgtataaaaggttcagaagataatggtcaagtcattgttgagctttcaaatatttttcttcacttccttcccctggacatgcacaaggaaaacaagcacaatatccttacagataacagttttataatttttaaatctgctcaaattttaattagcatacaagcagataacattttatatattttattttgtctgtctaggctgctataagaaaaataacatagattggttgaattaaaccacaaatatgtgttgctcactgttctggacagtggaaattcaagatcaaggtgccaggggatctagtgtctggtgaggggcctgatcctggttcagggacacacattcattccatgacatactttatctattataattgtgactcgatgttcgaaacagaagcattccaaattttataagcataaatactgataatcaatacagagaaaagtaagcaaatccaggtaacagttaagttttgtcacataaactaatctgacacttcactgaggaagcagataattctaaagtctatagtacctgagtaagctaacaatgaatgcataccctgataatagtgagggcattttgatggatctgaacatggagcataatgactgtcatcaaaaaagaaatcactagaacaagcacctagaatttaaaatatttagctttttcactcactgtgggatgcgtccagcatttactttgctgcttactattttttctgtgtcttgtttgtttacgtagcttaattcacccatttctctatgatatagttaatagcggcttttctagtgttatgaatttttgtgctcaaaagaatgtgggtgccttggcatggggaacccttggagttactgtaatgatagatgtctgtcatcttcaacaaaatggatttcaaggcctagatttaagataaacactgaagaaaaactttccctgagtgctttctacccaagaatcttctcacttttattagaagtacagcttcttatcactcagcctcagactgatttgactttccaatgatgaaaaacaataacaatagcttttcttatttatgttctatgtaataacttcaagggaaattggattaagaatgcctcattcacaatagtgtgcagaatattgagtgaacaagtgtaactgtaaatttctaaatcagtcttaggcagtgatggctaaccagtctgcctaaaaatggcttgtaacaagccatgtgcagctgtggtatgcccacacttaacctcttcattttacattgcagtggaataattcaatagcaattttttcaagtaaaatatagattttagcccaggcatagtggctcacacctgtaatcccagcacttaaggaggtcaaggtgggcgatcacaaggtcaggtgtttgagacaagcctggccaacatggtgaaaccctgtctctacaaaaaatacaaaaattagctgggtgtgcttacaggcacctgtagtcccagctactcaggaggctgaagcaggagaaccgtttgaaccaaggaggcagaggttgcagtgagctgggattgtgccattgcactccagcctgggtgacagcgcaacactccaccttaaaaaaaatatatacatatatatatatatatatatatatatatatatatatatatatatatatgtatacatatatatattatatacacacagacacgcacacacacacaaatttagtcattccagattttcttcttctgttgaaagaaatattaaattttcctcatagaaataatgtttttgtttcaatgagtgaaaaattatttccatttactatttcctattattctcagtataatctatatttgggtctattgaactattgtttattaattctattttacatataactttagcgaaacctcttataaggtattttgcctatgagatatattaactctgttcttcctcaatgcagttatccagaattgtactttccaggaatatacatcacatgatgtgaagataagaatgcatcttgctatcagcactgaatgatgagattgatccatctacaatagaccatgctagtcaaaatgtatacattcaacaatgtagctatgaaaatttcactaaaacactggtacctggcaccatctagtaagttattgacaaaatacatttagaaaggaaagccattggctcattattaaatgtatgacaagagtccatgaaaatggtttataagaaatttagttggccgggcgtggtggctcatgcctgtaatcccatcactttgggaggccgaggtgggttgatcacgaggtcaagagaacgagaccatcctggctaacaaggtgaaaccccgtctctactaaaaatacaaaaaattagccgggcgtggtggcgggcgcctgcagtcccacctactcgggaggctgaggcaggagagtggcgtgaacccaggaggtggagcttgcagtgagctgagatcgcaccactgcactccagcctgggtgacagagggagactctgactcaaaaaaaaaaaaaaaaaaaaaaaaaagaaagctagttttggtataattttggaatacatatatacaaacagtttcaaatatttgaggtggaatgtgcactttatataacaaaatttattttaatgaataaaatcgtatgtttgtttgcaaattgtttcagcaaagttatctgggccttactgtatgaagatatagctccatcttttctttaaaaaatattgacttggctgaatgttttccagcaatgagaaaaagtcaattcaggaatgaactaaaactttaaaataactctagcaatcgagactttagcagtctctggagaaaacatcactttctccaatgaaatcctgtatgtatttttcaaggtattaactggcgtcctacggagaagtatttgaaaagggggcttccataaatagcttaaatttattaatctgtattttaaaatgtatggctttgaaaataaatcacagcatcacagccctactcagagtattccatgaatgtttacaacattacttttatggtagcatttatttggtttatgtcacagagcatgaacagtggggattgaatataagtgagtgaatgaatggtttcattcactacaattgtaacgattgtgttatttctcagagcttgtaaaacccaataatgtttattaaaagtaagcaaaacaaacaagaacaagtgaaacatgcacttggaagagacctctgttgcaccaggaattagacacaatggtgcagctgtggagaaaacaacaacaaatggcatttttttcctacctcgtctcttttcttggaaggaggaagaaaagagcaattccaatgtactacttcttcccactccaacttagaaatcgcaggtagactgtgaaaacagacctttatttcttcattaagtgtctgaattagtcacaaaattgagcttgaaaaccccacagaaagagtgctctgtgcaattattatgagatgatgctcctcctttctcccaataaaggacgaaggttcttctgcccagatgctgattttcacaatacattatagctgggccaattccaatgttacttactgatatatgctatctacattgcacttatattaaactattgctggtcataaaattatcgtataccagaaaggaaaaaaaaagtgaggcagcatgagctaatgaatatttcttattaattcagactctacataagcatgctgagtaagaatatttagtcttttcattttttaatgagttcacttaatcaatgacctgaaattgcactttctgtccacgtaacagagattcttacagcacaaggactgttatttaactttgagtatcagtgattttcacagggctggatcagagcccattctaaaatgtgcttattgcatgtggactgatactgtaaaatgtgaatgcttggttaatgcaagaataaaaataaaatactcatattcaaaagcacattcacatctaagatgctttgtgtgtctttttaaaaaaatatataagttatgggatacatgtgcagaaagtgccagtttgacacatgggtatacatgtttactgcacccaacaacacatcatttacattagggatttcccctaatgctatgctatccctccccttaccccaccacccgaaaggcccgtctatgatgtgtccctgtgtccctgtgttctcattgttccattcccacttatgactgagaacatgcgttgtttcgttttctgtttctgtgtctttactgagaatggtttccagcttcacccatgtccttgcaaatgacatgaactcattctttttttatggctgcatagtattccatggtgtatatatgccacattttctttatccagtctatcattgatgggcatttgggttgattccaaggtttttctatactaaatggtgctgcaatacacatacgtgtgcatgcatcttcataatagaaagatgtataatcctatgggtatatacccagtaaagggattgctgggtcaaatggtatttctggttctagatcctttaggaattgccacactgtcttccacaatggttgaactaatttacactcccaccaacagtgtaaaagcgctcctaattctccataacctctccagcatctgttatttcctgactttttaatgatggtcattctaactggcatgagatggtatctcatagtggttttgatttgcatttctctaatgactagtgatgatgatcctttttttcatatgtttttggcagcataaatgtcttcttttgagaagtgtctgttcatatccttcacccgctttttgatgggttttttcttgtaaatttgtttaagttccttataaattctggatattagattaactctttgtcagatggatagattgacaaaattttctcccattctgtaggttgcctgttcactgttcactgttcactgtgatgatagttttgtttgtttgtttgtttgctgtgcagaagctctttatttcaattagattccatctgtcaattctggcttttgttgccatttcttttggtgttttagtcatgaagtctttgcccatgcctatgtcctgaatggtattgcctaggttttcttctagggtttttatggttttaggtctaacatttaagtctttaatccatcttgagttaatttttgtataaggtgtaacgaagtgatccagttacagttttctgcatatggctagtcagctttcccaacaccatgtattaaataggaaatcctttccccattgcttgtttttgtcaggtttgtcaaacatcagatggttgtagatgtgtggtgttatttctgaggcctctgttctgttccattggtctctatatctgttttggtaccagtaccatgctgtttcagttactcttgtcttgtaatatagtttgaagtcaggtagtatgacgcctccagctttgttctttttgcttaggattgtcttagctatacgggctcttttttggttccacatgacctttagtttttttctaattctgtgaacaaagtcaatggtagcttgatgggaatagcattgaatctatatattactttgggcagtatggccattttcacaatattgattctttctatccatgagcatggaatttttctttccatttgtttgtgtcctcttttatttccttgagcactgatttgtagttctccttgaagaagtccttcacatcacttgtaagttgtattcctagatattttattctctttgtagcaattgtgagtgggtgttcacttatgatttggctctctgtctattgttggtgtataggaatgcttgtgatttttgcacattgattttgtatcctgagactttgctgaagttccttatcagcttaaggactttttggactgagacaatggggttttctaaatatacaatcacgtcgtctgcaaacagagacaacttgacttcctctcttcctaattgaatactctttctttctttctcttgcctgattgccctggccagaatttccaacactacgttgaatagcagtggtgagagagggcatccttgtcttttgctggttttaaaacgcaatgcttccagcttttgaccattctgtatgacattggctgtgggtttgtcatacacagctcttattattttgacatatgttccgtcaatacctagtttattatttttagcatgaagggatgttgaattttatcgaaggccctgtctgcatctatcgggataatcatgtggcttttgtcactggttctgtttatgtgatggattacgcctattgatttgtgtattttgagctagccttgcatcccagggatgaagctgactggatcatgttggataagcttatgatgtgctgctggatttgatttgccagtattttattgaggattttcacatcgatgttcatcgggcatattaggcctataggcctgaaattttctttttttattgtgtctctgccaggttttggtatttggatgatgctggcctcataaaatgagttaaggaggattccctctttttctactgtttggaatagtttcagaaggaatggtacaagctcctctttgcacctcttgtagaattcggctgtgaatctgtctgtcctgggcttttattgtttggtaggctattaatcactgtgtcaattttggaacttgttattggtctatttcgggattcggcttcttcctggtttagtcttgggagagtatgtgtacccaggaatttgtccatttcttctagattttctagtttatttgtatagaggtatttatagtattctgtggtggtactttgtatttctgtgggattggtggtgatatccctttatcttttttttatcatgtctatttgattcttctctcttcttcttctttattagtctggctagcagtctatcaatttgttaatcatttcagaatatcagctcctggattcactgaggttttgaagggattttcatgtctctatctccttcagttctgctctgatcttagttatttcttgtcttctgctaggtttgaatttgtttgctcttgcttctctagttctttcagttgtgatgttagggcatcgattttggatctttcctgctttctcatgtgagaatttagcactatgattttccctcagaacactgctttagccgtgtcccagagattctggtacattgtgtctttgttctcactggtttcaaagaacttatttatttctgccttaatttcgttatttacccagtggtcatttaggagcaggttatcagtttccatgtagttgatgcagttttgagtgagtttcttaatcctgagttctaatttgattgcactgtggtctgagagactgtttgttatgatttatgttcctttacatttgctgaggagtgttttatttccaattatgtggtccattttagaataagtgctatgtggtgctgagaagaatgtgaactctgttaatttcgggtggacagttctatagatgtactaggtccactgagttcaagtcctgaatatctttgttaattttctgtctctttgatctgtctagtattgacagtgggtgttaaactctcccactattattgtgtgggagtctaagtctctttgtacgtctctaagaacttgctttccgaatctgggggcttctatattgggtgcatatatatttaggattgttaactcttcttgcattgatccctttaccattatgtaatgcccttgtctttttggatctttgttggtttaaagtctgttttatcagagactaggattgcaacccatgcttattttttgctttccatttacttggtaaatattcccccatccctttatttggagcctatgtgtgtcttcgcacatgagtctcctgaatacagcacaccgatgggtcttgactctttattcaattttccagtctgtgtcttttaattggggcatttagcccatttaaatttaaggttaatattgttatgtgtgaattcgaacctgtcatcatggtgctatctggttattttgcacaatagttgatgcagtttcttcatagtgttgttggtctttacattttggtatgtttgagcagtggctggtaccagtttttcctttccatatttagtgcttccttcaggagctcttataaggcaggcctagtggtgacaaaatcccccagaatttgcttttctatggaggattttatttctccttcgcttatgaagcttagtttggctggacatgaaattctgggttgaaaatacttttcttcaagaatgttgaatattggcccccactctcttctggctagtagggtttctgcagagagatccactgttagtctgacgggcttgcctttgtgggtaacccaacctttctctctagctgcccttagcattttttcctgtgtttcaaccttggtgaatgcgatgattatgtgtcttggggttgctcttctcaaggagtatctgagcggtgttctctgtatttcctgaatttgaatgttggcctgtcttgctagagtgaggaagatctcctggataatatcctgaagagtgttttccaacttggttccattctccccgtcactttcaggtccatcaatcaatcatagatttggtattttcacacagtcccatatttcttggaagctctattctttcctttcattcttttttctctaatcttgtcttcatgctttatttcattaagttgatcttcaatcgctgatatcctttcttccgcttgatcaattcggctactgatacttgtgtatgcgtcatgaagtccttgtgccgtgtttttcagctccatcaggtcatttatgttcttctctaaactagttattcaagtgagcagttcctgtaatcttttatcaaggttcttatcttccttgtattgggttagaaaacgctcctttagctcagaggagtttgttattacccaccttctgaagcctacttctgtcaattcatcaaacgcattccctgtcccgttgtgttcccttgctggcaaggagttgtgatcctttggaggagaagaggcattctggtttttggaattttcagcatttttgtgctggtttttcctcatctttgtggatttatctacctttgatcttttatgctgatgacctttggatgggattttcgcatgggcatcctttttgttaatgttgacgctattcctctctgcttgttagttttccttctaacagtcaggcccctcttctgcaggtctgctggagtttgctggaggtccactccagaccctctttcctggggtgtcaccagtggaggctgcagaacagcaaagattgctgcctgtgtcttcctctggaagctttgtcccagaagggcacctgagagatgccatccggagctctcctgtatgagatgtctgttgatccctgctgggaggtgtctcccagtcaggaggtatgggggtcagggtcccacttgagggggcggtctttcccttagcagagcttgagtgctgtggtaggagatctgctgctgtcttcagagccagcaggcagaaagagttaggtctgctgaagctgcacccacagccactccttcccccaggtgctctgtcccagggagacaggaattttatctatgagccgctgactggggctgctgcctttctttcagggatgacctgcctagggaggaggaatctagagaagcagtctggctacagtggctttgccgtgcagtggtgcgttctgcccagttcaaacttcctggcagctatgtttacactgtgagggggaaaccacctactcaagcctcagtaatggcagacatccctctctccaccaagctcaagtctcccagctcgacttcagactgctgtgctggcagccagaattcccagccagtgaatcttagcttgctggactccatgggggtgggacccactgagcaagaccacttggctccctggcttcagccccctttccaggggagtgaacagttctgtctcgttggggttccaggagacgctggggtccaaaaaaaacctcttgcagctagctcggtatctgtctgaacagctgccgagttttttccttgaaacccagggccctggtggtgtaggcatctgagggaatttcctggtttgttggatgcagaaactgtgggaaaagcatgctatctgggctggatagcaccatccctcaacggcgtagtccttcacggcttcccttggctaggagagggggttacccagccccttgcacttccccggtgaggcaatgccccacccttcttctgcttaccctccgtgggctgcacctactttctaaccagtcccagtgaaatgatccatgtacctcagagggaaatgcagaaatcacccgccttctgtgatggtctcactgggagctgcagacgggagctgttcctattcggtcatcttgctgagttccaactgctttgtgtgtctcaatttatgtgtccatgaatacattaatgggagacacttaaagaattctgaatctttgaattagctatacgctctcttccagatatgtggggaaaactgtcttcttttcaaaactaaccatagacacacacctttatcatgaggtgtactgatgaagcacaatgaaagcaacactcatagtttctgcatttgccatccaatatcaaaacaaaactaaaacaacaaaaatctttcatgattcaagtgcttcttcgtccaaaatttaatttaaatagactttctttgtgaaagaataacatacacacatataattttgttttaatatcttttagatcaagaactattcctaatgacctctatgaaattcaggtgaaattcggttttaatattgtgcttcctcagtaaataaaaggagaaagggcccctggaaaaccaggttttttaaaagtatacttgtaatttactataaaatagaatccagccaaaatgcactaacatgtaaggtgcatagttcattctttcattcaataaatatttttgcagtctctatagcactgtggccaagaactgtatcttatcacttgacctcttccaaggttactataattctcctaaaaatacagttactgtctccttttacaattaaaaggtggagatcattctcattattttcatatatgattggtgtccctgtcctttttatgtaataatgtgattctgcaaagtggcaataacaggtcacatttttattaaagttgcgggatgaaaaggaagctggattttagaaatttaagtcctgggttgtagaaccatttccactacatattgtctgtgtaacatccggcaggtcattaatttctctgaacgttatctgaagaaaaggaataatgcaggtatcctccagaggcatcaccagagtgcagaagggagagcacctcttggccatcaaactcactttgagacagaaagttgtgtccactgtgaattcattatgatatggtagacatgtggctcagtgcatttgaactccagttccccttgcctatacaaaggaataaaattgtctaaatacaggcaacattttgaagatttaaaatatgttaataaatttacatgaccaagagaagtattcttgattttcttctctcatactccacaagtgcttatcaacaattgctggtctcatctccggcaataacaagctagtctgaggtcgcaatgtccttagactagatcatctcagtcgccttctaaagacttgcaaacttgctgtcattcattccccgtgttacagctgttgtgatcgttccagtgtaaatcaaacaatcccacagcacatcaccaaatcaaactcgtaaatccacctccaccaccacagcctcagtccaagctgccgtgatctcttgggtggaaaaatacaattatttactgcattatctttcaacatccactcttctctcaccagtgctccacatgccagcataattgaccattcaacctcctctttattgctagcctatccctcttagaataattgcagaaagtatgcaggactgtcgagttatgtgcactaagctgtatcagctctgtaggctacactactccagtccccacctcgtcttctgaattccaggcacccttctagttcctctacaaaagcacaaggcttcctcttgccacagggcattgcctgggttctcctctcattcttttcttttctcctggcttctctcctgctcactcttcaggggagagtcagaggcatttggccaagaccttcccctgtcccattccccagactagattacctcttcttgcaaaatcctcttacagtttttccttaatagtccttcgtttggctggaaggtatatattttttcacatacagtttctaataagtaactctctcctactataccaagatagcaaggactgtctctcaccttttttgttggcagggggtggggtgtggcgttgggttattgtccatccagtatctagcttactctgtatatatatagcatttattaaataaatatttttggatacatgaaaacaatgtaaaataatagccttcagtcataagtagctagaagtctgataatctctttctaaaacttaactaaattttcagaaatatatgttaatatcaatatgtatgctaattcaagtgatattaagatatttaccaaaaataatttaaatattaatacttaaaacaaactattttaatttcatgtacatttccacaaatgctttagtcacatacttcagttatgattaaataatttttccaggaattaatagaatgattatttagatttacttatgtagaaatcctccaagctctcagctaagttttctaattcgatgaacacagtgtgattctatctccatggtgacagatattagatcttgaatttttatttctttaatattgctttgattacgaacaggccaaaaatgattatatgataatttgtatatacacacacatatataacgtgtataatttatgctaatcttctgcaatgtttccttgggttttttttgcactgatttttaatacatttattgaagcgagattttcttttgaatgtatcaaaatcaaatatagaatgtaagaaaggaaaaaaattcacttagcagtctgtgaagctcctcagatgggctgacttcatagctgctctcttgggagactaaaattatttcaataatgatgccccaaaatatttaggagagcttatttcagaattaccttctaaacctgtggcacatttctttccatcctctcaagtcggggaaatgttcttggacactctgctctcaggaacccaacaggctcccagctccaagcgtgctcccctccttcctcttccctatgccaccacagcacccaccttgccatccacagcccatccacaggctccagtgtggcccacggcatccttcctccgggtgtgaaattgcttttccctcaggcaggatccagtatctcttcttcaccaggtaagtcttactcttcacacctcaacacttcagtttctctatgaaagcttcccctgaatgctaagagaggacaaattgctccttcaaagtgcccttgcaccctaacacagtgttttcatgggtatgctgtttgattactttatctgcctgtccttaactgaaagctcattgagaataaaaaagatacctgatttagagctacattccttggccttgcattttccctggcacatagcagacctcaagtgaatatatatttaataactaaatatatagtaaatgtatcaagtcctaggaaacaagccttagtgcaattatgatattggatggccagagaaaaatgacatgggtctggtttctatgtaaattttggactttcggggatcacatatttggtggacccagggctcggctttaggactgtgtactcattaatgtgtgtaaaaagttgactgtgcaagtgcacccgagttagctcagagctgcttctagcaattttaatctatactcaaagtcccccacatcttaccacaggctgataaaagagcattttttgttcttttttgagaggaagtctcgctctgttgcccacgctggagtgcagtggcgtgatctcggctcactgcaagctctgcctcccgggttcacgccattctcctgcctcagcctcccgagtagagtagctgggattacaggcacctgccacgacacccggctcattttttttttttttttttttttttttttaggacagacggggtttcaccgtgttagccaggatgttctcgatctcctgatctcatgattcgcccacctcagcaagggactacatcatattcttcactgtgaattaaataaacataaatccttccacaaatattcagagtattaatttcctgttttattataaaacctatctttggctgggtgcaatgcttcatgcctgtaatctcggcattttgggaggccaaggtgggcggttcacgaggtcaggagttcaagatcagcctggccaacatggtgaaaccccatctctaccaaaaatacaaaaattagctggacatggtggcaggtcctgtaattccagctactcaagaggctgaggcaagataattgcttgaacctgggagggggaggttgcagtgagctgaaatcgtgccactgcactctagcctgggtgacagagatagactccacctcaaaaaaaaaaaaaaaacaaacctatctttacaagcagaaatggcggcattatagaaggcacattttactagatcattattttgaaatcaccatgtgaaaaccaccatgtggaaaaatattaaatcaatacatttaattaaaatgattaacctttttaaacagcatcttttcattaattaaattgaaaattgtacataaatgtttatcacataaaggcacaatgttagacactgcaaaagatatctttctgcaataaactgttccatttatacagtttataaagagtaaggacaataaaacatgcaggaagagcagtaattgcagaatgaaaaagtggcctgtgaggaatatgtacacactaagaatttaaaaagtcaggtgtggttgctctgacggaatcaggaaaataatcctcatgccaacggcgaagtttaaacatacatacatatatatacatatatatatgtatatatataaaaaatcctcttgccaatggtgaagtttaaacatacatacatacatatatatatacacacacgtgtgtgtgtgtgtttgtgtatgtttgacagaattttgctctcatcctccaggctggtgtacaatggcgtgatctcagctcagtgcaacctccgcctcccaggttcaagtaattctcctgcctcccttagcctcttaagtagctgggattacaggcacccgccaccacgcccagctaattttttgtatttttagtagagatggggtctcagcatgttagccaggctggtctcgagatcctcacctcatgatccaccaaccttggcctcccaaagttctgatattacaggtgtgagccatcatgcccggccttaaacctatattttaaggatacttctgaagcaaaatattctggaaactccatgttttttacatggtgaatttccatgtaaatttacatggtgaatttttacaggtgaatttccaattttatttccattattggcttacttgtgttccatgtttctgttaaattctaggattcaattctcagataaacatttcccaagtgtaaaactttacctagttttcctaagtcttataagggtataattaagtctttaactccagatgcatagctcgatttcctgtattttatgtttacatttccaaatccctacttgctttttattttcttaaatactaccatttccatgtgaactgtcacatctttatagtagtaactgtgaccaacctacatgagtgtgtttctctgcttttgtttctatatttaaagagggtgggaggactaaatattttgtctttaaaatgtattaaacacctatgtggccctgactgtaccaggcactgctttcaactgttatgtaaacttcatggaatctagcctgagcttgccccctgctgcccttccccttgtgggtactgccttaacacgccctctgctctcggctgtggtcatcacccagccaggtgtctccatgctcattaatttatttccaggaaggtacatgaaagacatgagccctgtatcatatatctttttaacattttcatcgcagtgttgaccatcttcctttgttgtgtatcgtgtaacacaaataatgatattaaaagcataaaaaaaactattgcatccactttacaggtgagaaaattgaggcatagcgaagttatggaaatttcctaatatcatgaggttctggctcgggccgtcgggttcccagcttgagttgttccccatgtcgggcgtctcatgaggctcctcctttctcctcttccatctcacccataactgctctctcccctccttcttcttcgtggcatcacataagacattctcttctaccctggctgagcaaaatgcaccgcgtcttccaaggtaaatgcgacaacaccaggaagcccttcctgattaaatcaccccaaatcaatctctctccctttgaggttctcctaacattttatttccttatgatagtgttaattatatcctatcttaaaaagttgtatcttgtacatactgcccgcttcatactggattgtaaattcacggaatgcaaataatttattgcatttttccctgctattgtgtttgacatcatcggaagttcaatgcacatttttacatcacttttaggtgaaaagatagacaacgattgtccacctcagtccttattccagtgcctcacatgtaacagacatgtggtcatggctaggtaaatcaatccatggagcaaagactgcatatgaaactagtttacatgactacattttaaggtaaacattcaaataatattaactgaaaatgaacggtagaaagaatctttagtcaaggataccatctatgaacacaaatttctattttagaatttagttgacttgttgataaaactaatttggcaatgaaaagaatgtttcatataaaattaataataattgggcatttcaaaatgtttatttcatgaagaaaaaagaacaagacacatgcagaggaagtaatgaattattttaagttgaatatatactactttaattaaatcttactacctctcgatatactgtacatttttaacttatatgtttaagatatgactccaatttttatctttttgagcttggcagatctagcaagcagttgttttctattttgaaaactgtttttgaatatgagataatcttatgtagaaaaagggtttgagaagcatgcattattttaaatacataacagattcattttagccagcattgtaaaaaatactcaatatatcattaagacacattttagaagagactatatttaggaattgattcctcagtgttaaaagaaagttagtggaaaggggagttcatttgaatctgtctatgctcccagttggggtcacataagcaggtcggttttaacagcttccagagaattcccagagggccctcacctcagaccaacaagaccatcttggcagacaattgcctattggctattgctaggctctgagcaaatgagtcaggaagcctgggagggcacaaagcactgacccaaatctctggactcttctacctcctccagatctgctgtgaattgtcccctacatccaccatcaacttgagtctcacagtacagtcaggtcaaagaaagagttggggctaaggaagcatttgatggaagacaaacgacgatggctaaaatctcagtagcctacgatgatgaaatgaaacagcatcgcagagagagaagcagtcatgggacactgcgttccgagcctcttttttttttttggtttgttttgtttttattatctgaactgatgagctttgtgagtagcacatgaggaataatccttccctggcatgtctgtagtgaaaattgacagacatgaggtttgtcatatatctgacacccactaagcacttagaattactgtcaataataataaagggctgacctaaaaaatggtcccggacatgatcttccggctaagataaaacagcttgttatcagaccaagtctcctgcagagccaaattagaaaagcgggataaaatatattacaagataaacataattgttttgaggacaaaggagagattatcagggctgcaacaacttgaggagccagaataacggagagaaagaaaacacagagtggtgagcccaatacagatccactctttcctccaggcaccaggcaggaaatggagaaactaagtcctgtagtctcacaggagtgagagatcaggaaggaagacagtctctagcaagctccaaagcccacagctgaaggtcactgaagggctacacattagcaaggatgcacctggaaatgcaccagccctcatagtgagaggtgacagcaggctggcagtcctcccagccctcgctcgctctcggcgcctcctctgcctgggctcccactttggtggcacttgaggagccctttggcccaccgctgcactgtgggagcccttttctgagttggccaaggccggagcccactccctcagcttgcggggaggtgtggagggagaggcgcgagtgggaaccagggctgtgcgaggcacttgcgggccagctggagttccgggtgggcgtgggcttggctggccccacactcggagcagctggccggccctgccggccctgagcaatgagggacatagcacccgggccagtggctgcggacggtgtactgaatcccccagcagtgccagcccaccggcgctgtgctcgacttctcacccggcgttagctgccttcccgcggggcagggctcaggacctgcagcccgccgtgcctgagcctcccacccactccatgggctcctgtgcggcccaagcctccccaacgagcaccatcctctgctccacggcacccagtcccatccaccacccaagggctgaggaatgcgggcacacggcacagggactggcaggcagctccacctgcagccgtggtgcgggacccaccgagtgaagccagctgcgctcctgagtctggtggggccttggagaacctttatgtgtcttcctcagggattgtaaatacaccaatcggcattctgtatctagctcaaggtttgtaaacacaccaatcagcaccctgtgtctagctcagggtttgtgagtgcaccaatcgacactctgtatctagctgctctgatggggccttggagaacctttatgtctagctcagggattgtaaatacaccaatcgacactctgtatcttgctcaaggtttgtaaacacaccaatcagcaccctgtatttacctcaaggtttgtgagtgcaccaatggacactgtatctagctgctctggtggggccttggagaacctttgtgtccacactctgtatctaactaatctgatggggtcgtggagaacctttgtatctagctcaggcattgtaaacacaccagtcagcaccctgtcaaaacagaccactgggctctatcaatcagcaggatgtgggtggggccagataagagaataaaagcaggctgccccagccagcagtggcaacccactcgtgtccccttccacactgtggaagctttgttctttcactctttgcaataaatcttgctgctgctcactctttgggtccacactgcttttatgagctgtaacactcaccgccaaagtctgcagcttcactcctgaagccaacgagaccacaagcccaccgggaggggaggaacgaacaactccagatgcgccgccttaagagctataacactcactacgaaggtctgcagtttcactcctgagccagcaagaccacgaacccactagaaggaagaaactctgaacacatccgaacgtcagaaggaacaaactccagacgcgccaccttaagaactgtaacactcactgcgacggtccgtggcatcattcttgaagctagtgagaccaagaacccaccaattccggacacattttggcgaccacgaagggactttcacctatcgccaagcagtgagacaatcgccgagtggtgagaccgtcgcctatcgccgagtagtgagacaatcgccaatcgccaagcagtgagtagcatcagacccctttcgcttgctattctgtcctatttttcattagaattcgggggctaaataccgggcacctgtcggccagttaaaagcgactagcgtggccgccggactaaagaaacgggtgtcaggctttctgggaaagggctctctaacaacccccaactcttcggagttgggaccgttggtttgcctagaaccagcttccgcttttcctgtacttctgggctgagccgagggtctacagagaggaaagccatgcagctccggggtcccaacaacatgttggttgaccctgtggccatgaccggaactctcaaaagcatgtcgcccaagccagacttgcccatctatcctatctatcctgacccttgccctctgggtcctaatgccggccagacaaacttcctctcacctctcctctctgaggttaggcccgcttctaaaaattgctacctgtctctggtgcttttctagtttctcctataagaaaaccagcttttatttagattggatcaactgtggattgcattggattggattaagcagctcaaatttagactggattaaggagatcagccccagtctaactgcctgccagaaacaaaataaatggtctctggggaaatcaaacctcaaccagactctcaaattatttgtacaatttttcatacaaaagattctatattttaaaaaaattacccagcataccaggagaaaagaccaagtgatcaaaaactgagaaaaaaaaaaaaagtacaatagaaagagactaacaggaagtgtagatattaaagttagcagaagttgcctttaaaataactgtgattaatatgttcaaagaaataaagagcaccataaagaacatcagcagagaactgccatctacaaagactggagtcacatggaaattctgcagttgaaataggcagtcccagaaattaaaaattaagctaattaatagcagattaggcaaagttgaaaagaggattagagaactagaaaaaaggttaatacacaatttttgaaagagggataacgaaactaatagtaaatgaagaatgactgtcacaaaacgtggaatatgggcaaaataataaataacatttcctcataaggagaaaaaagaaacaatggaatgaaagaagtatttgaagagataatgacagataatttactgtaactgattagagactttgagcagaagtgaaaaggtagaattcagatgaaagaaaccaaattacaaagagaaaaattttaatcatagaaaaaggactggcaaagaagcaacaataaaagttacagaagattttgcaatggaaaaaaattaaagccagaggtaatgaatgctgtctttaaagtgctataataaaatgatgaccaacatagagctctatacaaagtgaaactatcctatagaaattgaagacattttaagttaaattaaatctgagtaaatactctttagtccttttcaggtcgaataaaaattatattagatgaaagcatgcaggtaaagatggaataaacagcaatacaaaatgtaagctgatgggaaaattatatgtaacaataaaattattgatttgtgggatttaatatattagcaaaataatttgaaaattaattcaaacttttaatgactattttcatcattacctttttcattattatgcgcatgtaatggttgtacgtatacatggagtacacatgatattttcacacaagcatacaacgtgtaatgatgagatcagggtaattggctatccatctcctcaagcatttgccatttctttgtgtttaaaaacatgccaattccactcttttggttatttttaaatacataataaattattgttaactatggtgaccctattacacttccaagtactagttcttattcattctgactgtattttagtacccatcagccattcccaatttttccccaggcaattcccattggcagtgactaattgcttgtgtagagatagatttctctcacagagtgttgattttaaaggttacataaactgttaaagtcacagaccaaacctgttacagacttaacctgttaagctcatgtttcaaattcataactgtgatatttactggtttaatgataaaaatcacacctagttccttctggatgagccacagcttggcaattttccaggaaaaatcaatgtttttatggacgtaacctttttagcattttttttgatgctttattttctctaggacttttggataaacactgttccctctcagtaatttatatcataaaaacacagcactaaaatccctttttgttttattcacatgtatatgaaataccgccacaccatattccttaaagcatcatgcctgtgagagagatcctccatgaatagctgtgcggttccccatggcactttctgtgctcctccaggatgatactgggctgcagctgttctgcacacaggtctgcacgcacagtaggatcatggcaggtgttcaactttttctatccagtatctggcatagtatttgataagagtgcttaactttgtttgatgaataaataaatgagaacttgcatgcatgaatctgtactgtgtaagagaggttacatctatataagagcgcctaaaaagttataatagagatacccattaaaaataagtttagttaattttgaatgaatgctttcatctcttttaatccatgaaacattgcttttactattatatatgacaatatcctacagaggccaatagattaggtgcgctctcttcttccacattgatttttctgcccatcgtgagccaaccagcttttatggcttacttgaagggtatgtaattccttcagtaaaaaatgagttttctccacttgtctgttgttttacactgaaatgagtactgggaactgatgcatagtttgaagagcttaatgttcttttactcactttctctgcaaaaataattacacaactgtaaaactgtgagcttttcaaagcatcaagttcttgatatatatgtatatgtacatacatgtatatgtggatatatatgtatatgtacatgtatatgtggatatatatgtatatgtacatatatatgtatatgtagatacatatgtatatgtacatatatgtatatatatatgcacacatgaatttctccttgtccaagtgtctaacacctaaggaaatttattttgatacagaacctttcctagatgtgtaaaagaagaaataagctttacttacaaataattgtactcagactcatgatcacgatctcatttactgaagagaactatgtcttatgaactatgccttcactaggtactggttaagagattttctccacttatgacactcttcataaagtaaacattaagactttgcatttatagtagatgctaacacaagcacttttcacattatgaacttgtgggtaccattttgttaaaacattttgcctttccacaactctgtaactataaaaaattatgaaatttattgaaatgtaaaaactgttgtccctttaaaaactgaagtgtgaatacttttaaactcacttccagtgatagaaggagattgtgtgtagactttaaagtatacccagcaacatcaactagctactttcctgaatcgtgaatgcagcaccatttaagcaagcataggaaaaagaaaactaacaaaaggagcaaggtaaagcaaaatctaatacatgttcagtattctaaaatgcctctggcttccctctagctagagtggataataatttttcaaagacgggcttattttaaatggctagtaaaatgatatcaaacattttcttaggcatatatttaaatagagaagaaatatattgctggtgttgattacaactcaatggccgtcagaagacagtaacttttaggattccattaaatgctgatactagccaaaaagaaaaaggaaataaaacatcagaccacagtttcaaatacagtatagagagcacacactggctatgctatctagagacagagataaagaactatctcataaagacagagataaagaactatctcttcctctagatagtacagccagtctgtcctctctgcactgtatttgaaacagtggtctgatgttttctttcctgtttaagaaactctactctggccgggcatggtggcacatgcctgtaatcccagccctttcggaggccgagtctggcggatcagcagatcgagaccatcctggttaacacggtgaaaccccatccctactaaaaacacaaaaattagccgggcgtggtggcgggcgcctttagtcccagctactcaagaggctgaggcacaagaatcgcttgaacccgggaggcagaggttgcagtaagccgagattgcaccactgcactccagcctggcgacagagcaagactccgacacacacacacacacacacacacacaaaagaaactctactctgtgcttgattctgttcacaggctgctgctcaagcttccactgacgcgaatgtgatgtggcattaaaaacactccagggtgccctttcacttggaaaaaatatacatacacatatacattgcctttaagtatagtagagccaagtacaatatactatatataatatacattatataaacacgttatgtatacattatacaacgtgtactacatgcacattatataatgtgtaatagtgtaaaaatagaaaaataaaaaatatgttgtccttagactatctttaatttgtaaatgtttcaaaaagagaaactagaattttcattgctctcaatgagaaaagaaagaaaagtgcaaaaaagggaattggatagagccttatcagagttatgtaaaagaactacatttttctatattggaaaataaatctaatttttatttctaaatttgtgttttgcctctgcatatattatgccaataagaatgatgcctcagtgatctttagccatgttttttctgcctaattcaaagtattaaccataatatctcactcttctcagggactctgaaccaaaaaccaatgatagtaaggaatagactatttcttttttaccaatactaagaattaaagggttaagttaagtaagacaaactctctgctgatcagtgcctgcgagacaacagtgaaaaacaaatcagcactcattccccaggttaggaagtgcataatatgttaatgtcgactctataatatgggacttgcttgcattattaattgctaactcattactcaaaaagtgttcattctacaatactattaggcaagtgtgtttgcactgtgaagaccaagcaaaaataacctccgcaattgttgaatggtacaattagaaacacatgatttctaaattgccattatcacggccaaaaaaatgataaaaataattagttgccaacttgggaaaaaatatatatctttgccatgtcaaagagtatcaagaatactttggcagtttctggaatgcagcgtattaataattttcagaatctatcaggagcctgatgccactgagacctgccttctgacaccatagaatatgtggcttttgtctaacccacacactggacctggaagttcctaggttactaggctaagcaagtgcttaagatactgtctgttctaaaagtcaaaatggctccaaatgcttgtctatgctttttaacaatattacatttatttattttgtggtggtaacatgtatttatgaaatcttcaaagttatataggtttatttagaataacatgcaattttatttggtaaagcaagtgaattttgctcagaattctttatgctgttttttttttcttttagatgagaccaggataactcatctgtggtatgtgttacaagagtagtgtctagcgtcatacttgaaagtggagagatggtgaccatggggacagaaaagttctgggaagcagacatggactactggatttccatgaaaacaaaagtcacatccagaatacattaaattctaaaacatacatgctcaatcaacatgcgaagatactgaaaggactttgggcttattaattttatgttattcatccctagctgttcaaaagtactcattaagattgttctggtatgtagaatgtaaataaaatttatagctttatttcatatatttgaagcgctagcataatacctggaattatgacacctctccctatatgcttttaaaaataaaaatataaattagaaatatactatttaaaataaaaatgtatactgttaatatatgttgttcaaagttgttgacttttacaacattataaagctatattcacgatgaaatcttaagaaaatgagaagcactgaatagatagattttttgttgtttgttgcttttatgcttttggttttcttttgcttatctgaggacactagtaactaagattttggaaatttttttcctaaaataatttttaaacatttcttaataaaaggatatgggacataatttgagcttctcataatgactaatctttacttggcagaactcatcgtacacatttctgtgatacaacaatgctctcaggccttctgagctctgctgagttggtgattaaaacacacctggttgctgtcttattttagtcttcatatctcacctgtggcctgccttcttccctgctgtcaatcaattgcatgtttctctgaagcctgtgttcttgtctccaacagaaattcccaggatctgctattctctaaggttgtaagctatgccatcaaaagtattgagttctgaatgcatcatttcttcagttgtgtgttgagtgcttactgtttacaacatattattaggtattggctgagtaaagatgaagatgaaataagcaatgatctctaatatgaagaactcacaaacaccaggaggaagagccaaatgtgaagtacgaagtcgaacaaagacccagaggaagaagtgagtaattctttctggtctaggtcagacaaaattcacagacaaactagttgggccaccttggatatatgaatacaactattccaggtggagaagggatgaaagaaaagcattccaaacagaaatgagcaaagctgttgagcaaaagcaaatgagcagagctatcgagctgtaaacctgcatggtaggtccagggaagtcactgtggtatagcgtgattacagagtgaaggacacagagaggactgtagtgcaggcttctctcttgggagcagatgcaagcagctttccaagggtagtgatggcggaactgggccttcaactgtcagcaggagagggcataagtatgtaggtcagtgtcagattggaacaggcctgaattttaatataaatatgcaatgaaaattgcagagaaggttttaaagcagtgaagtgaggggataggatctgttttggaaatacttagcgtattgaggggaatgtactcagcaatgaggcagtggctacagaaagaccgtctagggggcctctggaacaaggcagaggggagaaagtaatgaccaagggaccggtggggaggctgaaagttgggcagacattctgagggacttcaggagatcggaggaaaggcagctgctagtgcaaacgcctagatagatggagatattggcaaaggcaaaacaggctgcaggtcatgcaatgcggccaggatgggaccagtgaatttcttatggaccattgcatctgaggtaccggagggacgtctaacagtagggacatgctggtagatgtttaacgagcggctttgctggcataacggattcctgatttataacatttgccaatttctgtggcataaataatactctcagggtagatttcatgctcccaacaagaatcttcctttaattgtgcctcttattatcttatctagttgcagtaactaaagtgtccaggagggtattacagaatagtgaaagtggtatatttacagtggtaattggaatgcttttaaattattccattaaattgtcacaaatattttaaaaaatatactcttccgtattcattttccttgttatcgctttgttgtttttgaggtggagtcttactccatctcccaggctggagtgcagtggcatgaccttgactcactgcaacctccacctgccaggtttaagcgattctcctgcctcagcttcctgagtagctagaactacaggggccggccaccacgcccagctaatttttgtatttttagtagagacagagtttcaccatgttggccaggctggtctcaaactcctgatcccaagtgatccgcctgtcttggcctcccaaagtgctaggattaccagcgtgagccactgtacccggcctcttttccttatttttgatgacatttataaagctcaatccaaaatgtgtgctaaatttttatctacgaattttaatatttatacttagttaaaatattgttttctaaaatctaccaatacacgaaatatcctgttgtttaatcattgtaatactattgaaatgaatttccatatttattgattttttcatttgctcccaaattctatgttaatatttatttagaagtttcgaatcagcatttatttatatgtgaggtttgctgtagttttctttctatatgtgttttctcaggctttcctgtgaaattcataaaactatttagaaaatttcttattggtctacatgctggaggggtttgtaaatcactggtgtcatctcatcctgcgatatcttgcataatgcatccgggccatttcttggtctcattcctttcttagggtgaatggaggatgctgaggtctcagcattgagaggaccaggcagtcactgaagtgcatacaaatgggccctacagaatctgccttttgctgctgctgaaaagcaaggttaatggaatttccgcaggaacatgagcgttaatatgatttccccatttgttccctctcctctttacgcatacatagcaaattaattaaatacttctgcagcatggctaaatccttgttattgtcatgataaaaaattaagcataataattttagtgctaattatgtatttttggcataatgtttcattccaactgaaatacccttaagcacaggagaatggccatttagtgaaagtgaaacataaaagagaacgcttttagagtcttggattatttttcaattataaatagcccataaagtgactatttgtagcacttaatatttatatataatcacacttcataatgaaagtagaaaataacaaatgacagaaatatttttatgatttttgtgatccggagtcttaaagctctgaaaagaccttagtttaaaattattagttactacttccatgtaataagcaccaattgtataccagatctcttaatttttccaacaattcctagctatatgcaacatcatttccattttgcaaaaaaggttagcatgcttaataaagttaaagaactttatcaaaaagcttctagagaatggagcagtttgctaagattgcctgtaacaaaataccacaaacagaccagcttaaagcaacaggaatttattgtctcacagttttgagggccaggagtctgaaatcaaaatgtcaggaggatcacgttccctccaaaccctgcctgtggaggacccttcttgtctctccacaccttctggaggttgttgggaatctctggtgctccttggctggaagaatcatcagtctcctccatctttacatggcctcttcctcatgtgcctctctgtctatgtgtcaagtttcccctttttataaggacactggtcatgttgaattaggacccactccaattacctcattttaacttgattaattctaaagtgatcttttttttttttttttttttttctctgagacggggtcttgctctgttacccaggctggagtgcagtggcgtgatctcagctcactgcaacctctgactcctgggttaaagcgattctcctgtcttagcctcttgagtagctgggaatacaggcgccagcatgcctggctaatttttgtattattagtagagacaggatttcaccatgttggccaggctggtctcaaactcctgaactcaagtaatccacgcatctcagcctcccaaagtgctgggcttaaaagtgtgagccaccacacccaccctgaaatgatctgtttctaaataaggtcacattctgagttattgggatttaggaatttgatgtgtgcgtttttttggaggggggcacaacttaacccataacaggaaacaagaagcaaatatgtatttgaacctggtctttcaacttcaaaacctacattttactctgctgcccatgtgttgcctttgtaatcaaaactaaaacctttccatttaacatttgaaattgttacctgcctgttcacatggctatctttcctccccaggctctaagctattttagggcagacatatcatcatatttctgatgttacccccaccttaatagataagtgtctaggacacaattccttagtaaatcttcatcatgctgaagagaaatgactctgtaaaaggaatgtggatggttatagtggtttaaatattgagactacatattataattcagtagttgaatgtttttcatacttgatgccaaagaaatgagataaaactaataaattttgggatctggaatatactggattccttgttgtatgtcactaacaaaccttagaggtgtaaacataggtgtgcctttttttataactttaatagggatggaattttaaaagcttggggaatttggaattctgagcatcctcatttagtttttcacagtgaaagagtgttactaattaattgcagaaacatcctaaaatgtagacacgtaggaacagaactcaaattggcttgagttggctataactctgtaattctgagacaggaaggtataatatgataaataaaaaggaaagagtagataaagggtgatttctaaggcaaaggataatcatgtcgattcaacaatttatctgtttattcatttgtctattgatgcattcattttcattccatccatccaaataatgctatacattgtcaatatgctaacaacaatggaaaggcctggtaagactgttctggttctgtggcttcctttggagtcctctcaaatggtggcaattgtttttgcttcatgctaatgtctactgtagactagctctggtggcacagaaaccatacattctcagtgttgcttcctaaacaatgtccctttccttacttaagtataaccagtgaagctgggtactgcgatgcatgtctgtagtcccagctactggggaggctgaggctggaggatcccttgaactcaggagttggaggccagcctaggcaacataggtagactttgtttctaaaaaacaaagcaaaacaaatgccattcttatctcatttctccatcacagaacatttcagcacctttttctctctttcagagctcctgttttccttcctggacactgacacgtctacatggatcttccattccttctttgcatggaatgatcttgcatgcagccatccactcttaaggcctgactgtaaatcttgctcttactaaactatatgaactgtaccacttgtacagcctcaaatccagagatcccacatctccccataaccagatccaccacttgaacactccctgtttgccacactgcccacagcatggcccaaccttgctcctttctctcaagggccaacttccctgtgtgttactgcaattgtaataatgaatgtagttccagtatctaaaaaacttgcttcaggaatacataagtctggaataatatatacccactgacatcaagtaagtttggttttggtaggagaacttgataggttaaaaaaaatcataggacagtatattaactattgttaagtaaaagcgggaagcacaagggagagatgcttaacccaagcttcaagattagatttagagaaggttcaaaaacgaaacctcctctctaagggtctcagggagactttctggaaaaatgatttctagactgaatcgtcaaagacaattttctattcatttctaaacaaatatagcaattttgatcattatgcaaataattttcatcatagacataatacttaaaattttatgtataacacacaagactctgttccttaacagtattttctcaccaagctataagcttttctaaaaaaaaaataattaataattaaatctctgaagtgcatatattcttcctaaatcaatgcaacattgtctttgttaactttgttgttgttatttccttttaatagtacgtttgctgtttgaacactcggtctaacttcagttcattcaaaaacagttcattttgaaaggaacaataaggaacaaacgaaatacacacatgatatggattggctgtatccccaccaaatctcaacttgaattctatctaccagaatacccacatattgtgggagggacccagggggaggtaattgaatcatgggggctgatctttcccatgctattcttctgatagcgaataagtctcacaagatctgatgggtttatcaggggtttccgcttttgtttcttcctcattttctcttgccacctccatgttagaagtgcctctttcctcccgccatgattctgaggcctcccagccatgtagaactgtaagatcaattcaacctatttttcttccctgccttgggtatgtctttttcagcagcatgaaaacagactaatacaacacacaatttttttttttctagcatttgcagctaacaaaagcagtttcctctcctcagtcaaaactttgaaataataaacttgtgatgctgattgaatgaaataataaagtgtgtaatttctaataacaatagtggtgatatattatcccatgcctttgatttctaatttgagaaatagatatcaatgtattaacttataagatccttaaaataaccctttcaaataagcaggagagatggcactctcatttcacagacctaaagtagtgtgaggtatgttgacctgaccaaggttaaatatccatccccaaatgtaaattcacccctggtcctcttgtaaacgaatgctttgaattgagtttcatctaaattttattacttgtatttttaaaaatatacttgaccagttactctatatctttctattttgcccatttgaaataaaacttatttcccaaaacaatgcaacaaaaaaagaaataaaacacagaaatgaaaatggaatatttaagaccaaaattatgtacttgagacatctgtagcatactataacacaatcagaaaaaaaatgttaaaggatattattaactcctttggaccatcatgttatatcacatgaaaaactgtagtttagcttttcttctacttcagtttaaaaagtaatgggatgactttcataggccagtcactgtgcttgccacaagagctagaaagatgagcctgcttgtcccccaaactcacagaagcttctgatgcagtgagagagacacagattaattaggtaagatttggagaatatggtgggtactaaaattatggctgctcttataataaacatcattgtcatctctaattattttaaaatatatgtgatttatttttatataaattatatataaaatagatataaggttctttagaacatttatcaatattcacaattgcatgtctttaattagatgcaaaaatcacagaaaataaaaagctagaataaatgcttcctcaaacttcccctgtatctctttacaaatcccactccaataaaaagtcaagttagataaataaagcttttgtaaaacggaattatcatagttgtagggatgaatatttacatgcctgagagctctccaatctaatttatgccacactcaccttgctcaaacacaatgatgatttggatttgctatttgaattacgaatactatgctgaattcctagcagtctaaacagctgaaaatggtgttggaggttaggggctggtgcctagatattagctctaacaggtggatgcagctctgtcatataaggtcatggaaatcactgctatcagccaggcatgaaatctgagttattttattagtgatggtggctgatggatgaccacagaataccaaactccagctacaggtgtggctgcttagttacaatgtatctgccaaaagatgcaaggaaaactccacattggttcaagattataaaaaatccactttagatacatttgtttctatattaaatcaactcaataaaaattaactatgctaggaatctagacacctaatttcctctgaaatatttacactcgttgacaataagcattaattagtgccagtgtgggtactggtactcagtttatgtttattgaagcaaaataaagctctaagtaggtggaaaatttttttcaatcacagaaataggttgagtattaaatagaacaaattgtattgtccaagcttatgaaaataaggaagaactacttttacttttgtagaagaaaaaaagaatgacttttttcctagagtcagtgaagatcttcaaaaaaacaataatttcagttgtttctaaatcaaatgttaaaccaattgttagtcttccaagaaagttacgtgtaccagaaaaattataaaatggtttaaaaatgtattaaactctttacttatttctaaagaatccacgtaacatgaactaactctacacaaagacaatgttaggattaagtaaaaagtgttagaacgtgccttccagactaaggtattaaaaaatccaacgtactgtatctgtagggagaacttaaaacttaaaacaataagaatgacaacaaaaagcacaatgattcagataggacaaaatgagattaaataattctaccccatgtgtccaagcaaggagataaactgtatactgtggtggatcatgtggcttcattactgtgtagtcaactagacagacttaaccccagaatagcatggtcaccctggaagaattttttttttttccttaaagatctgttgagaatgcaaggaggaaaatttttgataatcctaaattggagtaaattgtacctaattaagagaagacagagtggaagctcaaatttgagtggaacttctaaattatataaaccatcagtttttttttttacactaagtgcacaatatataaaattacaaaaaaaaatctcattgataagttacgtcaacgaatataaatgtatactgtactttaccacacttctgtccatctcatttaattattttagacatttggttatttgtaggaatgacatgcaaactatttcaccatcagcatggcccaggtgatagccagtcatagcaaccactaaccagctttctttaattccaaacaatggtaacaataattctcacagttcacacagtggatactgtaagccaagtatatttcctagtgtttatcacaataatgctcctacatatgcaaatgatctccaacttagagacaattaaagttacattcaaagagttttttgtaaactgctcaaagtagcataattcataagctgaacccaggtatgcatggatctgacacgcatatgctctgtccatccacctccatggaggtgttcactgtgataactagaaatgaaagtctagggttggttaccgcagaacagatcagtaggtacccaccaatggcttgtccttcccttttatactgtggagttaggactagagggtggcagtctaggtcgggctgacgttctcagcacttattgcctagctggggccatgtagctgagctgtggtcgcagaacaggagtgcaaatgtcaaatacatttccatatctggccatggaccctcctcacgtgatactctactctctctctctcccactctgacactggatttgacttccaggttgaccttaggtactctatgtagcaaatatagagatgggtagaaatggaaagttagtcatagctatagacttaataaacggtgaagtttaaagatatagctattaagaccaatatgaaagcatagctacagatggatatgttccttatttcagaaataaattcaagtgatcatcaatgccttttcttgaagtctgtttacagatataataggctaaataaatatatacatctgtttttgtatgaaaattataaatgaacacagttgattataactatttcctgatgtgctctccatcctaaagaaaacatttattcaaattcaacatcaaaccttatttgtgaaattaaatatcacagattaccaccaatgtttagataagaaattgacaaaattatttcacaaaaataggggaatggcattcttttctactcacagaaagacagagggtgtaaactcatctgctctttatgggaactaaggcgtgaggataaattgttagtaacttcagacgtaagaaatcaatctctcaatcttgacaaacttacatatctaaagaagatattctgactttaaaaggtttgcttatcgccacatttatacagactgttgaggaagctaagaaaaatattaaagtaatgtaaaaatgccttccaaaaaatttccctcttaattagatttttttttttttttttgagatgaagttttgctctcgtcacccaggctggagtgcaacggtgccatctcggctcactgcaacctccgtctcccaggttcaagcgattctcctgcctcagcctcccaagtagctgggattacaggcatgcgccaccacgcctgctaattttgtatttttagtagtgatagggtttctccatgttggtcaggctggtctcgaactcctaacctcagatgatcccccacactttggccgcccaaagtgccgggattacaggcgtgagccaccgcacctggccagattttttttaaaaagcatgagaataagacagggagtagagtgacagcgaagcaaaagtttggaagtccccttggagacagaggtggagctgtaccagggcctctctgaagtgtctgttatcatggcatttgcataacttgcattaggatagttcttcacagcctcagacccacttctacagggatcatctcatctgttcctgaatgttaagttggtaggacaggtgtgatattacagaatagacaaggagggacagagatcataaaggaacttctatggtcatacagatgataaaaggtagtattaagaattgaatactttagtagtaagagttcagtactttcctgccagccttcaacatttacagattacaaagtatggcggatgtctcatttttgcaattatttctccatacccctcatcatgcaatgaggggatcgtgatctccactcacggcattatgacttacagtgcttccctgtagctggagaaaaatatatttgccccattaactttgaccaaatgaaaagtgagtaaacttgatttatccatgtctgagcatgtctgaggttagcgtgcatctttcaccctgggttctgagtcagaagcactgtggagcagggcacagcctggaaccgtctacatagagtgtgaacaagaaggaattccttgtgaagcttatacacaggtgctggaggaacctcctcagagccagcaactgtactctctgaaagcttttatctttaccttccaaatgacatttgctagcaggcattccccaagaagaatgaatatagaaatagataaaggatgtattagcaaagttaccaattgcctttattgagataagagcctcaggaaaatctttctgctcccccagttccctaaggtgaactggcttaatgtaaaaaattaattcccttatttcatgtcttgaggcattgcctttccaccctatgtcattgaaaattgatgttgttgggagttattttagaagagaaaatctcttactaaaaaagaggaagaaaggggccctgcacaaataaggcacttcagaggtccgaagccaaaccaaatagcagataaggaagctgaaacagaagcttctactgccaggagagatccactattaatttgctggtccaagatacggaacacaggaacatgttgttgaaatatttataaggaggacagctgaaaccttatttaatatggccagagctgtccagcacatctcaggtacgcatacaataaaaccgtaaatatattaggaacatattggtcattatagtcattgagacaagatgtaaaactctttaacgtgcctacaagtaaagaaatattctataaaattcaaagaagtttgaaggcgtattttcttatcatgttagggcaagtggcaaatacttcttggcttgaaatgacttaattgtcttaagatcttcattgttgttatctacaaggaagccaccagcatctacagataactactgcagaaaaatctataataagcattgtctaaatgatgccttacaatgactggattttttagaaaggtaagctgactttatcctgtattaataaacaataaaaagaaatcttttattataattatataaataataacgctatcatataatgatatgatctaggttaaaatagattattatgtatgaatgtaactataaaaatagataaaaaagaagatattcagactatttgtaatttagtaaagactgaactatttttaataataaaatattgattctccaactgaaattctaaaaatgaactaaaagtataatttgaattctaaatatctaataagggaataaaaattatatgatgagaatagttttggcttgaattttttatggagacatagctatattaattactttaagaaaatatcagttctaattatgtgcttaaaaatactgactgcacaccaaagcaatagaagaaaattctcttttcttgaaccatgacctgctgcaaatttttcatactcctttaattttttttacatttcaatcaattccttttttgtattcaactctattttattaagaattcaatatatcattttaatttaaactcatatcaaaacattatatattaaacccacttaaaaatgtggtgaacctccattatttggaattttaaaactccattcagaatgtacaggagttagcaagtttgatcctaacaaatgttccataaataataaaggtaagtattaatcctatttaaaagataagcagtgggtaaaataaaaggaaagaaaaccagaacaaatattaagtgacctcatgatttcatttagctagctttgcaaaatagtgcgaaaacatgaaaataaaatgaatataatcacctcattcaaaagtaccttaaaatgacgtgggtttctgtcacattaaaaacagtgattttctttcacttctaaatgttggcttgtatgctaatgaaaaaatattgttagacaatttaggatgattttggtgtaccggagaagttggaatgaaacacaataatttccaatgtttgagaaagcagcacacattttaaatattgaagaatgatttttaattttaatgatttaattttaattttaatgattttaattttataagtattactctgggggatttgggatatgattgtatttgtaaatgatcactaatgtacatctatatacatttctaaattacaaattgacatgttataatctattcactataaaaagaattttatatagaaactggaaagatatgtatcagtttattgacagttgttaacttactcatcaacttagttgttatcatagacagataaacaattttttattctttttctttccacttatgtctgtattccaaatctggttttacagtggtaactctattccaaagtcctcacataatcggaaagttagcaacaagtactctacccctaagccttttaactttgattgactactacctttttcataaatagtacaaataaaggtacaatagatataagacattggtgtctatataacaggaatatgcattaaatggttatatatacaatatatatataatatattattctagtctttactcttgacaaatagcattgtgtgtgtgtgtgtgtgtgtgtgtgtgtgcgcgtgcgtaaagactaggatctccaggaaggaaggatcatcaacaagttcatgaatttgtcccgcttcatttcttctcgtggtcattagcttctgacttgattatgatcaaaatagctatcaataaatgaacgcttttatttttttctaaatctctaatttgtcaacagaatacctagcttaaaaatgttaaaaagtgaaactaaagttaaatctctgcaaatgaaatggaatcagaacatcaccaatctgtttatcctctttccaaactatgtctcctacttgggaatgatgatgatacatgggcttaatggtaacatttatgcacaaaatattgtttgcagttaattttgtaaaatttgaatatagatctacttcttcctcaatatttagttgtacctccttttttcagccaaggatctgtcagtatagtactctgatagcaaaaggtaattattgaagatttactttgactctgacggtgttcggggttcagaatcatgcttgcgcatgtcagattctttgccagagatgtaatttgttcttgtgggtctatgccagatacgagtaaggcttcctgtggtgctgtccagaacattaaagcaacaacccccatgatatctgtggctggccaccaaagtcctatctaactcctgctaagctaatgtggaacttaaaattaacctgtaccaaagtattttaaaaatcactgaaattagtattatgtcaccgtgttcacaattctcaaaaaagacagaacaacttcaaatataacttgaaattaagacagcaaccatggacacgttaactttacaaataaggcaaatactaacgttagaccgatgaagtttacctttaagaaaaaaagaagaagaagaagaagaagaaattttcacagggtgggttctcttgaagcaatgaacccaaaatgaattatctatgagcaaagagaggttgagtcctgtaaacctaattttatagataaagaattggaggaccactctgaacatagaatgagactataatggtccccagaattatcctgattatgatgattcatcttacctttatgcccgactgccaatttacctaattgaccaggaaacagagttaacagaaaaattacaattacgcaaatgataattatcttttctctaaagactttgggaggcaaaatcatgaatagtcaataaaatctaaccatgacctttcctagtatcttccttttttaaaattatcttccttataatgctttaacatatacttatacttctgtcccttgtagaatgcataaaaagaatggttgtctcatatccacgatctgtgacttgtaaatctgggaatcaatttacgctgccattgcaagctcaccggtccaatgctctcaaacactggcaggtgaaacttgatggtggacaagggttcgtgttctaattgccgtgtcaaattccagccaaatgaggctggagtagagacatttggaatgttcccgagatcaatgctgggagatggaaacatttttatgacgaggatgtgtctaagctagaccagagcagagccaatggacaaagccaggccttatgaaatatggagcccagacaccaagctgacaggaatggttggagtctatttctattttggaagcctgagaaggatgcggtggtgggaggctatatctcacgttcaaaattgatcgagctgaaatgacttgcaggattaattcacactaatactgagcttctaaaccgcaggacacataactgtcactgggcactgcactccactcagcacgccttgcaggtctaagagttggaaggagaaaatatgcttcagttagaaataaaacctaataaattaacctaagacaagggactgtgacttagagtctgtttataaatgatttctttgtggactgggaagaaaacagtcaaggaaacagggagagaaaaaaaaaaaagagttctttctgtgccagaggtgaggcttcttgcttgttcctggctccctgggctcacagtgctgctagtggctgttcttcctgctgtgattacaacatcatccgatgccaagccctttaccactcttggttctgtgtgtggctgaagacaacagcggccaatggcagcagggctgtcagctgctgaaacacagcactgttctctcaaggaccaggtaatgagggagaaccacttgaaattagcaaaacggagacaaatatgggcttaagattgcagtcaaccatgatgtgttctattcacttggatgacttctgtacataatattgtattattgatctatcctccagtttgataaagacctttttctaataaagaccttttatgaagggatagtaaattttcaaattgacataaaggggagtatcatttctccccaaatagaaaactaattttataaatccagaaataatatgacattttaattaaagtgaaatcacaaaaataactcaaaccgtgaactttctccccattatatcagtatagctttatttcattgtacatgagtagatataattcatccttttcttttggaaattgctaagatgcaagttaaattttttcatgtggcaccatatttcaggaaatccagtggtaaagtttgaaaatcgatcatttgctcttcaaccatattatttttattcattcatatgtttattcatttactcaagtaatatttattgtgtttggagcacttttttttacctgggaaagacagttaattttaaagcacgatccttgtactcaaggaactaattgatagtgtcggcaggagtgggagaggtagacaatgggcaaataaacaggtaattataagataattctgctagtgataagtagaaaatatggaaaaaataaataacaaaaaaaaatgcatttgaacgtatcagaatgttaagggttagggagtgcgggggacgggctattgattctgagacaggaataatacggagtagttgctggagaatagaaaattgcaggcaacaacttcacgtgactaagcaaaaggaaactgttgaaacagttgtgaagctagggcctgatacgacccagaaaacccagggtgtgtgccaagctggctaagacaaactggattcaacatggtgctgaatttgacctaggtttcaacaaggacctcattaaatgctcattagcatcctaaactccatgtccgccaacatcatgagagttctggcgccagccattttttggtgtaaaaatggatggcactacacttccaaaaaatttccaccttttttccagcaatcttcgtgagtattccaccccttggttaaagaaaacagtaaacgtagcagcctcaaaccgcttgagagtgactctctcttgagtaaatcctcactccctttcttgagtgtgtacttttccctttgcaataaatctctgtactttcactattttctgaatcttcctcactattttctgactcttccttgaattccttcttactgtggtgtcaagagcttggacactggctagtgttgaggtctcactgacatctggcgactttccccagcccacctgtatcaatgttattatatacagtggtcagagaaggcatcagggataatgtgagggtgtgtccttgcccagaaaagggtgttccaggtgaaggccctgggaggagatggtgcttggtgtattcgaaaccaacaacaaggtgaccagtgtccctggtgtgaagacaggaagagggaggcattagaggggaccctaggagtcttttcagggcaaagtaaagagtttgacttctactccaaaggggtggaaatccatggaagcattttgagctggagatttatgacttgatttcagtggtaaaagtctgcaccgtgggctaaggaggcccaagggcaaagtggggagatgggtgaggaggcaactaccctgacccaggtagccacggtggtggctgaccggaacatggtggagtggcagagggctcgacaaaaggatgctttctcaatctatcttgaaagtggacttgacatgatttgccagtggattgaacgtggaggaggagagacagagtgtcaagaaactgatgtattatttggagtgtttaaatgtggaatctccataagagacgccagtactgtcattaacaattattctgctccatcgtcaagataagggatgcgatggcaaagttatactacaaatgcgtcattttcgctagcaatgcccgccatacatttttaatcaccgtttattaagcaatgtcctaaagtcctctttgtgggattatgaaaattatccttcaggcatttcagaagtgaagtctgtgacgatgtgttttcttttatgagttcatatgttcaggaggctggaaaatacctagctgaatgtgtgatacacatgataagcatgctaaggcatatgggcagaagaagagattgctttctatagaacagggaactagaaaacatttgtttgttcttttaaaattaacatttaaaaatggatccaaagttaagccctgtaaaccttgtttgattaactctggaacacaatgttatactttttcctgctgaggtgctcaaaggaatgtggcatacttgaatgtagaaaaaaaaaaaaaaaacatgaaatctgaggagttgggctgaaacttgaaatcctccactttcaggttactgagttttagttttctcatcctcaagatgaaatactcgccagatgcgctggctcatgcatgtaatcccagcactttgggaggctgaggtgggcagactgcttcaactctggtgttccagaccagcctggacaagatggtgaaaccctgtatctacaaaaaaatgaaaaacttagctgggcatgctggtgtgtgcctttggtcccagctactcaggaggctgaggtgggaggattgctggagcctgggaggcagaggttgtagtgagccgagactgcgtgactgcactccagcctgggtgacagggtgagaccctgtctcagaaaaacaaaagagatgaaagctgatgatctaaagcctcattcctagctggggtattttgttatgttaattaattgattaatatatgaattcaataactcactaattagctattaaacaacactatgctttctttattgtactaaacactttatgtacaaaagtgagcagaataaacagccactgccatcacagagtatgatcttattagcaaaatggcatatttttgacatcccattcttaataggccagtgacttccaaagattttacgctgcagattgtacaggaaacattgccaattttagagcaatttaaacaagaaaacagaaaaaagtcaaagaagaaagaagcagggatgaagtactgaaacaggaacaaacaaacaaatccagattatggtgagaatatacgataaaaccaagcatcaaatgccctgagctttctgatagctctggtaaaaatttaagagagatgggatgcaggatattttcaaaaagaaggatcccctttacaaggaaattatcaggtaagtattcctatgctggctattaaactacctaattggtaattccttcaatagcttactaaacctatgggaatgaccattgctttgtgtcagggttcaggaaaaaaaaaaaacaattagatatcatttcatccaaattcttgctataaggatgctcccctacctctatttctctccttttcagggaaagggtgtcatttaaagactaataggttatgaacaccttttcttcccctgctttcttctacttcatttaaaactaggatgtaaacaagacttggggatacagatgcaagaaagagagactaaatccttcatagagatcaagtgggaagttcgtgaaactgactattggatccatgaaattgagcaatatccctctagtattaaattcaacatatcaagcactattgtaagcatgtgagtcacatcaatcatttaatctttctaatgacaccatgcagaaagtttcaaatatatgttctttttatggttaaggatttatttccaaaggggtcaggtgtcttcttcagggacaggctccagaacccaagctgagactccataaacaccactctttctatgatgccacctttataaagaataccccaggaggtatcatgtttgccgttttgtcatacatatccttcctccctgctttggtaaatatctgatggctgagttacatgtcagtacacttagaaatacctgattataaatagttgatttaattcatcccatgaattagtttgttattctttcaaaaagtaggttttatggttgtaacagctttgcaaatggttcttcatgactacactgccaattatatgttacttaatctaataacatggttgatattgcctttcacaagagttcaggatggcatgcatgcctgtgagtataaacaactgcatgtgtggcgaaaaccttatacgatttcgtttttgaatcattttaatgacatttaattgtccatgaggagttataatgacataactatgttggaaatcacattcgataaaattgtagttttaaaacttagtatctgcatcctttccttggaaaatagcagccctttttcccttagaaatgtaactaccatttttttttctttttggtctatttacaaaaacttaagaaaagtgaaagaagaccatagagaattgcctactgcactcttctccacagagataatggctgttactgtttagtaatatgttcttctagacctctctatatgggtttatagatacatctgggcgagtgtatacacagtttttaaatataaaggaaatcttacaatgggtactattcgtcaatttactcttcacttaatcctgtgttgtgaaaaccttttcataccaataaatatgaaagtttgtattattccctctttgaagactacacaaagctcacttcatggttatccgatgctgggtctaactcagctccccactggctatctggttagttcttgattgtttaatgttttaaactccactgccataaacatttctcagtgtgtaccatttcctgattgtatagttttcttcaaattgcctagatataaaacttgtggataaaactatcgcaatttattaagacccgtatatgtattgccaaattgccttcccagaagtgtttacacttcccctcacctcaccagaagatgaaactctctttctctttaacctcctataaatgtaagtcattttgttaagagaaaaagtgtgtcttgtgttcatttactgtgtgttttcatcatgactaaagatgttgtattttcaatattatttataattatatattctcatttgtgagtcatctattcaaaatgtagcaaaattactcagtgttcctctcctgctttgtacacatatgcgaatttaacctcagcttaaaatggtaattcctcaccagggtttgaagtgcctgccaccttcataatgcatcttaaaggtcagctggcaatcagtgacaaattctacattcctgaatagttacttgtgaattcaggatttcatttagcttaatttgtgtgtttttttcctcctaagtgctcaggtctgaaatagtcaaattttaaccatctaattggaatgaaaagaaagccatggttcccggcgtgtccctaggaggtgaggatagaagagtgctgggaagaggaggcacagactcttttcatgaaggaatgcatctcacactaggagcagagacctgatcggagacggtcggtggcttgaacgctgagtgctaaaaaaaactggctgcaggcacactgccttcatcacctttgttttcaacacttccgtttccagcacatgtgataaaaataaatgaagagatcccaaagctaaaacttcaaaaataccttgtttccttttttgaagttccccactttacttaggagcactttcagaattgaaaaaaaacaagaggaatggttttccaatcgtacaagtctacactggaattccaaatgattgttttcttcaggaaaataatagggaagatgccacctacctgtgtccttctcaagaactctgaggtcacatggagatgaccacaacaggcaaattgtggcctccaatatttggtgcattttaagctttctccacaccgaggaactggaggaacagtggaatgaatgtgtgcctggacctgagccatgaaccagaaaccatgaggacaagggtaaggccactcaggggacccatcagccttctccatctactcaactgccacccaaacctcacgccacatccctgccactctcagggtatggaggctggtgggtgtgtttgtgtgtgcaaatgtgtgtgtacctgcaaatctatgcacactcaacaaacagcaccagtaacaccagcctctgtctcttcctggctttgacagaatttaagagaggctaaacaagagcacaaacctgagtgaatcagagcatactagaatactttcttatgctttcctgaacatgataggcagagattttatgtactaattatgggaagagctgatgctgtgacacagggactagagatataacagtccctgcaaaactgatctcataacattagattcccaggaaaattcagtgtaagggggctagaggaacttgttttgcatttggtggctggttttccctcactttcctaggcttgtcttatagctgaatgcacacacacacaggtacacaattctaaacacgagctgattgctcttcccataagagaacaagaacaattctaattcatttaaataatgtccagttggtaagagagaaaacaatttgttgagtgtgtacaaattgttgtttgtatttaaatgacagagtgatgagccaaggcacgccatccatgctccgagtgcccattgcactagagtagacaccaccgcaggtggccatgtctacagggttgtcattctcacctccacactggcacacagagaaatcctaaagagaaattagagcttaggcaagctcatgctactcatgaactaggttagttgcctccagaaccaagtttgctgcacctgttcaccatggcctggaagagcatacttacactactagtgtggcaggctctcatcagagaccgcaactgtaagcccagcactttcacacacaatgactacagttaagtgatggctgagcaggtgcttggacttttttcaccctctttttgctaagtgacttgagcgaggtttgcctgacaacccttaatgaattatatgcaaaaaatgtcaattttccatcaaatggcagtagtaaatcattcagaagtgaaaaaaatagaagactgaattctaatttggatctttaacaaactctttctctcactgctaacatcaagaccacccagggactgggattcacatgggaaatggttcaatgatggtgttatttttgaaagcagaaggctgtctaatgccaaaaaaaaaaaaaaaagaaaacgttcctcaatcactccatcttctgtacttgaaatttagtagagatagagaagttttcttttgtattgtgaatttttattgttaggaatcttcatggaaaataaagattttacatgtcctaataaaaattttaggacaaacaccctgaaataccacatgcaaaattatgataagcaatatagagccaagatttgacagtttactggcaagccaatgtgagaacggacagagatgcaataaaaacaatgaacttttaagttctgataataataataataatagttatgcatgaaagacattgtttagaaaacaaagggcattgggggccagcaaagcaaactgcatattgaggagatggacccaagactagttcaggctacacatttgtgtttcacacctaaacggactggacacaaaggccaaaactctgtagaaaatcctgtcttgaaggtagcactcccaccattacctccatggcttgtctagtgatgatgaggttgacagaaaacagtccagatattaaggtcagaaaatccagcacctaaataagcctctaacctttgctttttatttgggccttagtaaattatgtcacctctaaactgatctctttatttttaagattcatatactaataagaattatgtaacatagcacaagcggaagtatctagaacttagaaacctagaacatagaacacaggaacaaccagaggaaagtccgctgagtatgaccacacacacacgtacacgtacacacacatacaaacgtgcgcacacacacaaacgcacacacactggatgcacgaatgcacaccattcatggaacgaacacttccttaaaatattcaattacagtggaaagactgtcacctgagataataatttagactacaatatgtctgtagaatttaaaatgcatatattcttaaaagataatcagacattatttttttaaaaatgaataatatgaaaacctaaagatataaagtattattaatattttctctagagtaaaaaattgttcaccaatctcagataattttcaaatatgttatgaattttctatgatttgtctgaaaaacagtcgtatttgtagtacaaagtaattttccctgaaatcagaattggtggacgctaatgacttcacagttattttcagatgagaaaggcttcctatttgtctcagatctacaaactgatataatctattagtacctctgtaactgcatgacacaaaataagtggggcacaagaagaggaaaaagcaactacccatttcaaatctattatcgcccttacactctccatgcaaagagaaacagaaggaaatacgtgtgtgtacccatgtgaacacaacacacctgcatagaacgtggagagcttaaggcactatgaaataatctcttcacattgggtttacgcagtatcttcccccaaacccagaaaactctcagacacccataatatacagcaatggtgtttcttcttatcttaacatatggagaaattgtgaaagaatagctcactgacttgtaaaaagtacaaccgttatttagaaatgcagaccaatttcctcattgattaggtcaaagtaatttaattgcttacaaatgtccaaattctaattttaaagtaggaaaaatattgcatatttagcaaatgtgtgagggccaataggttttcatactatgaggataaacacttcattcaaagcaaaagaggcgctatagccaaaagtcattcttaaataataaatatatttttttgtgagtgtaaggtgttatttccttataccatcttgtgcacataaactgttctgttaattttttgaaactgcctgttaggatccccaaatataaaaataaaatggaactacatttcaattaatactacttcaatacttaacacatgactatttccatcttattcctgataatctatcaaaaccttcctttttctgatatattattctttcaaaagcattcttttttcactgttttggatgaattcatagcccataactatttgtttgtacagtgcccctttcaaaacttagattaagaatctagccagaatctttttcaaattcttctgtaaaaaaccacatcaccttttcggttagataattctcaaagcaattttcggatgaaataaacttagttctacccaatagtctggagtgttcttatttcatagtgcaacttgcctaagcccaaactatttagacatcttcctataacatactccctttgttgtgataaaaataaatgaacagatcccatagctaaaacttcaaaaatacctagttttcttttttgaagttccgcactttacttaggagcactttgagaattgaaaaaaacaagaggaatggtttaccaattgtacaagtctacactggaattccaaatgaatgttttcttcaggaaaataatagggaagatgccacctacctgagtccttctcaagaactctgaggtcacatggagatgaccacaacaggcaaatcgtggcctccaatatttggtgcattttaagaacactggctatttagtctgtaagagtaaaactaactatttaaagctggttataaattatatctcctgctcactctctctaaatcacaccaaatacaaagactttctcattctctcatgccagcaatacatcagttataatactcagtaaactttggttaaatacaaaacactatagaataagatacaggatctagcaactactgacagctgacattggacatgccaacgcttgagaaagagccaacagtaaactgactttaaaagcatcttgactcatttgtcacttatccaatggtgatgatcatcattgtgtatgttttccagggatattggcataaatgcatggctacccttccttatttgtagaatccagaggaaaaaactaaagacaagaaactcattttggtcttctgggcttattcattggtttttgctgtttaatttttaaaattatagtttgttttactcttgcattggatattaataatataacagacctactaattctgattgtattgtcttttatttattccaagcagatttcttttttttacctaatagattccttaatattccataagtgatttctaacatgtttctaaaattttattaattgatgatagtttaatcttatttttataaataatagatgttaagactctatattttttcaaaatgtttttgaaacatgttttaaaattcttatgccaactaagacaagatgtatttctattatcactatctgctcttatgccactttgatttaatcaaattagtttttgcaactttatacaaatagtgaataaagaaaatataaataaaatctttaagagcgattacttgcttcaccttcttttgttggataatgtctataaactgatacagatataaccaaaaatattcaagtttaaattagaaaacggaatgtaaacagagctgattacaacctcatctaacactggactccaataaccctgtcattccatattttaaatatgcaaggtagtaggactgatattttggtaaggcaaatgccttgccagaaacagaaaggtaaacattctggtaaatcacctgtcaactagacaatgctatgaggtttctgtctggatttggcttctgattccatcatggtggcgctctccttatcgatcctgagcaatattttagaagcacctggttataaagtaagctcactggaaatactcttcccagatctccatgtggctgaagtctcattgtttaggtttcagatcaaagccctcagtgaatctgttcttcatcactccacttattacctaccccaacaccttgtttaatttcctatttggcattcctcattattagaaagtgagttatttgcttgctcatatgttaaattttttatctccctcctccatgagtatattcattggaagagaccaagaacactcacccttcttgctctcattttaccccagaacctggaccaatgcctgggacccagttcctatgcaataacacttgttaattaactttttaagatgcaatatttctttttaaaatatttatgatttggagctgcctatttggataagatttctcttggccagttttactttagagatcacttagaatatgcactatggtgacaggtcactaccacatcatgctgaattttttggtacaatctgccgaggtgccaaatgtcacatgaaaggtttctgtccttcaagaaaacaaaaccagaacccaaacctagggaccacccataagatgtgcatgtgaccaacaatttcccccatctggaaagactcatcctacccaactcaagcccagacctcataaatgtgcttcaatggcgcctcttttgtaatattgctaagctcagccatgtccctcataagcaggaaatccaggaagcccagctttgcttgacgaacacacttttgcaggatgtctgcaatggaacagtttactttgcagaaatatttctgagatttgaacagaagagcaaaggtgggcaggactcacggagtgctgttagggacctaaggcctattttatattcttggtgggaaaccaagaacaaagctcagagaataagtttttctctagctctgtgtacatatttatttcttgattcttcttatcgcctacatagccttctcctggatccaacaaatgaaggcttttgatgtttttctgagcttcagatctgaaatgaatgccttgggaaaccgttaaattattgactggatttcaatcaaacatcactctagctaaaatattagatccaaaacgtgatgcatggaccttctggttgttttcaacactgagtaaaaatgttgccacctttcagaatcttgaggaagccccaaaacatttctgacttcactgttcagagaaaacattacaggatcttccatcttaccttacttttaatgtgtggtatatgaaatacaagagtacacgtaatagaatagacagagtgggctctagccataaactcttcacaaaagaaaccacaataacaaatccatattttatttctagtaaacataacagaagcttcagtaataccagaaggagattaaaatactgcaattctatttcaaaaataatttacctatttacttctctgctcaagcattttttcccggtacgaaagccaaacaaatattaaataataaatatcctggttgaatttctctagtcttttgccctagatttaactcatgagaaagaaatgaacgtttatcacttacttttaagggtggtgggcagaatgtctacattttttcccaccaccaccaccccaaatagtttttgaaagactaattacatgttgttatgtttaaatgctgttaaataaatgcatgtaacaaaattaaagcaatatagccttctccaaataaacataattttaattaacaaagggaatgtcaatatttagcatcaagactgatgtccagttttgagtgaggatttcttttcatgaaataattaatttagtccttcaactagcggtcgtcgttgtgacagtagctagtgtagtagaagtagcaagaagaaaagcccattggactaggtaactgcaaaatgtcactaactctgagtccaaacgttttgctaagctctaatgcatcttgcattagtgttttgatgatttgctcaccagatacatccagttatattttccactctatccgtctgtgcactctgtactctagccacatgggacgtcatatttttattgaagtgccaaagatatgtcactaaaaaagacttttgaagctattgttgacctgatttaatagtatgtgttctttgttttctgaagaggaagaacttggaaaaccaggcatgtcctcacaattttggtattcatatcacatagcacatatcagttgaaataatatgttttgtttggaattaaataattccatgataaaatgaagtcattttaggacaattacagcataaatattagtactgggccaatcacaacaaaatatcaaatattaataatacatttatatttatatgctgaagaattagcatagtgttacatgaggcataattacaaatatgttcttaagcattgattttatatatgcattttataaaattagaatagtatggtgaatgaaatatttattaacacaataaatactgctataatactcacattaattaattattatcagttataggagtatacatttttccctttttaagagtaggactataaagatatgtctccattgtgtttggtgttcagaaagtagaaatttaaggtaatatggagaattatttgaaaaatcaaatagtaaataaaactaaataacaattgctctatctaaaagtctgttctcctgtaagaaatatacatgtgtatacatatgtattacacacacatatatatgtatacacataaaagctactaacatagacatcaatatttccattttaaatataaggaatttgagtttgagaaacttaaataatttgaccagagtctaaaatttgctaaataatcatagataacgctttcttctacttttatagctgaactataaaaaagttaccccaagatgataaaagacaaggaaaacatgtttcaagaaatctaaagaataaaaattgcacagagtatattttttaactgcagtagaattaaacgagaatctatagaaataagactgcttgaaaagcccaaatatatgaaatcatacaacatgcttcttaaaatgcataggacgaagataaaatcataagagaagttagaaaatattttaaactaaattactagtaaatcactataaaatgtttggcaaataaattattatatggagggaaacatagcattaactacttatttataaaaaagagagagccaaattagtgactttatattccacttaacttataagaaaaaggagactaaacccaaaataaatagaagagtgaaaataagagaaaaattgagtaaagtaaaaaaaaataggcaactggcaaataataaattaaaatgtggtctttaaaaaaatcaagaaaattggcaaactcttggctagaaagattttaaaagggaattaatacaaatcagcaatatcaaaaatgaaaaatccatttttatcatatattcgtcagacctgaagtggacttagaataataacagcagctgagtatttcttatctgaaattcttaggaccagacgtatttcagatttgggatttcttttttcgaattttggaatatatgcagacctataaataatgagaaatcctggggatgagacccaacactaaatacaaaattcatttaatttcatgtacatcttatatacataacctgaagacaattttaaacaatattttaaagtatatatgcaactcatcaaagaaggtcaggtgtggaattttccacttatgatgtcatgttggcacgaaacaattttggattttggaacatttgggatttggaattttataattagagatgctcaacctgcattaataactgtacctacacatttaaaaagcagagatcaagtggatatcttgaaaaacataattcaccaaaattgacaccagaagaaagagacaatctatacagccctaaatctagaatatacattgaattttttatttaagatttctaaaagaaaactccaggagcagatttttctgtcttaaattttatctagaaatcacatcaaaattacacagttttagaaacagaggagaaaacagttctgctcatttttttaataatttaccgtctcctgtacagtgaaatcttaaaaaggctacaaaaaagggaattacagacaaaagcccctcatgtatacagacacaaatattttaaatgaactactgtaagtcaaacccaataatatatttgaaaaatctagtgtaccttacgaccaagtaggctgtactctggaatgagaagttggattaaaatttcacaaaactaattcaatgtaattgaacatataaacagaaaaaaaggcaaaaatactaccattttaattgatgccaaaatcatatgaaaaaattacatacttattcataataaaaccctcagcaaactactaatgataggaaactttctcaagcagataaagaacatttgtgaaaaatctacaagcaacatattagtgcagttctaggcaggagacaaaatctctcatcagggaaattcagtatgaagaacgattaatttatagaagattaaacgcaaagaggggtaaagagaattaaaaaaaaaaaaaaagaatggcagacatattgacctgacattacctggaggctcaggcagagtactcaaagaagaaaaaggcaaaagaggatacttgcctggctgagattcagagctggctgaggagggaggatttagtggcccaccgggcagcaaaaatgcatgctgaggctcaacactccacacagtccagcacgagtgccagctaatgtctgtgggaccttctggcgagctacccgatggggtgacagcaaaactatggagatgattgtcactggataccctgcacaatgctgactggcacataatcagaagcagaaattagtaagaatgtctcttcctcctgctgtgtccatgcagcaccctctactgagaaagcttaacatagtggcagctggcaaacgcgacatgtgtacaaggtttggtttcggaattacaaagcagaggaaagaagagcaggtttggaaatgaagggcaatatgctaataactggtacaaaagacattgtggatgatgatgacagaattcattacatcccacctgtgcctgtgttcctcacttttaccacttccgtgcaacattgtactgaaggagctgggcatttcaatacagcacccaaaagaagaaggcacaaaagggaaagttgagctgcctctctttgcagatgacatggttgcctccataaaaatttctcatggaatctttaaaacaactactaaaattaattgaatttaggaaggtcacggaatacagattaatattttaaaaatcagttaaattcaaagttttttatatgtcacatgaaatcaggaaacacaaaagaaaaaacataaattagacttttttaagactaaaaaatgttgttaaatatataccattaaaaggataaatgttggtggaaggaattacctataatacatatttcagtcaaagaactcgaatctggaatatttagaaagctctgataactcaaagggaagacaaaagttgcagtgaagatgcgcaaaatattttaacagatacttcaccaaggaagatatctgaatgatcaataagcacataaaatactaatattattggtcatcagggaaatgcaaattcacatcaccgtaaaataacactctacactcattacaatgacgaaaactaaaaaggctgagtacactaaatatagcaaaaacatacaacaactaaaattcatccctcaggtgggaatttaaaatgggactaccagattagaaaacattttagccacttcttcaaaagtttaacataaaacatactacccacccattccactcttgaatgtttgaccacagtaattaaactattttccccacaaagacttttatgcaaataatcaaaggagctttatttctaatagctaaaaacaggggggtgaggggggaacaaatgtctattagagtgataaactaaatgtggcatagctgtatattggaattctgcttaaccataaaaaatgtaccatttttatatgaagaaatgtggatggacctcaaaatcattattctgagtgaaagaagttaggcatatacagatgtgtgtgtgtatatatatatttcatataatttggcatatataatatttcaaaaaagcaaactaattcatagtgacagaaaacagttcagtggtgtgctggcaacaaaacttagaacacaggatggatgaccggggtcacaagaaaagttttgtgggtgatagaaatattcgttagcttgatggtggtggtgttccacggttgtatataaatctcatccaatttaaaattttcaatatctgcactttattggttactaaatatacctttaaatgtgaataattgtaactaaaggactcattcatcaagctagtattcaaaatgactatctctagctcttgcgtaaagaaatctattatgtatccaaggtaaactgggctctctgtataccaaaattctaatttaggaaaccaaaatagcaggtttgcagtaaaacttggcaaatcaactactgttccaagaatgagatgacctctatttgtctaaagcccctgataacgtgcaagtacacttccggtagatcaaaccataccattgcaacacaagctatagtagggaaagggttagctagtctattgcagaagaattcttcgagctcttgtcaaatctctccattatcaaaagaaagtaaccgaaatctagaaagactcaaccagttttggggtcaacttctttggatgcctttcccaatcctctctggaattaccagcatatggcactgacaaggctgcagttgtcaatcaccttctacatcagaggttgcaagcgctgctacacaggtgcattgcctttggcctgcactggaatttaaaccggaggggatttcacatattgaagattctttgctgctgatgaacaatggaagatccacgacattggacacgcctcacatttttgcctggcaacggtgggtcggtgcccagcagcagctgctctgtttacacgggatataattctcaagctcacaagaatgtatttttctatgatctgacacctgctctgtttcgctgattcacactctctgcctgactcctgagggtattcaagtttgtgaccctagtcaagtccagaaagtgacccacacagacctcagagtccacatcacacccaccttagcctttcaaattacattcgtttccattcggggtggtgggcagagaaggcactggcattcttttttaaaattaaagtgtgctcctggtagagaacagcagttttcataacataactctttgaatggatgagtttatcatcaccttattctttattcagcgtgcttgccgcttataccatagagatcatgagaaaccgggaagaatgacagtcacattttaaaacaaagtgttccttaattggatgggtcaaactagggtgccacagatgacaagagaactatgacatgaccataccagggaaaatacgaggacgggaatctcgtacggggagatacagagacccacaggcaacctcgtctacacagcacgttctcaccttccactgtttaagcacaagtcacctgcttggaacgccagttaattttcctttactggacatagctgaaaagagtgatggaagttgaggatgtcttaaaaagtctcaatagagggtcaagtttcagtgcaaaatgtaaatgatcctttcaacttccccatgtaagaaacatgcactgcattttgaagcagtcgcctctttgagagtgccttattttaatgagtctacatttatgagcacaatcatcgtaaatactctgaatgaatccacctttgtaaagcacatatgttccacttcctccctacctgaaccatctctagtccaaagtaggacttccctgcctcccctggctctcctgtatacacgagcaaatacaaagtcacaacatatcccgtgcatttacattttagaaatatttaatctaaaaaaaaatgtgaaaacccctaaacctaagcaagcaaatataatgattatcgtatccgtaacatattcaagacaggcttggtgtatatatatatttgagaaagagtctggttctgtcgcccaggttggagtgccgtggtatgatctcagctcattccaatctctgcctcccaagttcaagctattctcatacctgagcctcccgagtagcagggactacaggtacacacccccacgcctggctaattgttgtatttttggtagagacggggtttcaccatgttggccaggctggtctcgaactcctgacctctagtgatctgcccgccttggtctcccaaagtgctgggattataggcatgagtcaccatgcttggccaaccttgatatatttttgatgggactatcacggacttgtaagaactgacattacaattggagaaaaactgccatgaaagattcatgtatagaccatgagaaacagagacactatctcctttacaaagctattttaggaagttttcagcaggccaaggttttctttagctcagttttcctcttttggctgagaggacacagcctgcatgaagcaatcccttgtgttatttctgcttcctctctgattctctcaaattgaacatacagcctgttcattgcggggggctgtgccttgaagctgggagccagccacacctttttttttaatgctactgatttctaaaggaaaaagtaacagatattggttataaagtatgtggaaggaagtagtagtccaacaatagtagtaactctgaaccttctgtttgagggtttagtgtgagatgggtgcaacatttgagcttgggaagttgtgctgaaaatcacgttgagagaaagttatctgatcttaaagcggttgtaagaaggagatcaacaagagctagactcagggcatggagccaaggaaatccagtcagggtcaggaccgcagggggcagggtgtgggagggcagggcgccagcttgattctgaggaagagctctgcagtgggcttcactccacctcttgcaaagacgtctccccatcctgacctacccttcagttcaaggatgccccaaagaaaatatatgaaggctttattcacttagatctgaaaacctgaagccctgtgcagagttctgaattctgttctagttaatactccaggttctaagacataagcaagaacgatataagcaagaagaaaatcaagtgaaatacttgccttttcgattctttattatttttagtacattcaaatataaacaaagtgcatcagatttctctgcaaagggatacgtaagtaggtgagtgtatttattgtggtaaagcaagtaattgcttcatactctaagtaatattatattccttttttaaattttgggaattaaaagtgaataactcacatattttgtatatagcattcattccctttgaacttattcagtaaacaactatacatttcaatatttcaactaatattatgcgatgaaaactcacttgtttattctgaatgtttagctactcttagaggttgaaaggataaatcagcaacagactttgctgtccagtcacttgaaatgggcaggatgggggaaagaagaaaaagtaaatcttaaacagaaaaaagtcactcagcttcaaacttgatcatccacataaagctcatttaaaatcctgaaaaatctgggaaactatttatagctctttattgcatattaatatggatggtttcccactaaactatttcaacaaactacttctgtggatttgatacctgaagaaaaaagaatagaagtaaattaacaattttactgattcttgacactttcttttctcagaaggtattaaataaaataactatttcatttccttttgaaagacaatgtaaaataattactaaagtgatttcttcatgaaatttgattatgtctactactgtggaaaactcacttccttcctgacacgatgcccaacatcacctcccattcctggtcactccagctgctccgggatgccccagcctctgctggctgcctctgccccgccaaaaaaataacagttgctcccctcagccagttccagctaacctctttaagcttcggccttgaacagaaaaataatgtaggcagacatatgaatagtataggaatagtacagacaattctagatattgctataaatcaaaggttttcacccttggcatttctgatactgtatggcagacacttctttgtcatgtgagatatcctgtccactgcaggacgatgatcagcatctctagattatacctgtcagattctaagagcaactatctccccactgtgacaattaaaaaaaaatgtctctagatactgccactgttccctgggacaaaaaaatcacccccagtggagaaaggctgatagaagcatatacatacacatatattatataccatatatatacttctgtgtgtgtgtatatatatatatatatgtacacagtatcaaatttcaactgaatgatttttaaaatttttcttgcagttctatgttaacattttcttgtagttctaaaagtgcatcttataaatgaaggaaactaattcttggtctttcatacctcttgtaaatattttaacttaatttgtcatttgccttttgagtattaagttttaggaagtccaatttttcactcatatatatatacttctatgtatgtgtgtgtgtatatatacacacatatatatacacatatatatacacatatatatacatatatatacacatatacacatatatacacatatacatatatatgtatatgtatatatacacacagtatcagtatatacacacacataaaactatacagagagagaaagagacataggataagcataaacacagatgtaattcagtgtaagaatttcaaggacagagaacacacacaggaaaaagaaaatgttaaaaaaaatgctctcctcacacatgccctgccagggacactaaaatggcctactgtttctggatgaaggcagtatttttaccttggttaaaattacactgactcatgggaagccatctaagagccctcaggtgagttagatacccttggaggagcttcccacagcctctactgaaatcactacaacctgttaaaattatatctagatcaggaatctctgagctcccaccatcatctagaaattcgttgatggtgttttattatgagtttttacacgccttttattaaaagagaataaaaccttggaagaaaatggacactctgatactgtgtttattcttaaatgaaacatatatgtgagagatcttctcagatccgcaaataaaatgtcattgtttttaatggtaatttgtattgtagagctaatataatttacttaactagtgagagttattgatagtctacatttatatacttagacatgtttgaattttcaaacattatcaaaatgaaacaaaaagcattcctttacatttattttgtcatatttgaatgcatatttgtagaatacattcttagctagaatttctgaatgaaaagtttgtactttattttgagaaaaatttcaaaatatctatacaaaaatgttgcagcaatttaatatcctaccaatagacatgaaaacatgttttcaatatcctcaaaaacgctgttactaaaatgtgaaggtatgcccattcagaatggcgagctatcatactgcattgttttaacttggttcgaatatacttactggcacaaatgtattgtatttggactccttacgtatattttacctgcttttcaattgaaggattatttaaaattttcttgtagctctagaagtgcatcttacaaattaagagaaacaattctttgtctttcatacttattagaaatattttaacttgtcgtttgccttttgaatgttaagttttaggaagtccaatttttcattcagttttatatgtgatttctaaattacgtgtcctgcctagaaagacacttagacaatatttatcatttttattttccatattaatatttacattggtgatctaacatatttattttgctacaaacagcaaagactagatttactattgtataaaacagtgtcaacattcagattttcatgaccaaatcaagaagatatctttgtctgctaataatagtgtcatgttgcaaactatgtggctgtctgcttgttcttctgttccctttgtgtaaatctgaatgcttttccttaggctttaactttctaagaggaatatcccaggaagctccttctctctagccaaccgcaatatttgaatacttttccacacacctgtatttacaaatgcctaaaatacttctctgcccatattagtatggttttgctgctttttaaaaaaagccaagatatggaagtgaaccatccgtttttagctaccgcaaaacacaccaccacagcatgaggaggtagttgtctgaattcacatgcctgtcaaaacttcctcatagtattgcaaacataattattatctctcttacatgttttcttattttatcacagaatttctaattactagtcattttatcctttttcttaacaaataagcacacagcaaatacacacacacacacacacacacacacacacacacacacactctcacagttgttgtcaactaaggctgcataataatatcacttagggaaggagagaattaggtataaccatgatgagagcccaatctcacccttgaatctctgaattaattggtcttctccttctctctagacaactgcaaatactcaaaaacaaaacaaaacaaaaacgaaaaacaaacaaaaaacaaaaacaaaaatactcaaacttaaccagtaatgattgagcttacctaggggtcactaatttaaagcatatgttgacaagagcaatttgaaagatacattgaggaaaattacattttatttcatcatcctaaaatctgtaggtagaatagtgacaaaatcacctaattatgggaacattataggtttatctgagtggaccaaacacctctgctgtccacctctggtgccctcactaaggtacaataacctgttgaaccaggtttctaagcattgatgggtttctgtgatgtgtcatctgtgctccagttaagaagtcacctctgtgtgacaagctcttccactgctacttccctggaactatccaggccctggttctgggatcctccctcaccctgtgctggtcatatttgctggtcactgtcccagtcctgactgcacggctgccccagtgccatcaataagaagtcaaaacatgtgtggtgttcatatgaggctggtgtccctataaaagctttgacagtggcttcaccctctgattatcaatcttaaccagacatcactcactagccaagctaaaaataaaatgaaggccaggtgcggtggctcacacctgtaatcccagcactttgggaggccgaggcgggtggatcacgaggtcaggagttctagaccagcctggccaatatggtgaaaccctgtctctattaaaaaatacaaaaattagccaggagtggtggcatgtgcctgtagtcccagctacttgggaggctgaggcaggagaatcgctggaacctgggaggcagaggttgcagtgagctgagatcctgccaccacgctccagcctgggagacagggcaagattcagtctcaagacaataaaataaaataaaatgataccttggtttgtttttttttttttttaatcagtccattgatctgtgaatggctcccttaggaccttgtagcaactatggagacagaaaagcagaatttaggcaatgctaggtctctagtctaatatgatcctaatgtaattgagaccctttctttagccctcatatgtctataagttctaaatatcaccagatatattttatgttaggtaggttttgtcatggtgtgtaacctaactatccacaataaaactgtttttaaaaatatttaatgcattcaaaagcattattactgtttaagaaaactggaaaacctattctattttaacaacacttattcatgattttctgattttaatggccctatcacattcacctctaacctcttcattatcagcattgcagaaaattaggggtaatcttgttaaagttagaaagaccgacgaactcgagataaatgccaaagctatttccctaggccttgtattttacaataatcatgaattaatatatcctgattttctatattgagtggtaaaatctcccttcatagattcgcctttattcactttctgactttctaaggagtttctcttagacctttgatataataattttatcacagttggaaatagatgtcaacgtcaattgtttctgatttgggacaagtaaataaaacttcaaatttagaaaacatgtaccaattatcagtcaccacatgggatggttgactcacattcatttaggagagagttacattaagtcacgttgggttccgtgcacagtggcagggatgagttgccctgaatcaggaataatgtaattcaaaattgccccacgaacacttattgacgatgtgaaagtcaacatatcttccagcactttgggaggccgaggtgggcagatcacctgaggtcaggagttctagaccagcctggccaacatggtgaaaccccgtctctactaaaaataaaaaaattagccaggtgtggtggtgcaccctgtaatcccagttactcaggaggctgagacagcagaattgcttaaaccggagaggaggagattgcagtgagccaatatagtaccattgcactccagcctgggtgacaagagcaaaactccatcatgggggtagggggagcagggaaaaactcaagacgttggtaatcacaggagaagacacattcagggcacatttcttagcctcagaggattatgttctattagacatctgaatgtacaaagatatacaagccccgagccccattgcgaggtaacttcagggcaggtgtgagttcaaaggagtacaggcttccaattgcagtaggtggccagtgttacaggagttcatgcacacaaagaaaatgtacgtgggttgttgtttggaatgcctagggaagatttcctgaaataaatataatgtgcactgcgttttgaaagacgcatactattcagaccggtagagggagaggccgggaataagaggacaacattctcttgtaaggtcaggtcaaggagtaacccacagatctgtgcaactgaacaaggatacttttcaggggacaaacgggagggactgaaggacagaatgcagtttggagtccgatcatggactttcttgaatttcagggtcatgggtactagaactgtttatgttgccggagatagaagccagggctaggacagcagcagatgtgtcagtgttcccgagaggggagcctggggcaggaaaggatcgtgcattggtctatgtgaacgctcaggacagcctgtgccaggacaggagccttcgtaggaacatttactattaggatcaaaaacaggctgtggttaatggaaaggtgtttttttatgtgttcgtttgtttctttgtttttttttgatggagtttcagtctgtcccccaggctggagtgcagtggtgcgatctcggctcactgaaagctccgcctccccagttcacaccagtctcctgcctcaccctccctagtagctgggactacaggcgcccaccaccacgcccagctaatttttttttgtatttttagtagagatggggtttcaccgtgttagccaggatggtctcgatctactgacctcgtgatccaactgcctcggcctcccaaagtgctgggattacaggtaagagccgccatgccaggcctacttcctttttcttttgttttgtttgagatgaagtctacctctgtcacccaggctggagtgcagtggcatgatctgcactcactgcaacctccatttcccaggttcaagtgattctcctgcctcagcctcccgagtagctggacttacagatgcctgccaccatgtccagctaattttttttgtacttttagtggagacggggtttcatcatattggccaaggatggtctcaaactcctgacctcaggtgatccacccgccttagcctcccaaattgctgggattacaggcatgagccaccatgcttagcccaagacatgttaaaaaataagcattttgggatttggtgactgcatggttggaccttactggagactgggaagcaagaggaaatgcagagtcaataaagttcagctgtttaaaacagcaaccacctgacaggtcattaaaaaaaaaaaaaacaatgaagagatgctttaattctaaataacacaaagatcagatttttcattttgaattttgagtccaaatttcttccctgtgcttaccaagagaggtctcatttcagctctcaatatccacatcattaaaatttagtttattgatgggtgcccaaatcatatatgtattgttggtgtgtttgtactaaagaaataatccaagatgataatataaaggatatattaattttttaactctaaatgtttttacatatgtaaataatactatatttctgactaaagttccagttacaaggtaagcatcaataattctaaagtatatattctgttttgtcagctggggattaaatctgcctcttaagtttatttcgaaaaaaaatattacagtggttatgtgaaagaaatttattgatactaaaaatgctcaagttgtttaacagaaaaactgttttggtatttcagttaatgcacattttaaacttctaaaaatagcttttgtgcaacaataaaacaacaacacaccaagacagctctaagcaataacttttgtgacatctcagttatcagcagctcctacatcaatcctcccacaaaagaatccgtcctttgaattctagagctgccttaagggttgctacttaattgcgtttgagaaataaacaactgtttcaaggcataatgggaaacgaatagcattagagtgctccctttcccgattaattagaatttgctactatttataactactttccccatcaactcatcctgaatgttgaaagagaaaacacctcctcatgtgttttccctgacaacacacccattccaatttcacatctctatttatttcaccttttgtaatagtagagacctgtaacactcagtagtcattgggcgtttttccgatttgtattacagtactctaaacggttcccaaagaaatcactctgcactcctcgaacgtctcctcaaaatggcattctacgtatgcggataggaggaagaaatataaaatggaatatcaagatgaaagcaacatcctaactctaaggacaataaacaagtagaaatatgacatatttttctctatttcaaacaaaaaattgtcggtaactgagtgattcatatgaacctaagtaggctctttcttatcaacctcccttgcttcctgtactaaacataacccagcaagtaaaagaaaaaaacattctgttgtacatacaactcacaataaagctctctgaggcacaggtatcaatttatttactgttcactcaaactccaaaatgaaatatgtttctaattgttctaacttaatatttccgctgtcgatcctgttataatattgaagatggtaagaatgttgttttatatttattaatataaaatgatcataatagtaccataagaccataagagataatacattattgaaagacatacctgtcagtcaaattaagacaggttttctatatatgaaagaactagagtaaataaaaatattgagagaaagaaaatggaaacatttttaagagagcatatttttaacaagcattttttaatggaaaggtaaagtcataattttaacgtagagtcacacacattggcatttgaataaaatggattgtctaattcttttttctgtaactctgcagtttttattaccattataatacactactataccctagtagcgttgataattgacaacaaaaaaagtaactggcttttaaagagcataaattatttaagaaagcctacatcaaattagcaagtattgtatatgtagatactttgttcaaatactaacacataagaccataaatgtaataaaaggacagaggaaagcttacctgtttcagaaaagagacggccattctactatgtatgaaaggtaaacatgctactaaaaacagataatagatattgtagatgactcagaaaaaaaactaggtgtttgaaagtgggtgaaaaaatgcaaataaaatatatttgaaaatatattaatgaatatattttatatttaacctattagttatgtagcatatattgacatattataaactagatgtacacataaaattgtgttttctgtagagatttttttctcatcccataaaataataaatgaagcatatgattcttgtgtgtattactgttggcattaacatcagtaatctatataagttaattttgttaggaaaatctgatttctttggaagggatattccttcttcctttgccaaattgaaaacaaaaagtagatacagacgtacaggtataattttttcttgttgacaattgaaaaaatataatttaaaaatgataccaggaaatgttttgctttcttcattgtaaaaactatagatcaaaagagaaaacaaattacgaatagattgtaccattattgtctaaaccacaaattctccaaagaatgcaatagccctgaatgttgttccctcacccacctcctatgttcctttcactgaatatattctctgacaacataagggttcattttgttctgattagctgaattgtactcaagaatttatctttgttctttttctctcaaactcacagttgcttaaaaacaatggtgtattataattttatttaaattaccttgacaactctgtttcacagatcttgaacaatatatctataaacaaagtcagtgataactttcaataaaaagttaaatttttaagtatagaaaaagtatgcacaatttgccacaagttgatagacttcaagttttctgtatagtaactgtatttttcttttctggtaatgaggggtgaagccagctggacttcttgcattgagtggggacttggagaacttttctgtcttacaagaggattgtaaaatgcaccaatcagcactctgtaaaacacaccaatcagcgctctgtaaaatgcaccaatcagcgctctataaaacacaccaatcagcaggatcgtaaaagtagccaatcacacggaggactgaaaaaagggcattcctataggacagaaatggaacatgggaggggacaaataagggcacaaaagcagcccaacgggttggtctcccttgctgtgctgtggaaactttattcgctcttagcaataaaccttgctaccactaactctttgtttccctgccatctttaagagctggaaaactcaccccaaaggtctgtggcttcattcttgaagtcagcgaggccacgaacccaccggaaggaaccaactccggacacaataataaaatttaaatattccaactagatttcataatctgtgtattcaaacagtgctaactgtaatataaaaagttgataccttacctcacttttaaattcccttgttgaggctgtccatcgtaaactgataaaatatcaaaatcttcttcaagagcaaaggtatggaaggacaactgtatcctattgcgctcgcccgtgatgatgatccaggtgcagttggcatagttcggatacccgtgaggaaaccctgggctctcaatagtgccattgggaccctggactaagcctccacagttctgacctggaagagaaaacacacacaaaaaagcatattattctggccatctttaatctgtgatttaaaaaatttctaaacactttagccaatttttttttttttttttttttttttttttttttttttgagacggagtctcgctctgtcgcccaggccggactgcggactgcagtggcgcgatctcagctcactgcaagctccgcttcccgggttcacgccattctcctgcctcagcctcccgagtaggtgggactacaggcgcccgccaccgcgcccggctaattttttgtatttttagtagagacggggtttcaccttgttagccaggatggtctcgatctcctgacctcatgatccacccgccccggcctcccaaagtgctgggattacaggcgtgagccaccgcgcccggcctagccaatttttacaacattttataattcttgcacaaatattgaaggataaattaagtgttctgcagtgctgaaagatagaggacaacaacaaattaaaagaaaatatgcaacattttgtaactaatattagaagtttagggaagttctttatcctgtcactttaaaatacagcctcatcaatatcaaatttcagttcatgggggaacaaatttggtgctatctacatagtatcatgcttaaaacactccaccctaaattctttgttggtggaaactaagttacagaagaataaacattataaaactatatacatacacacctagccacataactgcaatatgtggtaataagaatagttagaaaaaaacaaggtcaatacgccagtgattgatcggtgcctgtgctggcaaatgtcttactgggcagaagaataacatatgcataaaggaagcttatcaagttgaaaataaaagacataaaacaaggtaagttaaatgacgctaaaatgaaagagcagctcagcaaaacgaggactgtaacaacatcctcactattgatgtctacccgttcacacaggcaggacttaggaggtggagcagaaaggaaggtgtaccacaaaatgaggggaccaagtaaagaaaaggctcagagttccaaagagcagtaagtaagcagtaagtgaattagcttagtccctaagcaggacagcaggacatctcacgttttactcagccctcccttaagaacttccctttggcaggtggaattgggatcaccctgagggtttaggattgacatgacaatgggaaatgatgagggctgaagggcaattgagtgccacaaagccaccttgaagccactgagcagtgtctgaggaactgatttcattctgcctctgcctctgaagattttgtgttattgattctaacaaagcacttctcaggtgactcccagactgctggagtagtttgaaagaatagaacccttgagtaaattgtaggccccaggcttcctgcaagaaccaagcgctgaaagaacagctctgggagattagtaacagctgcacacctgacccacctattctatttttaccactagacaaactgaaatgcctgccttgtcagcctcaccgatgcatttcatttccgctactcctgatcttcatccacctactttgcagggtgattccctacttgcctgtttcagcccttccccttcccaagttacttcccacatacaagctctccgtgccatgctaatttggtccctgtggttgtcaattttttttttttttttttggtctgttcagttacctgtaacagtctgcctctgatggccatgcctgggccaatccaactgaagcaagaggagccaaagctgaaaacggggcagacagatcgttggaagtgtgctctcataaacacactctgctcatgtaccctgtaaatattactatcctgtaagggaataggataacccactcaaacccttccaacatttcgtttgtctgaggttagctgttaagtagctcgcaaaaactgtctatgtttcttaccttcttaatatgcccatttcccactaatgtgctttaaatgtatttaaatgttttgacactaaaaatattgagaaagttttgaagggacctgggtgtactcagattgtggcatgtagtgtaagtacttgaatacaagtattatctcagctcttattgttaaagtacaaatagaaaattattttcaactacattttatacttaaaaagtattttacaacagtagacctcagtgagctcaaatcattcacagtaatattatcaaatgcttgtgggagttggcaaaatcttaataaaaagatttaatgaaagggatttatgagtttaaaaccagagaactaataaaaagcccattttccactaaatttaagtccaataataacactgtaacaagtaaatattaaagctgtggggttttgaaaggtttttaaagaaaatagcttgtctgctttacgagtaattcttgcttaacagtaaatcaaaaaaagggaagacttgattataaattggaaaaaagaaaaatcagttcaacagaaaaacgtcaactggaaagtagttactgttatagacccatcaggttgaatcagatgaacagatatgaagatttcctcaaggaataacatttaggctgcattcagggtactaatgagtacagtgcatgttgctgaatgagtcacatttgatccattcattgacattccatagcaccggttagaaattttggcaactgctcaaaagttcttagcagaatgaatatcatcgttggctgtccagtgcaaacaaccaagaagtttttaaagtatctatgcctaagatagaatcggatgtatttggtctgcaacttaatactgcatcttattataaagccaccgtgattaaagcagtgtttgattggtgtaagcctaaatagccagtggaacagaatagaaagccataaaatccacaaagatatagaatctagatttaaagctaatatggtagtcctcttttctcttggatcttatactctaatgggcccttgcctactatagagtatgcacaaatattctatacatgttttctttgtaaacgatgtacatctaagcttaatgtaaatgatgtccttaagtacagcttcaaacaagtggattattttaattgaatattcttaatggacaacttttaaatgctgcaaacataaccatatttcaacatgttgtttaacatgaatcccttgtaagtacctttgtaatttgtatttcttcagggcaataaaataatcggtagtttctgtgataattgtaatgttttagttaaaattaagatgttattttacagggattgaaaccttaattattgctaaaaaaaaaaaaaaaaaagtctaatggtcttcttcctccataaactgacaccggaagtcaccctgaaataaaatatcaatatcaatggcaatatcaatggtaaaaaagaagtatatatatatgtatgtgtatatttttcctagtgatactgaagtttgatttcaatttcaatttcgatttcaatttcatatatatatatatgaacacactctgtgatgtgtattttggtatgcatgcaattacacatataccaaaatacacatctgtaattgcatggataccaaaatacacatcacagagaaacatacatgcaacattgtgcatacagatgtttttgctgctataattcaaacaaacttccaagagaaaacctgaacacatgccataattttaggcaactggaatctaaatcatctgttaccgaaataataatatacgaaacatctggctcctatctaaagtaatcagcagaatgttagatatagaagaatcagagagttagtttttttgcagatttctactccttagataagtccttaataccacaaccttccatacacagagttaacttcagtcatttttaaattctgtcttatactgttggactgaggttctgttttcaaactacattttcacatatactctttgttgaccgtctaagtagccacacatcatgatttttacaaggatggaagaacaagtgaaaatgaagtaagttgtccaaagtcttctgggaatgaatcaaggtcttctgacaccaaagcctagagccgtcccaccaaacccagttatatctccacgaacaaacacagcaggcaacccagtgcattacagacctcatgtatggtgatcgagtcataacatatatcacaataaataccttagatcacaaaataaaatggtgagtaaatacagacattcggaaaatctagatatgtagggactctaaattctgtcgttctttaaaactaatcaatgcccattgaaggaaaaaaaagtgaaagtattaagtagcaattggaaacataaacatcactcatagtcttattaccaaagataattattgctaacattttgctgaacacttttctaatctacagttaatgttgcaatactacctggcatgcaagatgtgaacaatttggatttggattaaatacttgccagtcctgcaggaaccagtaagaactgacctacgaagtgccttgctttggaggtgacctggtcagcctgtaggtgctactctctatcctgtgaaggtccaggtctgcaagatgggcaagtgctcggcaaggagcctataggactacttgttcggggccccggtgagccatggagttgatggttggttatacagcagtgcccctcttggaggccggaaaacacattccagtaaaggcagggctcactgtgtcctatgacaattttctactttgaaagcctgtctcagaaacacccagcttagaaaatggccctgtgccctcatcatttctgagatgaactaacccctccactctgaacacccccctacagttggttggctcctctcccgggctgttgctctgtaattcgtgctgctgtatagcagtggcacatacttttcctagaaagtagcagctgagatgattcatctgtgatccaaactgattcactgtgagcatttgaggagtgaaggtatcataaacaaacgccttcctagattctacacctggatgaaactgtgctgtttctctcagtcctgggctgggtgggcattctcagaaagtagtagaggtggacataatatttaaaaactggtgtgccaaatatgttctactacctcatttaattcgtgcacagcctttgaagtggggtgtgtagcttagcctttgctttgctagctgtgaaaataattacttgggtaatgctttatgatgagggaatggttttgctattcaaaacctctgtctgagagcaaatgtttggacatcaaagatattttgacatgtaattgggtttagggacttagaaagatgtggactatactgttctgtatgtggagacagccatgcagggaaatgatactctgtagcaaattctacaaacgaggaaacgagtcatttgagaaatgatggacaggactgcagaggaacagtctggagatgaaaagacttgggaatgtataattgtctccaactctggggcctgatatcatttgaaagcgtatatagatttgtgtgtaaatagagtccaggcagaagccatattatcatctgaacagtatgtctcattggagataaacatcaaaaacagcctttgtggtttttatcccgtttgcaaaaagcccagatcaccacactggctcctttctaaaacaacatcattggtggaaaaataaaccttacatatttattacactcaggggcagtgtcgatccttttactacatctattttgtgaaaatgacaatttatggttttcatgtctatataaattactgtgtaaacgagaacttgattactttctgacaggcagatttttgacctccaaagcatctttcatttttgacatttttgtagtcaatttctattgtatacctgttggcttttctggaacactaaacattgccttactcctactggacgtagctatcaagcaactctcaagtaaaaaacataaaataaagaaaaaataaaataatataaaataaaatggtccattgcgattttcagtgaatttttttatttaagagctaaggagtacgacagacttctaagtggctctggaatttgaaatagtgagaggcctcagatttcaatgaaggaagtggaagtttccctgatcagataagcgctgtttgaaacggtaaacaaatcaaatatgcattaaattctgcattatcttctacagtttcaggggttattccagggtctgcattatggggaaaataattaattgtggaaggaccatgatttaaagtgccgttccggggacttcgattaagggttttcagaattaaagtcttcaggcattttgcaggaacaccatgccctgtaggaggctttgaaagcctgatgattctcagatcacctggagctactgacatcagccactctggctcagcgccctagggtacttggttgggttttactcccaaacacttatgggagattactcactacatgagcaaagaagaaaagtaaaaatgccagaggcagcctgcctgaaagagagccaaggaatcgatttctcactgtggagtctttgcccatgagcaaggccttgaagggagctcttacactcaaaatgaaccaggagtacccggtttgtatcactccaaaaggaaaagggaggttttcactggtcagtgtcacttctttcccttccttgaacacaccacgcttgttcccaccccaggccctttgaacatgtgggtccagctacccgaaatgagctttgcccagattttttcattgaggcctcatgcaggtctcactcaatgcagtatactctttccagacactcatatctcaatcagcaacattcttccaacattacatgctaccctttgccctatttttttttgagacagagtctctctctgtcaccaggctagagtgcagcggcgctatcttagctcactgcagcctccacctcccaggttcaagtgatcctcccgcctcaacctccagagtagctgggattacaggcacgcgccaccacacctgactaatatttctatttttagtagagacagggttgttcaccgtgttgcccaggctgggcaggaacctctgacctcaggtgatggcctcgcctcagcctcccaaagtactggaattacaggtgtgagccaccatgcctggcgcctacactattgtattcccttatagcatttataactttgtgaaatatcctatttacttgcttacgcattgatgatctctttctacactaaaatgtaaaccttccaagagtgaagataatgattggcttgtttatatgcccatttctagaatagtgcctgctagttgacattcaattgttgaagcctgtgggtgagtttgagtgcatgtgtgggaggtagaggtggtcggacaaattaaatctctgtgcacactcatagggaagcagggaaagcagtggtacttgaaagaactataaatctatattctggttagtgattacttaaaacattaggatgcaggtgatattttaattccaaaagcagagttgctattctctcaaccctgttcagcagcctgattgtcgaaagctccttaaatactccctgctttatgggaagctaatttttctcctacatgctgttcctatggacgttggcatctctgctttttccttctagacaggggtcatcattccgggcaagacaaggctgccatgagtcagaactggaacctcacggatatgatgtcaatgttgttccctctgctgttgcccccaggggaggcagctttagttaactccagcaatgtaatgttttcacctactgagaaattgttgcattaatggtaataaagtcattcagtgtgtacccactctgaaaagacaaattgccaagacagcaggtgtagtgcaggggcaaaaaaaaaaaaaaaaaaaaaaaggcaagcaaagcactgggcttcggatcaaacaaatctaaaatatgattaatttgctgcatggagcattaagccttgaacatattgcctcatggatatgagccccagtttccacaggtgcgggatgacgaggctgcccattttgcaaagtaattgtagactggcaaaaagagatgtcgaaggtaggaagcaggggtagacacagaaaagaaaaaagatgattattgtcatttttacaaaggaatatttagctagagggcctcctaattgcaagagaattttacgtgaaagatgatgagtgggatttgccctgtgcctgcctttaccctgttgtcctttagattccgggacacatcattcttcacagggaggcttcatggcaccccacgcctgcatgtgctcctccgctcactgtacttaaacattgtacttaaaatatgaggatttcaaggccatgtaacacgactttagagattctgagtgataaagtcggttatattcctcagccaatcaaatcaaaaacaacaagcactgttttattcacgattcccagatctcacatcgatgttttggaaataaacgatttttttgcctgaaacaggtgacaatctaaacctgagtcttcgcttcagagacttcgagcttatatttcaataatgcaagttattctgaagtcaatgctacttttcttatagaaacatagcacccattgccagtggagagaattctcttcctctatgcatggtagaactaatctttttattatatttattttttcttagaactaataattagttgtatgtcaggtatttatttatctcttaatgaaattcccagtgatgacacttcatcttgggtcagtaggattgagttgttccctacatttgaaatcatgctatgtattactcttgctttaatacgggtgaagccagaagctccagtgtctcaaggttgtggcagtgaatgaatgtagtaaaatgtttccctaagtagtgcatttaaactctgagatgtaaattgatgtagtttaattgggatactataggatggattcagcattactcactaaaaaaggtgtaaaactaccagttgcctgattcctgggtgttcgcatatacaaattctttctgtgtagatatatgagtgccatagttgtctttcctcaacaatgaagaaagatttctgcgtcaacaaggcatattttaaaattgtaataccatgctctattttaatgcttagtagagttcacctccaaagagaaattgaaatgttaaaaagtcatactaaaacccctagatctatgattatacctgaaggttgaagctaatacaagctctctaagaggacagacagtaaagaagaatataatgagggttttttgttatgaaaattatacagatatggagacctgaatcatgacaaattatgagcagatttttttaacctcatcaaaattagtacacacatttttaaaaagagatataaatgtccaacacattttctctctcccgggatgtggacctagtcatagactaacagccaaggtgctgacacggccctcctctaggccatccaaagtgaggccaagatggcagcaaagtcagttcttaaggggtgttttataagtttaatatgaagaaattgatctccaacaagtcaaatttaaatgtataaaaatcacaaatgggttcatatccatctctttggacaaataggccactgggccatacgtaacttcagagtgtttcgggcgccagtttgctgtttctatttttttttttttttaatttcttctaaaaaaaaaaatccgggatacatgtgcacaaactgcaggtttgttacataggtatacatgtgccacggcggcctgctacgtaggtacgcgtgtgccacggcggcctgctacgtaggtacgcgtgtgccacggaggtctgttaggtaggtacgcgtgtgccacggcggcctgctacgtaggtatgcgtgtgccacggcggcctgctacgtaggtacgcgtgtgccatggtggtttgttacgtaggtacgcgtgtgccatggttgtttgctgcacctattgacccctcctctaagttccctcccctcatcccccaccccccaatatgtcctggtgtgtgttgttcccctctctgtatctatgtgttctcattgttcagctcccacttgtgagttagaatatgtggtgtttggttttctgttcttgtgttggtttgctgaggatgaagcttccagcttcatccatgtccctgcaaaggacatgatctcattcctttcttatggctgcatagtattccatggtgtgtatgtactggattttcttttttccagtctatcactgatgggcgtttgggttggttccaagtctttgctattgtaaatagtactgcagtagacatacatgtgcatgtgtctttatagtagaacgatttatattcctttgggtatatacccagtaatgggattgctggtcaaatggtatttctggttctagatccttgaggaactgccacactgtcttcctcagttgttgaactaatttccattcccaccaacagtggaaaagtgtttctatttctccacagtctcacaagcatctgttgtttccttactttttaataattgccattctgactggcatgagatggcatctcactgtggttttgatttgcgtttctctgattatcagtgatgttgagctttctttcttatgtttgttggacacataaatgtcttcttttgagaagtgtctgttcatatcctttgcccactttttgatggggttgttttttcttgctaatttcttgtagttttttgtttatcttgttcctgcttccccacctgtgagtcacttaggatataatgacatgatccacattctctgtgatctacgggattgtctgtcaccaagtggcccctaatggtgcctcagccatgagtcttggggctcagtccacaccacaagggcatgaaatagatcttcctcacacacacaccatgcatgcatgcacacaaacacacacacacatgcctgctttctccctctcttagggaaatagtgctataacttatatttgggtttagtgtctatctgcacaaaaaatgtgatttttttttgcacagtggctgcatggataaaatcatgatgcatatcaccatttacgttgctcatttcacagacaaccatgtttcaccttttactggatttttaacatttacagttgtgcttttcctcagtgtctttgtgaatttaggaagagaatttgtggggatgagggctactccattatgttggagttgagacatcagatgccggctgatgccaccccaccacttgtctggtaaaatgtgtgtttatagttggtcgggaagtatgcacacccaccacagtaacaacgtcacaaaggataagagtgtgcttccgcatatacgtaaatcaatttcagtctgcaatgaagccagcacttccttagtactgacacctagtatcctagggccctggagtagtgccttcaataaacatatctatactgcggttatatattctctttggccgagaaactcttcttgtaggcttcagttggtatatttgccaaggtgctcaaaataagtgagtcatcattgatacacctgtcattatatgatctaaccttctcaagaagatagtaatgctctagactggcagccatgaaggcagatacctttattataatctactgactgctatattccaagtgccaagcacagtgcccagtgcacagtaaacatttggtctatggaagcaagggagctggagtgactattgtatctgataaaagatattattactacctacagtaatgattgtgaacattgacagagtacctattataaggtaaatagtttccatattttaatcatcacaaatgatcttgaaagacaggcattatcattcctattttactgatgagaaaaactaaagagcttgagtgattttttccaaagccacatatacaaagcaaagaaatgaggggtataaacccacgtgagtaggacttctacccctgtgctcatcctatcctgacacaatttagaaatgatatagtattttttctgtcattttctgaaaagaatgtgtctacaaattccactacaaaagcaaaggccaattttttaattttaagaactcttctactcctctttataagaagccatgaaactacattaattggaaaaaaaattaaacgtttttgtgtatctgagccgaaggctaaattctgtttctttgtctctatttgtgtaggcatttcagaaactaataatgatgtttatctttagttttatttcataagtaactattctgacctgatactacaatatgagttatgcctttaacaaataaaagaggtttggaatttcaataatatttgcaggtgtatgactgggggcaccatgtgttgatgcacaggttgtgcactgcacaactccacagagtgtcgttcacacagatgacacagctgccttgaacataagactgtcgagaacttgattgatattagaatttatcatgtctgggatgagacagctttacgtgtgaatatgtagaagacaccaaatagtcataaaaatatcaatgaccagcactttgggaggccgaggcgggcggatcacgaggtcaggagatcgagaccatcctggctaacacggtgaaaccccgtctctaataaaaatccaaaaaattagccgggtgtggtggcgggcgcctgtagtcccagctactcgggaggctgaggcaggagaatggcgtgaacccgggaggcggagcttgcagtgagcctagatggtgccactgcactccagcctgggcagcagtacgagactccgtctcaagaaaaaaaaaaaaaaaaaaaaaaaaaatcaatgaaaacaatagctcccttaacggatttgccactgtaattgatcttcagctaaatttctacatccatttgtatggcctttcaacttttaacttgctcctaagctgtgggcaagaaatcaaagccctggcttctgcctcttattttagcttggttttgcgacgtgatgcttctgcagaaacaacgcatgacattgaaactccacggagaattcggatttgctatacaaagtattttggcaaaaaggaagtgacagcctttcgagtctgtggccttgagttaaaaaaaaaaaagatacagcttgtagttgattctgtgtgtgattttattttactgatttctaattagagatttgagagcagaaaatatgtattttgcctatttaagcatggttattcagtttcatctagattctattcttctttattttacccaagttttgcttccaaggttgtagagtagaaagcagaaaaatagctagttgcctagataaagtatgtgaacagaagtgttgatctatttagcaggataatactattcttatttgccttgctttaaccattacaaatgaaccagaaacttgtactcataagttaaatattgataacaagaagaaatatggacttagagacaagggaccatttgcaatattcactgatcaaagcagtacaaaggatcaaaacttttagatctagtgcagatgtctcaggaaatataacatgatgccaagcgaatggcagcaaaaagctgaggctaaaatgagtactatagtttcaactgagaaaaaaaatcaaattattgtaccaaattccctaatatcagatgtgtataaacttaagaatattaaatacctggcaaacagcaagaggacagttttataaatcataaaaagcatttgtttaatgatcaaatgttaaagatttggtatttccagaaaaaaaagtgttgacaaaatcaacctttaatagcgttgaatattcaagcagatcagctcaagcagtgcattcctccactgctgtgctgtttctcgggtcttcagctggcatcatttctaattttttgcactgtagcttgattatagtcatatactggtggggggaggaattgaacaaacacaagcggatcacagaagaaaaaataaagtttactggtttctctaatcagagtcataatttactattttacttaagaacaaaactattccttaatatccagctgtaaaatgaggcccacatggttaatattctcataagatccttacacatcttctgggataattctctttcaatttctgccaggtatatgatgatattctgtcattattatttcaacatgacactctaattcacacgtctttagatttaaacacacatacctactccccatctgtatttaatgggcaagctgtgtgattattaggggtgacctaatttgatttactgaaccaaacagagagctcattggaattaaaggactcctgtcttataaagaaccctggcctgcaagttagggagagacattagattatctttcatgtgctagtatgatttagagacctgatagggagaactttaactcaatcctctgggtctagctccctaagtataatgaaaggagactcaattagaaaaatgtctaagtctcagctttcctctaagatacctatgagccatgattgagtcaggaagaacttgaattgtcaaatctttaacacaatttttttccaattaaattaataataaaggagattaggagaggcagaggaagcagcaataaattctattcccaattataaagcattgagggattgcattaaataggagtcttcaaaagaaccataaaaatcaaaggatgggattggggaaaatgatgtcagaatagaaatccagtctcatttatacttcgagaccaggaataactgtgaagagacatttgacatttctcattagtctaatgtattagcatcagtgaaggtcttttgaaacaaacatatgagacttccattctgtttttttgtctgtttcattctgctttgggaggaagtgggaatttccatttaaagagacaagcggggtcagtgcatgcagcctaccagaaagaaccactgtgccgagcctgccgagacagattcgccccatgtggtggctgcacctgtgatcccagctactcagcaggttgaggcaggagaatcgcttgaacccgggaggcagaggttgcagtgggccgagatcaagccattgcaccacagcctggagacagagagagactctgtctcaaaatttaaaaaaaaagacagattcgccacagcttcagccatcagggcaatcccaagcgcagtgacaagctctagagcagcagtctccaggctttttggcaccagggcggttttgtggaagacaatttttctgtgaagggtgtggggatggttttggggcattagattctcataaagactgcacaaactagatcccttgcgtgcaccgttcacaatagggttcatgctcctgtaagaatctaacgccgctgctgatgtggtggggtggagttcaggtggtaatgtgagtgatagggagtggctggaaatacaagcaaagcttcccttgctcacccactgctcatcccctactgtgtggtccggttcctaacaggccacagataggtacctgtcctcagtccagggcttggggaccccgctctagaggatgtgtttatgagagacagagctccttgtctctttcccagccacagattcagcccatttagtagaaatttccaaagtagactcttaggtgttgagtgatctgactggtcacagcaggaggcaattttagagataaagcaaatgacttttcatctatacaaatcgggctcctataaaggagtgattggatccacagactcccaagtaactgaattaaggtgacgatcactaggcgcaaccacattagaagtttaagtagactcaagtaggtcatggctatctttccgtgctgcagtagaaacatttttttgttattactaaaaattctggtaattgtttaattcacaagagtaccttgtctgtcatgttattttcctttccaggctaaaatttgcatttcaaataaaggaaagacttacagacaccagactttctaaaatagattttagcaacccatgctcaatatcatttctacttgtttcaaaatggaaagttttgtgatttatgacatgcattaaaatagtcccagataaccaccagtgacagagagtcaactgcagcgggttcctgatctcattgtgatccccaggagttaagttgccccaggctgaaaataagcataacacaaatggcagaaaaggaaatgttggaggaaaattgtattcaaacacatttggttgaaactccaaagtgtagtagatattattttgaatttgaagggaggcatttgcaaataactaatctttatcaagtgccatgcttttaggattctgaagaagacatgcatttttcataacgttattcatgcaaaatatctcagtagtctcagtagtcatttttttttaaccaaagtataatatcacagaggatattttaggattggattggtttcatttactcatgattaggttccattcaaatataaaggttggttgtaaacctgaattgacttcagatgtccaagttaaataataacttctcaaagccccataatgcctcagcaacttttttctttcccggtgcaaaccagggccgatgttacactccatgtatttgctgcaatttctatttctcaattgccttttctgttgtttcatctttgacctactcttctggagtagtctggatctagtaatctcaatatgtctaaaatatgtctcaggaattcaatttgaacaacagttcaggcaaatctcaaatgaatatagacttatatggaaaggatataaatggttcagggatgtattgctttctatgcagacgtaacaactccagcagtataattcccctgctgggtctccacccctctgatgctctctattctggggaagtagagcaaattctttgcttggtgagtttggaaaaggaaagtaggaacttggagcatgaagcctttctctctccaccctggaaacgaagtaccaggcaatgcatatacttcttacgtttgctgagaggcacagtggagtttagagggggaggaatggagggatgttggtctaatccagagttttatattaggaagttcatatggctatagatatcaactaaaatggttgaagtcagcttagattgtaataagttttggatttgttgggtgctttccagtggtctcacacctgtggaagaggtgtcttatttctcaatgcattcataattcagacagagaagaaaactttattttttgggtcccttctgtgtacacaggcagacaactttggaaagtcatctttcactggtgaaaatggaactctattttaaagacaacaaataatgatttatttggaaaggggcaaagggttgaaaaactacctattatacattatacaatatacccatgtaacaaacctgcacaggtatcccccaaatctaaaacaaaagttagtattttttaaaagacaacaaataactaaccattgtttgaaaatgaggccaagcatttgatacagatgtacctccaaaaaaaaaaaaagcttaaatctttgtaaatcatttgtccatcaaaggagacctattaatttacctatattactaatttcaagggttttgtcttactaagacagttttgattcttttgactttaccaaaatgttattccttaaatacagataattacctttttcatgaacttcgtttccttctacctgcaaatcttaccttggttgctaaaattgaatagaaccctccccctggggtcactgccatgctgctatcctggctgcctggctgatcctagttcctcaatggccactggttgcaatcgacctgctgaaggtttgaaagtggcttccaggagaccaaacaaaactaagtgataggaagtaaatgttaaacaaaaacaattttaggtataaaatggaaatgtgaagttacagacatggattctggcttattttttggaaataaagtaaaatctatgatgatcagaatttaagaggatctcaaattgtaatatttacttccactgacattttaagaggaaataaacagttgaattacttatttttcaaaaaacttctgtgtaagtaactttatggtacttgctatagaagaacatagcatgtaatcaccttaatcatttagatgaaaagtcaatataatggaaaaggtaactaggacacgaagaggtgttaaccagaaaaatgatgttcataagaaatgcccaacagctactcacactaatagtataatttacgttgatataatatcaaatcaattactcaaagacctccaacaacaaaatgtggattagaattcagctaattcacttactgagaaagaaaagaaaagcatgtttcattattcatcaaatattgattgactgtcaactgtgtggacactgtgttaggctcagagaagacacagatctgtgctccctggagttccatgttagtgcagagggttggacaataaaaaataaacctactcaatacataaactgcatgctctgttgggagatgagtagtgttatggaagagaagaaaatgtagggcacagtaatgggaaagacaatgctagtcttatgggggcaaagtgtatcgtgtgtgtcaatgagaggtgatgtgaagcaaggattaaagggaatgagggaaaaccccataagaacactgaggaaggactattccaggaagggaatatggctgtggaaaagccttaggttaggagccagactttcagggggcagtagaagaagccagtgagcctagtgaagaaaagcaggaggaaaagacatctgagaggcaaccttcagggtagagaaggtcagaccaggcatggttgtgcaaagttgccatgatattcagattttaatctcagtaaagtggggacactttgaaggactaatgtatcattatattatccacgtaaagcttaaagcacttaacctttgctgataagaacatttacggaccatttcataaaaaaatccatcttgcagggattctgacaactttgggtttgttcaaatctgatgccatattcaacttgcaaatacgattgttgtgaatagaaaattagttgaatttactatggttcaaaccaacaaaggtggtgactaattttagtttcaaagttctctgagatagtctatcatcaccgaatacaactgcccagttacctgccagagcaacaatgggacactcactccagaacagtgtttggggacactaaatgccgcaggaggcagtggcagacgtgatcctagaaaggaccgtcctgcggggattctcggtgtaaaggagaacccttccccagagaaaccacatttactaatgtgcagagaccaccaaatcagcaggggcccccaacatcttatctgtcctaatccatctgggggcggcctgaaacactgacaaaaggtgtttgtctttgcatcacccgattcagaactcacatgaggcacaagagatggacgatcctcaaaaaccaccgtagggcacgcaaagccaccaggacacgcaaaagatcacaatggaggcaaataacacagtgcccaaagctgcacagaaaagctaggcacagattttctctgggatataaaagcatccaaaacatccctgcatagtgggaaactcagaaactcacacatatgcccagggcagaatacactctcagaaaagacctcacaattttcccaaactttcacacctggttgagcagtagtttcagtgcaaacaagaaggaaaaactaaggcagagttgtaaaaagcctggcgaagtgttgaaggagggcccagcacacaaagggtcaactggcagactgagagaggattttcatttttgttttgtatttcctttctgcctctcttttcctttctttcttattcatgtccattcccttccctctctgtctctctttctcactcacgcactcttggcattcatggaaatctctgtcaaaacgctgtttaaacattagttaaagggacaaaggcttcaaagaacaaacatagaaaagaatataaaccttataaaaattgtttttaaaagtatttaattcaataactacagcaataaaacaattcccaagaagaataaataaaattaatttgcacagttaccaatgtataatagtaaacatggccagttctcaaaaaatcataaaacattaacaaaaagaaaatatgacccactcacaaaagaaatgaaaaaaaaaaaaactctccctgaaaaagcacggacatttgaattagtagaaaaagacttaaacctactgtttaaaatacacccaaatagctaaaggaaaccatagacaaaaaggtctaggaaaccaggagaatggcatctgaacaagcagaaaatgtcactacagatatagaagttataaaaaaatacaaatactgaagataaaaagtacaataactgatgctataaactcatgagaaggtttcaaaagttggttaaagcaggtagaagaaagaatcaacaaacctaaaattaagaaagttgaaaatatccagtatgaagaaaaatattcagtatgaagggaaaaagaagggaaaaaaataaacagagcttaagaaacacatggggcaccatgaaacataacaatatatgcataataaaaaatccaaaagggaaggagaaagagaaagcagcagaaataatgtttgaataaatgactgcaaatttccaaaatttactaatcaaaataaatcaacacattcgagaaactcagatacgtgtaggaaggataaactcaaagagatccatactgggacatattttaataaaattttgaaagacaaaaacaaagattgaattttaaagatggcaagacagaagtaacttattatacacaacagatccttagaaagagcacctgcaaatttctcattaaaaattcctggaggccagaagcaagtggcagtatatttttaaagcagtgacgcaaaaaagcaaaaacaaaaacaaaaactctatcaaactcactattctacattcagcaaactatgcttcagaaatcagacattgataaactagaaataaatatattcacaaatttttaaaagcaaaatgctacaatgaatgccagtgcggagtatccacaatgaaataaaaagacttcggaaagtaaagcaatgccgttagaaaaattaaaaactacaatcaaagtcattatactggtaaatataaaagtcactattcttatactttcggtttctaactcatttttcttctatatgatttaaaagacaaatacataaaacaatcaccacacatctgggttaatggtaacacaatttatgaggatataatatgttcctatgtgaacatggtctggggttgggagtctagagctatataggagcacaacttttctatgttattgaaaatacgttgatattaatagaactagattgttatgattttaggatgtgaattgtaatgtctgtggtaaccacgaaggcaataactgaaaacaatacataaagggaaatgagagggaagtcaaaatggtacactacaaaaatacataaacaagaaaaccagagaacttcacaaatacatacaaataaaataaccgattaaaaatgtaagtacaaaaatgggtcaaagaagaaattccatgagaaaataaaaagtttcctggagacaaatgaaaacgaggacacacaaaaatatatatggaatcagaaaaacagtgctcagaggaaatgcatagctgcaaataccaacattaaaaaagaagaaaagatcaattaacaccctaactatacaactgaaggaattagagaaaggagatacaaataaactccaagctggcaggtaaaatgaaatattaaaaagattagagcagatatatttaaaaatgcagaacagcaaaacaatagaatctacaaacataatgtgacatagacttgcagtggaataccactcagtcacaaatgaaggaagtactgacacaggctgcaccatggatgaaccttgaaaacatgctaagtggaagaagccaggcacaaaatgtcacagacagtacaatttcacacatatcagatacccagaagagttatatccatagacacagaaaacagattggtgattgccagagtctaggccatttccaaggcgacaggggagtgactgtttaatgagtatggggtttcctttttggatgataaactgtttctcatacagatggaggtggtagttatacaacattgtgaatgtactgacgcctcggatttgttcctgagaatgcttaatttatattaagtaaatttcattttaataatttttaaattaatctatgtaaccatccatattaacatgctaaacaataaaaatcaaataaatcataaaaatcatgtccatcagggaaaaaatgcatgtgacataattcaacacccactcaggatcaaaacactctgaaaactaggaatgaagaagaatttcctcaaattggtaaggagtatatactcaacttgtaactataattatacttaatagtgaaaggctccatgattttctcctaagattggataaaagaaaggatgtccactcttattcaatatataattgggagttctcaaccagtgcaaaaaaaaaaaaaaaggaacgaaataaaatttatatacatctgaaagggagaaataaaactgtccatatttaaagatgacataatgttctttgtagaaaaccccaaggaatctaccaagaaattcccataaccagtaagtgattttattaagtctgtaacatggacagaagagttaaaaacgcaacacaatttaaagccattcaaaaatacttaggtgtaaatctagcaaaacacatacaggatgtgtttgctgaaaaccagaaaacacgaaagtaatgattaagcaagataccatgtcagaaaagtaaacataggaaagatatcaatgatcccaaaattgacacacaggtttattgcaattccattacaaatcctaacccaacttttgcagatatagagaagattattctaaaatgtatagggcaagacaaaggaactggaatacctaaaataattttaaaataatagacaccaaaatcacaatctataaaataaaaaatattataaattatagttcagcaaaattaaaaacatttcctctttgaaaaatcctgtaaagggaatgaaaagacaagctacagaccgcagaaagtatttgaaaatcacatatttgacaaaggactaacatctctaatctataaagaactctcaaaactcagccataaagccaacaatccaattagaaaatgggcaaaattatgaagacatttcactgaagataggcagatggcaaataccatgttaaaaggtactcaacaacattagctattagggaaatgcaaattacaactacaatgagatatcacttcacacttacaataatggctaagcttaaaagaaaaatgataaaatcaaaatctggttagcataagaagaaaatggatcatacatacattgctggttggaatgcaaaatggcacagccaccccgggaaacagttggcagtttctttataaaacacaacctgcaactatcatacaacctaccaattgtactactaggcatttatcctagaaatgtgacaacattcacacaaaaacctgcacatgaaattttatagcagcgttatctggaataagcaaaaactgaaacagcccagatgtcctttaatgagtgaatggctaaataaattgtgttacatccataacatctaataccactcagcaataaaacaacgacaataacaacaaataaaaacagactgctgactgatacatgccatatactggatacatctttagagaactaggctgagtatacaaagccaatcctcaaacgttgtatgctataggattcgatttttataacatttttgaagtgacaaaaatatagaaatggagaacagattattcattgctatgggttaggcggtggggtcaggaggaacgtgaatgtgactctacatgagaataggatctttgtagtgatataaatattctgtatctccaatgtgttcatctcaataccttagctgtgatgttgtactatttcctggctttgcaagatgttaccgtaaggggaaactgagcaatagatacaagatatctctccgtattattgtttacaacttcatgggaatgtaaaaaagtcccaaaataaaaagtttaatttcaaaacaaaatatagactaagatcaatgtttttataagaccattaaatcgtaataatcctatatccaaaaaacggttagcatgaagaatatgttagtcctaggtaacagaagttgtagaatgttaatgttatcatggagatgaaggacggtagcatgctgagacaagaatatacgtaaatcacaatcagtatcttttaataggattatattgacagtttctacatagttacagagttattacaacatattcaatataattttgctctattagcaatgtttgatgaacaattatatcatggacatacacaggtcaatgatgtaactgtgttgagacattatattaagataaaaatttgggactagagaaacaccacaattacactttttcttttctaatagattgcagtacaatatataaatttcaaaggaaatgaaaaccccctattaaatccttaaacagggtctaataacctgacatgtttgcaaagttatgctataatgattttttataattaataccaaatttaataaacatttttattttgtagacaaataagaggtttctaaaagtaactgagtaatgaattactcagaggaaatgagggaaagcagagggggcgatttataggaacatgcattgttcctgaaattgctgaggaaaaggcattagattctacaaaaagaccacattgacacgcttttcttttaataacactaatttctttttattttctccagtgaagcactttgtttctgcagactggtgctttctggtggtgaaaagtccatctgtgtttttcaggcactttcgctcgtctccctggagaatgctaatgtaaagatgtcattcatgtgcccaacaatgccagtcttgacggctacgatttctcacatcatgttcttcagaaatataaaacccctttcagccgccacttcgttttgtggtctactttcaggagcatttgtacactgcactttcagatgttacgcaattattcgtcacatacacctcctgctccaccgttcctatggatgatgctcacattccttttccaccagggattcaagctcaggtgacaaacgagtgcccacatcatcaaaacattgtggcaggacacttgtcatggtgtggaaacgcgggtgacagtgtttattccaaaatgagttagccaaaagacaaaaagagagaaagaaaaaggaaagaaaggctaaagaggttactcttaaggaatgttcttcaacatgatttcctttttcatgtggagaaggcttttgttttgttttgatttccctgaaaaatctctgttccagcccagagctgactaacatgactggagagagtcaagtaagccaacccctgaggacaggagggccagatcacgtgggcttaggacgccacggagaagggatctgtgtcatttcctctggaaacccactggatcagctgggaagtgctggttctcttggcaagacaagcctgagacacattatcccagcccgatttttactgctgacttttcattacctgtatatacacgataacacaaagttagggaccagagcaaacattggacaaagcccatctttttaaaggggaaagagcagagcaaaactacgtagaatctacaggtatttctttcctctaagggactctttggaagatgctaagtgattggtttgggtcaatgtccctgccgaaatctcatgtccagtagtaaccctgaatattggaggaggggcctggtgggaggtgattgaatcatgggcacagatattccccttgctgttgtcctgatagtgcatgctagtgagttctcacaagacctggctgttgaaaagtgcatgacaactctcccttcactctcttcctcttgctccagccaaggaagacatgcctactttcccttccactatgattgttttaagttccctgagacctccccagccatgcttccggtccagcctacagaaccgcaggtcaactaaatccctcttttaaataaattgcccagtcacaggtagttctttaaagtaacgtgagaatggactaatgcactaagtgctgtagcagagcgcctctggttccaggcagaacaaatccaggatcgtcagacacttcagattctcacaaatacctgggctggatcaggaaaagcatcctggggttcttctcaaaatccagtgtcatctgacgatggctccactgggatggaaattggaaagctaatccagataagactgaggaagtggctcctgttgtttctggttcgggcaagagatccacaacacaatgctgttctgatgaagctacctcatgaaatcgcctctgtgaactgtgtgggttctgtgtgtgcgtcatcgtacagcctcatcagagtctgttaaaatttctcacacctggacaggtacaccagctggtaaagagagagatactctccctgcgcatctcaaagtagcccagggagtagttttcatctttgcattatcttggggacatttaagaaacactaaaatattatttctgtgtgactagtaagaagagattttcaatgctgggcacggtggctcacgcctataatctcagcactgtggaaggctgaggcgggcggatcacttgagctcaggagttctagaccagcctgggcaacatggtgaaaccccatgtctacagtagaaacgaaaattgaatgttcctggtagttcccgcctgtggtctcagctactccagaggctaaggtgggaggactgctttaccctggggagttcaaggctgcagtgagccgtgatcataccactgcattccaccctcggcaatacagcaagagcgtgtcttgaaaataaagaaataaataaataacaaaaataaatacatttttaaaggaaaagaaaatgttttcaagagttctcagattgtcacgtcaaattcacatgtgcttattattataacaggttgggagccatacacagcaaaaataaaagcaaaattttattttatataaaagtgtagatgctaatcttatagagacaatcaaattattcacatagtttggaactatggaaattatggcatctttatggtgagggaaaatcttctttgtatgcatttcaaatggattacatccatccaaactttataaaacacaatgtatatatattacttctttacagtttctatttacataaaaaacttgcattaggaatgtgtttgggaattttagatatattgaaaaattgtagcatctgaaaaaggaaaataatatctcatcgtgttcttcattttattattaccaaatattttaattttcaaactgtttaattattaatttgcagaaaaggtattagtttccctttactctccttccaccttgccacccagccctgccctctgtatttctggcaatctagattaaacctcctgcattttttgctttcttaggtcttttctgtttgtccatttgccaaaccctggcggcttctttcagagctctgttctcccacgaccttcctctccttcactttctctgaaacttcaaagtttggctggttctcttttctctcagattggccttcctctccctttgctgactttgaaatttgtaaggtaaattaactgaagactaatttccaaaaagtaaaccacccgttttaggtgaacgggtccatgagtcgtgaaagttatgtcacacataaccatgagtaacccataaccatgagagattcaaactccacagctaacacacaagcattcccagcacactgataagatcctcttgctcctctgtggtcagccctctcccccagagggtggcagctggttatcagtgatatgatttccatctctgtagctttgcctttcccaggtcatattaatagaatcatacagtgtgcatgcagccttttgcaatggcttattccacgttagcataacgcattcaaggtccacccacgctgttgcatggatccataatctattcctctttgttctgagtagtgctctatggtatgaatattaaacaatgtggttaccatttgcatattaatatttgtgtttgttttccatttattagcaaatataaagttgctgtaaatatttatgtaaaagtcttcctgtagacatgttttcatttatcttgagtaattacctaggaagaccttgcaggattgtatagtaggtatatattttactttacaagaatgacccaaatgtttgccaacatgaccgtgccactctgcgttcctattaggaatatgtaatattgcatgaactctgcatcggcagcagcacttgttgttgtcattttttttgtttttgctttaagccatagtaactggcacataggacaatctcattttgcttctaggtaacgtttctgtggtgactggggggcgctgagcatcttctgatgtgcctgtcatacagcacatcctgggatgcagaataatgacctcccaaggatgtctaagtcctacttcctggaaactgtgaatatattatttaatgtggtggaggggaatcaaggtaacagatggaatcacggttgctaataagctaaccttagaatagaaagatgattttggaatagccagatgggcccaatataatcagagagggcttttaacatggaagagggaggcagagtcagtgtgaaagtgagtcaacatgataaggactcaatcagcaactactggtttgaagaggaaacagcacaggagacaagcaatgtgggcagcctctagaagctgtgagaggcaaaaaggtgaatttttactaagaccctccagaacggaacagaatcctgataatactttgatttttgaccaattttggacttctgacttctaaaactgtaaaataacaaatttatgctgtttcaaaccaataatattgtggtaacttattatataagcaacaggaaaatagtaaataatccataactgtaattaaacaaagtgtccaaatattttttattttaaaatgtgctgttttcttactgagatttgagagttcttcatacagtcaagtccttcatcagatatgtattttgcaaaaacgttctcacattctgtagtctatcttttcattttcttaacggtgtgttttgaagagcagaactttataattttgatgaagtctgatttatcaaactcctattttagtgctcctgctttttgtgtgttacctaattaaaaaaaaagttctttgcctcaatttgtgaagcatttataaaatttttatgtaatttttattcctttagtttatatatgtaagaatatcaatcattttgagttaacttttgtgtataatgtgagatataagtaaattttttaaacttctacatgtacaggtccagttattacagaatcctttggtgaaaagactattttttctccattgtgttaccttgtcccctttctcaaatattgttcggccacatatatgtaggcctatttgtggactctattttgttccatagattatatctatctatctatcatgttttccaataccacagtcttgattactgtagcatgaaaagaaatcttgaaatcagagtgtgttagtgatccaatttagtgcttctttcttaaaattgtcttggccattctagattctctgcttttctgcaaacattcgagagtgaatttgtccttttcttcaaaatgcctgctgatattttgatttggattgcattgaatccagagaacaatttagaaaaaaaaaaagaaactgatgtcttaataatatgaagtactccaattcatgaacatgatataccctccttttatgtaggtctttttaaaattttcctatattagtgtattgtagttcaaaattcagatttttatatattttcttggattgtccctgagtactttatgtattggaacgctattgcatatgggattaaaaaaatacaaattctaattttcttcagtgattgttggttaaagaaattcaatggatttttaaaatattgaccttaaatcacatggcattattaaactcttttggtttcagtaacattcttgtatattgcttagaatttttctacatagactacgtcctttgtgaataaagataatcttattttatccttccaatttgtaaaccttttatagctttttctagccttaatgcacggctaaaactgctaatggaattgaatagcagtggttagagtggccatctttgcctggttcacacatacgtctttgaaacaattcttttacctgccattgcatttgttaaaaatctacaatattttcgactccattttttaagctatagcgattctacatgaaatacctcatctcttattttgtaacattaacacgtattaatttgacctaatcttattctaccttgcacgtgtagcttttagcagatattgcctcgtatcaaactcaatgagttttctgaagtttaatcaactgcactgccatggatttgagtataataacttctgttatggcttctgatccttccaactttgataatggggcattccgttgaaaagcccaaaccacaaacccaaatctcatccacgtttgtaggcttttccattttgtaacttagctttcttggatgatcacagcactgtcattggtaggggttcttgggctgccttgaaccctcgtctctagccactgccacacacagcactctaacttgcttttgatgttttccattattattattattattattattattattattattattattattattatttgagatggagtctcgctctgtcacccaggctggagtgcagtggcacgatctcagctcactgcaagctccgcctccctggttcacgccattctcctgcctcagcctccagagaagctgggaatacaggcgtccgccaccacgcctggctaatttttttgcatttttagtagagatggggtttcatcgtgttagccaggatgttctcgatttcctgacctagtgatctccccgcgtcagcctcccaaaaataaaacattaccagtttgcctacaacctctctctagatagttttccatttccagtgttctcttccttaatccctcaatgaagtgctcaacattctccatgatttcttctctatatctgttatcctctctctaccatgtttatctctgtattttctattaaattcaggttgaatctgtttcctcagatctctgaagctttattttattctctttttctaattcatctattatttctgaactagtgttagctttatttctaatttggtttcttaggtgtctaatcttccttttaatctcactcatttcctttgaaatattactttcatcttatatttcacagaatttacacagctcttaatttttacagacttataaagctttacttcagctttaaaaaatctgcatttggcatgtgttttctccctatttccttcttcgcttcctttagggctgggatgtgaatactttgccttctcttgctgtctctcttgcttttagttcccttaatgggacagagatgggggctagacatatttactactgatttttacctctgttatcgtttatatttattcactaaaaatccttacaagaagttagctctacccagaaggtacactccaattggtaattcctccaatccgtatttctcgatgagatttttggtaatcatacaaatgatttctcctcatttgagaaaatagttgtagttttgtttttctagttcctgaggaacaactacttggaactcaggatgtggacaaccgtatctagtcatctttcctttctgcctacccacttcttccaaattgacacatatcaatgagaattttcagagatttttttacccatctccagagaagcactctggaagcattagggtagctactaagtatttctgtttagaaactttttttaaccttccaacaaagttcttaacattttatagtatgaagctgttggttttttgctaacttgaacatttctgctgtttcttttcttaaaccctctttacatagttttattcaccttcttagggtcagaggtagggggtactgcaaatatttttctagaaggagaatgatttaagtagcaatatttggaaagacatccaagaagaatggtttcttagccaaatcacagaactcctcaggtttctgggcttctagaactgctgaaaggtgcagagccccagtgtgctatactcctttatttttgaaagtcatgagtttcatgttttatgaggattggagctgctgagctgaagatctattaacactagtgaagtgttgctccagaacaaatgaactcaaccatctgaaccctgctaggagaaactctgtagaaagggaagctggtttggtgcccccacgtccacaagtgtaagatagggcaaactttctgattagggtagggttagaaatatagtttttcatctcctacactcacattaatttttgcaaactaaagtccctccatgtatatttctgctatgccttctctcatgttctttgtgtggataatgtagaagaggcatggcctttagtctcctggaagctctcatttgcctcttttgatggtttttgtggccttggccctagggaatagctgactttgtcttatttatgaccgtgtcaagattgtggctaataatgaaatacatgttctcctaataagtgaagtcatgggaaagaaaatgtgtgttttggatagtcaaggagcaaacatgtgtgtcctgtgagctagatacgtggtggtcttttaactactcccacttgaattcattattataattaaaagtgctaactgcaagggatactgtgtcttatattctgatcgttacccttaatataaaaataaagcacatctttgctataggcagttctgtatgacatgcattttgataatatcactatgcaaatgttacctgctataatataaaatgttcatccaaatattactatgataggtttgataggattcacgtctcttaaggcagaccagaaaaaaatagttggctctaagtggttgagaaatacaagtacacaaaaatttataatataaagaaaaaaataatttgtttcatgtgctcagatgaaagtcatactcttttcttagaagagcaaaagaacgtgtttgtgtttggtggtggcatgttttgatgggggtactttaacaaggaaattttagtgacaaggatagctttattaattgagcagtcatataacaaacagtcatatgacatccatgctatctcctgactacagctttatcaagaagctccttaagcttgcctacattggctgctgttttatccactaataattctcaacacagtcattgcaaatattacaaagcagaaccctgctggtttgaatctgtggcttgaaaaactagctgcatttgcactcagtattctctcttcaaatcctgcggcatgatttatgtacctatgatgcttagtattccattcctcttagtagtttcctttcaagatgaagtattcaatccttttaccattgaagtcattagataatttcttggtgactattagggcaggttactgaatgggccctagggaaacgctaacatggcaattctttattcttgttttttaaacctaattgatgctgtttatctacttaaaaaaaattacagacccaagtctgtttgtgtaatcaactagaaactcttcatgaggagaaaaattaacatttggcagacaagtttattgtgataattctggaagcacgacagaaaagccactgttctggaataatagcagtgatgtcggcaaagtgtgactggccagcttccaaataagcatcactttttcctctccacgtgaattcaccagacactttgaatagtctcaaacaacgttatcttcaacagttcctctctcagcacagagagcttcaactaaaacgttttaaaatggaactgttttcatgattcagtttatagatttattttttcttacctcaaaatatgggtcagaaagtattgcttgtgtgtgtgtgtgtgcttgtgtgtgtgtgcttgcacgctcacaagcatgcctgctttcctccaggaggctctcagcctgaaggagccagcgaaaaacttacgtttgaggagtttcatttatgcttcatctttttaaattatcttaaaaacgagaagatagaaaccctccactaagttgccaagcatgccagtggagtgggtcagctttctcagtagggagcagcacctcgccgaggtaggcagtgttttgctttctcagaacatccagcatggtttgggtggcttactgagagcatgacagtgatgacaccaaggcagtcctgtaccttttgttgaaagatagagtttcctttaagaattcggctttctacagtgacaggacctggtcactgatcttcccattgcatgaggctctcacacagtgaaatacctgctggcttccatttgccaagtgtcctggaacctcaggaagagaggacaatggcagctgcagagaaggttatatgtgcacaggtcacaggacacatatcaggaagcttttgatctcttgtgctctcccaaatgaaaacttctctagaacttcatttctcaacctagggtaaaaggtgagatgggttggatgctgacttgaagtaactgtaaagagacttagagcctgttcacattctcacactttgaagtatgggcagaaaatatttgtagtgtatgtaaaataacccattttctcaatgagaaaagagggagaataattccttttatattactgatgaaaaaaagctttaataaggatctttggtgaaatatgcacctataatgtaaacaaccaatcacagaaagtgtaagactattgctgattccctactgtaaataaaatgtgctacgtatgcagaaaaattaaaaagaataaaataacaaataatgccaggtgcttgaaaaagttttgggagaaaggggagaaaggaagtaagactgcgcacacacatgcacacatggtgacacaacacacgcactctcatacagtgacatacccagtcacatgcatacatggtgacatgacacacatacttacactcacatgcatggtaacaaaacacacacacacactcccgtatgtagtgacgtacacatatgcatgcatacatggtaacatggagcacaccgaaacatgagacaacaaacacattcacaaacatggcgacatacacatgcatacatggtgacacggcacacatacataacacacacgtttccatagtggcatacacatatgcatgcatacatggtgacatggcacacacgcacacggtgacacaacacacacacaaacatgctgacatggcacacacacacaaggtgaaacaacacacaagcatggtgacatggcacacacacatctgtagcaaactgaggacattgaggggaaaaagggattctatggaaggaaaaagaaagaaagaaaagacatttatcaggtacaatgttaaaatttatgccaaatgtttatttaaaaaaactttttgtaagagtcccttatgaattctcatgaaaaagtcacaaaaactattaaaacgcataaaatgcaagacccaaagactccagggcaaagttagttttacagatcatcctttgaaagggtttagcatgctgtctataggtgacctgctgccatctgtaaggattatcctcctttccaacctagggcccagaggtgttgaggcacacttgatatcattggccacattatctaaaacctcaggaaatgattgctatgtgttttgttggaagagtttcctacaaaacagctctcagttagttcccctttaatatctagcacctactttctaccttgtgcttgggggaaactctgggggcaattcacagactacctctattctaggaatcatgctttgtggttctagtcctcatttacatcaactctgctaatgcttcctcaacattttcccccaagaaaacccacagctggtcaattaaatcttgacgacataatgctaagtgtaagaagccagtcacaaaaggtcacacattgtatgattaagtttgtatgaagtgttcagaatacatatatccacagagactaaaagcaattgagtgcttgccagggactgcccgtgatggaagtgaggggctggggaatggtaatgattgctgaaagatacagggtttgggaggatagataaaaagccctaaaattaataaaggaggtgattgcacacctctgtgaatatattaaaaaccatcgaattgtgcactatacagaggcaaatcttacggtatgagaagtatatctcaataaagctattattaaaattctaaatggagactttctcacttatatgcattattctctttatataaaccagattcaaacattggccatctcacagcagatgtccactggaaccatagatgaggtgggaaaatcgatctaatggtcagacctcaaaattttggccatacaattatttgttcactggaggggttggacctagtggtcctgagttgaaaaaagcgggaggttatgttgagtctggcatgtgcagggcacagggatggacctggattgaggctgaaaaaaatgctaaggaaggtaaacgcaagtggaaatagataggttgatgccaggataggttgaaaaaaagttctgaagaaggtaaaggcaagtggaaacaggtagggtgatgccaggatgggaaggtctcaaacacctggcagaggaggctgtgtgtataaatgctcaaagggaatgagggaacagtacgtactcagtaaaatcagcaggagaggagcaacttgaccataatagtattgaacaaagatgtaccactaaccgttctggtacttgaagctttggtgcaaatcaggaacaccaaggagacaaataatagtgtttggtaaaacaaacaaaacagaacaacaataacaacaacaaaaacaaaccctaatatatggaatgtagaagagagtagtgcaaatacatatagaagaaaatgcaaggtttcctggcctagagtatcagcatgctatagattgaatcgtgtccccctccaaaattcatgtgttaaagtgctaagcccccaatgtgatatctggaggtggggcatttaggaggtgattagctttacatgacgttagaaggtggagactctcatgatggcattagtccctttataagaagagatgctagagaggctgcttcctcattctcctccatgagaggacacggtgaggaggcagctgtctccaaaccaagaagagagccttccccagggaactaaactggctgcaccttagtgttggacgcacagggctccagaactgcgaggaataaattcttgttgtttaagccacccaatccatggtattttgttatggcagcctgagctgactaacacataacatttatatagtttcagttttttctttagttttaaaccttagaacctaacctgttctagtgaacaattctttttccaatacttatacaccatgcagtatttaaaacacttaaaactttcacttcttatctctgaaggggcattgttggagcctaaagagagttatcaacatcaaaagttatttgtaaaataaatgagtgtagagaaatgtttgacatttgaaaaatacagggcaaaaccttaagtttatcatttctgagctggctgactgtttttgtcatatttaactttgctgagcctcaggattgtaagaacattaaataaagaacaatacacggataacaagtcataaatcaaaccagaatcaagactgtaatggagggacaagttctgagaatggtttgatatttcaatgtagagacaataaaggcctaagttgaggtggtagtagcagcagtgattacaatgaggacagaataaacataaaaaaagtaagcaggatatctttctggcaatctcaaaattgagctgtttaagtaaaaatccaagagttatatttggtattttttttgcatattttccctattcatctgtactcccttacattgcattctacttgtcaacagtaagcctgtgtttacattcaggtactctgttttctttgaacgaaagccaaaggtactctaatcatcacatttatgcagtgtagtaaggtgcctaattgtttcctaaacaaaaagtatctaaactatcatactagtagaaaaagagaaaaataaacgttaagcctggattgaatgatttgttttatggatgtgtctgccttttatagataatagcaattcttcacatttgctttacatttggccttgcagtttttgaagcaaattattcacttttatcctttcaacagtcctagaaagtagaaagagaagcgatgatcccccatattgctgagtggtaattacacaattctgctatgcataagatgttttgtcatataaacagacatgttttctatattatcaaggtcatagaccctgacctaggcattgaatagttttgtggtacttgggattgaagattctttagagttgctcttctcctttgcttatgacaccctccctctatatattaagataaattagccatgtttctcattccctgccaaacactgaaacagaagctcctgtatccatctgccctgaactgcaccactgccctaatattagctatgtccttgactttgacttccccatccacccctcaaccacttctgggagcctctgcagctgctggagtatgtcttcattcctatcttcaactctccttcaacttatcacaggtcctgctaattttgccttccgaatatatctcataatttcctgttggtctacatcatcactagcaccagtttagcacaagctaccagctaccacggcaccctttaacggacttcttatctccattctcctttcgcacctgcagcaatctgttttccaagttacaaaggaaaaaagaacaattttattatagcctatgtagcgtatcaatgtcacgtcatagtttgtgtttctagatctctcccccagccctcctgcccttagtttgttcttagcccaccaaagcttttctttgttctcttcagcgagttgctcattttataaaatggctttgaatgttttgttcttctgtcctggaattttatatattgagagagagatatacatattttatatatagagagagattttagatatacaggaattttatatacatagagagagatgatatatatagagaaattatatatatctatcatatataatatatattatatattttatatatatataaaattttatatagaattttacatagaattttatatagagagaattatatatatagaattatatatagagatatgatatatatagggatatatattataatatctatcatatatacatatataatatatatgatacataaaataatatatacattatatctctatcggattttatcatttatatggtcaggtaactatacataatagttcttaagttactgtagaaataatgctcagggaattttagaaataattctactttgttgaaggaatccaacaatgtagttagaaattaaagtgaagaaagaaattacaatatacaattagtttatcattataaacatgtgctacctatttatttatcttggataatgggacagagtttcaacataaggcatttgaattagagacagattctctctctctctctcgttctctctccaaccttgtttcaacacactacaatttatatagttattctctaatcatttttatatgttcaagccagaagaaattttccagtgaaggatttccttataatctgcactacatcaagaatactcactttgatgctttcatagtgcctaagtaatttttctttatagcatttatcactgctgcatttttatatttctttatgtaatcattaattaatctctctgactaattgtgaatttcatgagttctactttgactcaccgttagatgcagaaaacccattagagttcttggcaggcaacagatgctcatcaaatacttgtgagcaaaaaggagaatggaaaacagaaggtaatgtaaaaatgacaaaagaagaacaaaaaggaggcaaggatggaggagaaacgaagctgaagaatgtctttaaaatgaagtattaacacatctgaatgctgtaaagtgtgacatttaatgaactatatattgattccgtaggtataaaacactagaaaaaaaatgaaatagacataaagcctgccttccatggtttgatgtcagagacagtgataaacaaacaaatataaaaccaaatgggaactattttagtaacagcacacatggacacacacccacatatgaattaaaggaactctcttatcaagctggaaggagcaaaacagtctaaaaagaatttttcttttttttttggccacttctgtaatcccagtgctttaggaggctgaggcgtgtagatcacatgaggccgggagttcgaggtcagcctggccaacctggtgaaaccctgtctctaatgaaaatacaaaaattagccaggtgtggtggcacgcacctgtagtcccaactacttgggagggtgaggcatgagaataacctgaacccaagaggtggaggttgcagtgagccaagatcatgtgactgcattccagcctgggcaacagagcaagactctgtctcaacaacaaaaaaaaagaatttgttaacaaaactaaaaactatcacatttttattatcatttatatggccaggtaactacacatgatagttcttgagttactgtagaattaatgttcagtgaatttcagcaataattctgctttttgatggaatctaacattatattcagaaattaagtgaagaaataaattacaatatgcatttacattactactaaaaacatgtgctacctatttatttatcagggaaatggatacctttcaacagaaggcatccaaataagataaaaatgtcttcaaggaccctgttgttaaacacatgtgctaatttcaaaataaatatctacaggaaagttgtctctcgtcttacctttgagcaagttacctttaacctgtatgtagcaagggtgtggtttttgctatcaatgtttcctcagtcactgcccagtaactgaaattctgtcattgtaaaaagtttacaaacagtaatatttgacaaacaaatagattgtacttaactacataaaccaaaccagccaaccttaccagctatgctaagagttgtgtgctgccgactctcaacctcacccacagaacaacagggacctgcccaagatggttcattgtttgcccagatcacagtgaggttcgtgactctattcctccctcaggtagcctcacatctggtcatctgcgcaagtttctttttctgtcaatgtactttcccttcttgatatggccaagatcaaccacaacgcaagttctattgaatctggctctgggagctgtctttgcagggctttccctggacacatggcactgttgctttcctgagtccagctgctgacgtgaacacccgagaaggtagcttgaccttactctgcagatgcatgaagggcgaagttgacaccttctgcccatttttgataaacaatgaaatattaaacattttttaactttgttgaaatttaaaatggatgtgcctaacaacgaattaaaataataattaaagtagtaattccgccctgtttatttttagactagtcatcctcactccctctatatacctatcactattctagaatttcatgagtctagacttcgcttctggcattggccccaaaatgccaaatttgaggagcacagataatttttttcacactatgaaaactgcaataagttctcttaatcatcgtccttctttaatgataatgtatctacaaaagataatatcttactaggaagttaggaggatcaaacaacataactatctacaagaacccagacactcagtggatttttgctggatttgaaatttattagtttctgtaactacttatttctttaaatgaagctttatgctaagtaatatgtgtataaatattataaaatgcataattattttaaatgtttatttaaatatgtaatagattaaatatgtaaaatatatacaatgcataataaatgcaatagaaatgctcatttaattttaaaaatagattgctgtttcccaaattaattgcaagtttttattaacagggcagatttagaaccatatttctagaatattagcgataacagcttgtaatttgttttagtactcttcaagtactttaatcttagcaatgtatgcaaatgatgtgaataaaacaatatgacattaacatgatttaaatatatttcacaaatcatagataccttgcacagtatttggtaaaaggacaactatgaatatacacagcagtgtatgtagaatcagacctgttcttaggaatttcttcagatctaattgtgttctgcaaaaatgcatgctgtgcttctggacattccgctgattttcaaaaatacatgttatgttatcactaatattttacaaggaaaattcgaccgaaaaagtaatatgaatcaaaaatctgaaagcaccgggtcacttaattcaacctcgtatctttccctactaatgttactgttcaatacaagtgcactttctggtgaatttccttcaccctttgaaactacattgagtgacgtaccatgttctcatcatcgtaccttcacacttgatgacactgggcagatgcattaaattatagagagggaggaaggagaaatggaaattggaactgctgatggtgagccagcttgatagggggccaccacattctaagatagtttttgtgtttgtttttgtgacagagtcttcctctgttgccaggctggagtgcagtggcatgatcttggctcactgcaacctctgcctcccaggttcaagtgactctcccgcctcagcctcccgagtagctgggattacaggtgaggcccaccacacccagctattttttgtatttttagtagagacgaggtttcaccatgttggccaggatggtcttgatctcttgacttcaggtgatccacccgccttggcctcccaaagtgttgggattataagtgtgagccactgtacccaaccctaagatagttttcaatgtgatatgataagcacacacacacacacacaaacccctaatctatctatattgatgtgtgtgtgtgtgtgtgtgtgtgtgagagagagagagagagagagagagagaatgagaaagtcatgcaacctctggaaacctccttgttttttaaattcagaaaaattaacttgcattatggctacgtaatgaaaaataattaatgtctctcctgattaacgaagatgaaagcaaacaatttttgacataggcatgaatggccaacaatacttcttgagaaggtaatctatttttggcaattgcattttctgtaggaaatgagagaggtcatttgaaaataagaccctagatatcgatatgaataaatccagtctgcttggcttttaacttctactttgtatcgttacatttgaaaagaggtagtacaatatctgatataagtggtgttgaaaccaccaatatggtttgctaatttcagtgggcattcttgctgtctcttcagtatctatttccctctttccatcatctttacaaaaccccagcttttccagtcactggactttggtgaaatgaaaccacaaatggtgagcacaaatgatgtctcaatacgttgttaggtaagccaagatctttcctttgttgtttacgccaatgttagttgtgctttctggtgcttgctattgaaaatacgacgagtggaactcgagcctggtaaatattactctgtggcttcactatgtgcttggttgctggcacgtcaatcctgctctcatacatccccccttttcctcatacaaaataacccgactttaaggcagaattaacaaaaaagaagcctagacctattgtgaaaaattagcatcctctgaaaagataaagaggtatttaccccatgttatctaaataattttaagaaagtcataaaacctctgataacctccattttctcctccgtaaggtgaggaaggtaactctgcagaaaaaaatgctcagaacaaatgttcagagtaagccctacctcgtgcttggtcactaggaagtgttgatttattttctttgctttcttgtgtttctgtggaaagcgttattaatacgcttgaaaggtttatgtcattttattggataaatttgttgttgttattttgagacagggtctcactctgtcacccaggctgaagtgctgtggggtgatctcagctcactgcaacctccgcctcctgggctcaagcaattctcatgcctcagcctcccaagtatctggataactgggactacaggcacacaccaccatgcctggctaaatttttgaattgtttttgtagagatgggatttcactatgttgcccaggctggtctcaaactcctggggctaaagcaatccacctgccttagcctcccaaagttctaggaatacaagcacaagccactgtgcttagactgaaaaatgctttttttgattagtcagaatgctgtatttaaattacttgttgtgtatctgtgtcctcaggtatgcatttagtaattttcaaatttcgatgatttgctatgaattttttttcataggaataatatttctatatgaaaaatagaataatatgaaagatacaggaaaaagaatgtttttcattagcatcagaaaaaaatccaattagaacagttgttttaaaaacagataagataatacataaatgtatgatgcagtctgaacactctaaggacataggcttcttaaaggtatttatttgtaattttggattttaggatattacagatcacaatagtgtacagcttcttaccttggaaaaatgatactctaattctatattatttgtccaatattacgttgctgtcttagcttgaaaaaatagtttaaatccttcagtaagtatatacgaagcaacattatatataagaatatgatttcacattaaactaaatacactgaaatgtttttatccaaagactactaaatagtgactacatattttcttaatattttaataactttggaacatttttagagaaatgtttctctcatttctttaggagcaataagtatcttcatatatatatatatatatatatatatatatatatatatagtcacacataaacacatccaaattatctcacttcttgtgaaatataagtattagaatagtccaatgtcattgtggcatagaatttagaaattaagagaagtttcaatttgtactattatttacatgtaacttatgaattagtatggtcagttctgatctgttaatgtttttacaaattttacttattctaagggtaatatgttcatgaaacaacttagtattaccatgaagagtctaatgatctcaatttccttttcagaaagatatgttaaaagtaattaagataaaaagaaaagcaaaatccaaagtacatttaatagtaaatgcatttccaactaggtacacaggcccatttggagtggttctccaagccgaaaccctcttgctctccttttctgagacctgtccttacatttacacactcattatatcctgaaggacacacttgattaagggaagtctatcagactccactcctgcacaagtagagtggacaacaggggaggctatcccatctctgtaagggattgtgccaggacagtaaattagcacctagaggcacgttctattgtgaatcactgttggtagtggagccagaaaacctttcatcagacagttgaggaaatgacgaggaacctcgcagagaaggcggccctggagtgtggggactcccagccagtccagtggctctgtttccttggggtcccaccaggggtcctgatttactggtagtaaatttcccatttttgcacaattagctcagacatacatctatgaaacttttctaggcactaaggctacaagaaaaaatggcagtaaaaataagaacaagtagacaattactccttggaatatgaatctgttcatttggatcactaattgtcaagaactttataggaaaggactaattagatatgtgagcagcatgtcatatacaagaagagtttttaatcaaaagatatttatcacagtgaaatctgagaaaatattcagtatcactgactgagtattgctcaagtgaatggttgtacatcagtatgatggcattttacaatttttgtaagtttagaagaacatttaaaaatccagggaattttgtacaagtgaaaaagcatattacataaaatgataatgatttcatatacacacgtcaatagacaaggaatgcaaaaaccttaaataccataaggttatttatgaataaggacacgagaagttcagtggattttcttctttatacttcggacaactttctacaataagtgtgcattgatttttaatcgtgcaaaaaataggagcgcagacttggtaaaaatcggttttctgtttgtccaacaacatataacctaccttcttgattctcaaaatgaactctatgaagaaacttactcatcaaatttcaatactttccaaaccttaaagctcgcatcttgctttttgaaatggataattttttggtttgttttgagacggggtcttgctggatcaccccggctggagagagatttactttcaaataaatctctgttttcaaaaaaacatagagattttcaaatctaggctttgccactttcatactgggtgctttggccctgttagcctgtctgaaccctcttttgaaaattaggaatgatattaattgaatgtaaggattataaggcaattaagtgaaataatacatgtgaaacatcatacatacgctttccctgtctcagggaatgaaggatagctgtaaaaatattttgaactataaataattaatcataaatttcaactgatttgattttgcaattttaattattgagaacagtaagtaaaaaagagatagcttattcatgttaaagaatataatagacaaacctgtgctactctttcttcttctactaatcaatcacttactcaacaaaactgtaaaattcactaataatcttgccttttacatttgctcccaattgctgaaatggaagcctattttaatgatagtaagaaaaaaagtgacactaacatagaacaacgggactcagaaatcaaatatagcagcttccaacatgattcttctgacccttacccagttatcgagcaactccaacatatttactgccttctattattatgaagattcaactcataaaggcaatggaaataatcattgtatgttgtaaacaaacataatggacaagaaagggcacaaggaatctcaaatgagaataatggccgtaaacaaagtgctgcatgggagaaaataaacacaagtacaggtctacttaccacatgcatcatatcaaaaacttaatcatggccaggcgtgttggctcatgcctgtaatcccagcactttgggaggctgaggcaggcagatcaccttaggtcaggagttcgagaccagcctggccaacatggcaaaaccccatctctactaaaaatacaaaatactagctgagtgtggtggcacgtgcctgtaatcccagctacccgggaggctgaggcaggagaatcgcttagaactcaggaggcggaggttgcagtgagtcgagatcacaccactgcactgcagcctgggtgacagaatgagactccttctttaaaagaaaaaaagaaagaaagaaagaaagaaagaaaaacgtaagcacaccatcacaccatgtacttcacagagaaacttcacaggaaacaaaatcaattaaatttgaaaattgagtacaaggaagtgaaacggtaaaataaattctgaacattctttttaagaaattacgtttcaaatctgttggtgagaaaaaaatatttattaggtcggtgcaaaagtaattggagtttttgccattactttcaatttgccatgactcatatttataggtttgctaaaagagaggttgatttccctttgggccatggccaccttgattctcaaaatgaactctatgaagaaacttactggatcatctttaaaagcactgacgttgttataaacacaaataaaaacggcaaagactgctgattttaaaaccttattttctcaatttaattccacagttgttttatgaagggaggtaattggcagttttatcttgtcttggatgactctggttgtgtcattcactttttcgttacagaagctgtgtcagaaaatttgagatgccaaattatgtgctattccctacactcaagaagagaagcagtgcaaggaacgtacccttctttcacctttggagttagtaaggcttttctttcggagctgtcttggattttcctcttgccaagcacgagagtgaaggaatgctttcttttcaacggcccattaaaacgaacatatatgcaatcatgccattcctgattgattggattcaggacaccctaaccctaaatatggcactctgacatttgagaaaactgcagaggcaggaaggccactgtcacctgcccttgctcttctcccccgatgtaggccataagtaggccttgtgcgagagggggcctccccatacctagagaaaagaaataacctgtctctgaaaacacgggagcacagcgaagaacctgagcaaacagcccctgctacatccctgctgatttataagcattagatcacaagtccttcgtccagtctcacgtcccgacgtctggctacctcttcatcaaagccataagtgaaatatacaagttgacctgttgctctgggttttcatttccttacgaaggctcatattacataaatttgtaggcttttaactattttgtcatgggggcctcagccatgaacctaagatcagaagaaaagatccttctccttcgcttcagagacccatttgaaaggttagaaccatgaaagcctcaagatgcaatgagctgcagggagagaaggaaggaggcaaaccctgagcaggcgatggcccaagaccagacagaggtggatttcctggtgctggaagaatggagacgcacttggaagtggaggagacacgtctccagtcctgaacggcacacagggaggtggcaagaccactcatgatgctggcacatggcaccagccagcgaactccatgcacccatggcagatgtcttctgaggctgagcttcaggcgagccggcccctgtgcaggctaactctgtggtcgataaaagctgccatagcacacagaccatgggccagggaagagcaccgctgccagccagagaggcaggggtcttagtgtgagcatcagagccaaggaagaggctttctgatgactgcatctccaggcccctggtagccacaggatgctggcactatcagatgaaggaggacaaggagccttactgaggacagaggatgatgtgtgaagacagatgcatagatggagaagagccagatcgaacaggactaaagtacattaagtaacgtgatatagcttacaaatgtcataaaaatacgtactagagtggaaagaaaatgaaaaactttcaatgttgataatttagtcaacactaagtccacctgatcaatttagaagcaaattgtagaagagatgccagaagacacgatctctgggaaggtttcttggtttatttgggaaataagaaattgcagaaattttataggagcatcacaagaatttaacaagaaaggtagttactctgtattttcccggtgaattatgaagtgttactcacagctaaatccgtgaaggcttaaaatgagctgccgctgtttttgatctttcaagatagctaaacagaaagagtcacctcccctttccacactaggttcttcttctatttctggttccctccttttgtcaccctccttcactaatgatttcagggaatgcatgcacagacagatacacacaaacacacatacatacatacacacacacacacacacacacacactcatctcctgcatgcctgtgtcaggagccaatctggataacgacatgtcatatgtgaattgtgatggttgatctttcacatcctagacatttaactctatctgtagcatctttcactgcttcttgattctatctggtgtgtatttcaagtacctacactgttccatttttagatgatatctaattgattgccctatggctcagttcactctcttacccagttttaaagctttctacattcatgtagaaattggaggattgtatgaggtatttgattctaaggttctaaggtatttgattctaggagttttttgtgagtgtacgagagtcaagattctttgggttttaaatatcaatccttatatcttacgtcttagcttcagatacaaatttcaatatgtatattgatctaacataatgaatctatgtcaaaaaactgaaaaagcatgggcttgggatgcaggtcaagtcaccagaactaaaaagctgtaagtgcccaaaataatggactatcaggttgagcgtggcctaattaatgctctgacacctgctataccaaaccaagaagggtgagccatctccccgggtccctgctgccagcaggcgtaagcacttgtatggtgataataagcaaaatgcattgaacttcattagaataccaaggaaaattctccaaaatggctcttaattaaatggtctcccactaagcagcagtcagagagtgaacactccctatattttattcaactgaatgtcatgttgacttcagagccatttgggggggtctttacctaagaacaatgcttcctatttacatagttattttcatatgagattcgtgtagcactccacaaatgtcatctcattacctcatgcagtgagtcaattacagcactgcggagataacccaagactcaaaactccccgtgctttgtgagaacagctctgtaaacatcgcaagtggtctgatgtgatgcctgttgtagacaggggaaatgaagattgacataaattctataactcacgtcagtgtgctaacagcacaagaatgtgattgtccattaaagcattcactttcttatttttcaagaaatggccattttccaattctggtatcaattacccagaggaagttatagaactaaattgtctgttcatatgaatacaatcttctgctgtccacataataacttgctttattcaagagtgaatacatttgcacctgtattgataaatttgttctcaacccaacaggtaacttagtgatcatataatgcctgaattcagcaaaggtaacaggccccaaatctggaaatttcaataggtttattcttttgtgttcagatcctactgtgaggtgattttgcatgtattaaaccaagcgtaacagtatggaaacaaagttcaccagctccctaattttggatatgtaggaaggtatatttgggttttgctagtcaaatacttgatcttcataatgctcatttccagaatgattttttccacattgtagagtcatatttgtcatctaaaattgtctatatgtttcataagaaataagaaaacatgatttaatgggtatgcatttatattagaaggatttgtggggaaaaaagggttttctttatgacgtatttcttggataacttctcagagaagttttaaagtatcataaggattattaagaatattcaagttacaatacatttttgaaaagctgaataacacagttcagtaagatcttttctagttcagaggacagaaaaggtgtaagacaaagactgtatctgaggcacccaagtaatcttttttttgcgaaatgcctttgctttggttcctggccaaatgaactgcagatcgtctttggctgcagttatttctgtacctgatgacctcttctattaaaatgatggtggtttaggctaactccatatggaatttatctatggggtcacaaaagtccctttctggtgcctttaatactagactcattgtatgtttatatgaatgattaaaactactatggaggtaagaaggaaagcctgttttaatacacagctacaaatgttatcactttctcccctgcaggaagtgggctgtattactgccgtaagcgtagtgctaaagaatcgtaatttaaaaataaataaataaagcaatgggtttagagaagagaatgggtttgaagcattggtaacattatacggagaagagttacaaagccttctataatttgtttttctatttcaacaaattcatgatattgtgaaagacttattacaatgctcataatttaagattaccctcacagtgttatttacatgtcagtgcagttttttctctttgcatgattttaggctgtgaaaatttctagaccaacaagtcttaatgaaatttcccttgctttcaatcctgaagaggacgacctaacagtttagtgactaatttaagtaaaaagcagtggaaaaaattaaaacagctacttcccttcacctatagttttgaatgagtaaatgggggaatgttgctaacacattcaaaatttcagaatattcaacagccaaaaaagaagaaagttgcagaatttaaggaaatatcaaaatttgtattttaaaagttttactgggtaatataaattatgatatttgagtggtatttcctggaaaatctatctgtcatgacacatcgcacttcagaaaaaggatgaattctaaaatattatattttagcaaaaagcatgcttgttcctcagtcatgtgaatacagttattcacacaatccttttgtgaaataatctcagcatttcagcaggattttatgaattgaatcattatactgcagttgtttcacagggatctgaaatcttgatattattattttatttttgagacagaatctcactctgtcaccaggctggagttcactggtgcgatctcggctcactgcaacctcttcctgccgggttcaagcaattctgctgcctcagcctcctgagcagctgggactataggtgcatgtcaccatgcccggctaatttttctatttttagtagaggtggggtttcaccatgttggccaggctggtcttgctctcttgagctcatgatctgcctgccgtggcctcccaaagtgctgggattacaggcatgagccaccgtgactggccaaaattatttttacgccgtgctttgaaacatgcacctttaaaatggtacctgggtatttttaaatggattttccccatctttatgacagaatgaaatagcagaggacattttaactgcaagggaaggaagtgaaggaatcaaagaatgttacccaaagaaactgcaaatcagcagcaaactcctagggatgggctggtgagcagaaattaaatgggaaagccaacctgtcagcagaatgaataggtggagagtgtgaatttcagctgtaagccttagtttaattttctttcctgataacctctaccacaggctgttatttcaaagtcactgggcccactcacctagatagacacctattactaaagcaaccaccttcttgcaacatattgagtaattatattcatcttgataacatccttcttgacaattttatcattgatggaactctccgcctgtgaaggttatttgtatttttccccgcttctgaccttatgtcccatgaaaagggttctatagagcaaataccatttgttatgttatcttgggaaatggccacacttctccttccaggaactgtggcaaaaattattttctgcactccatctatgcctgtcatgtctgccttgatggagtgaaaggaacatctacctgcctgccttaactacgcttattttcaacccaatttcctgaaggtccaggtacactacattgggaatctgtagctatctagcccagcagtggaatgctaaattttaacctttaaatcattgttcaaatctaaccacagcagataaagtcgaagaggttttaatgggccagtgttttcacacttctcaaacacactcctgtgatttggcaggtgccatgaactcagtttggggacattttctcctcactccctataactagtttatggcaaataaactgcagctctcgttttatgagctctcctctgtctcaatccatcttcagtgccctcttgtacagcagagctcagtcctactatcctgaattatgataatgcggggcacacaacctaccctacaaatgggacttgctgtatgctgaatacccctggcaccctggtactcagcccaggggctccacctgctgaaaacctgccccctgtcccttctggaaaccagcagcccctggcctgacctcacagggaaatcatggctacttaccgacctcactcaagtcctctgcaagccactcccaacagtcaagtcttaagatgtacgttttcttagttatgagaaagggagaaactcattaaaggaaatttaaaaacaaaaaaagaatgtattaaaaacaaagtaaaacaacaaaacgaaacaaaaaactgaggttctgcttcccaaacacatatcccggttgcttttcgtggccaggatttttaaagagtagaccgtccttgaagctcctggctatggtcgaccacatgggagttgaaggggttgataaaaagaaaatatctaagacataatgtctgagttaaggaacaaggagcagccacatgaagagggccgggaagactgtgagccatgggtgagagcgtttccaaggattctgcaggcaaagccatgtggggtccgtgaggctgcagcagacaaggactgaccaactgtcctggtttgccgatggtcaccattttataactgaaaagtcctgcagcctgcaaaccccccgataacgtgcaaatcaggatgatctcacatcatgcctaattctagttcctattgtttcttatacgggccctccctggaattctcaaatttttaaatttctaccatagcagtcatgaactactttctcatcatactgtgaggtgctagacaagactctatggtattcttctgacttaattgcttaaacactgaccagattcccagttttgcctcattgacagtgggccaatccccaagaggtcacctgccttatttctgccatggttcctggaacaaagctcatcatgggaaaacgtcaactcctgtccagaggccaatcttctctgggtgctgtgatactgactacactacacagctttcttctccacatcctctcggaagttcccagggcccactggaatcttctgagtgtcagggttgctctcccttcaagctcctcttaattccttaatttggccagtgtttcagtaatgaaatgtgagacaccatgctcaccccttgggtgacggccatgagcaagaaatgttctctgccaataacaagttcaaggttcatggagaggtagatagggaagaaggaatagcaaaaacatcataactttgtataatgtgatacagggatgcatggtgcatcttatgtgagtagagtggagaaaacagctggatggtaggaggacttcctggaggtgtgttctggctgtgtcagcctcaatattccaaacttgtttagctcttgaatctcattcttctctaactatgtggggacattagtcctatactgttcctcttttttcacttgagtctgcttctttaattttacatttttttattttaaatatgcatcaatcaaaacagcccattaggcagagtggtattgaggtaaaacaacgggatttttctccttccattttttcaaatgggtgatctttcattttagtattcattttctcaaaacttattctttcagagatgaggtctccctacgcttcccaggctggagtacactgactattcatagatgtgatcatagctcactacagccccaaattcctaggctcaagccattctcctgcctcagcctcctgagtagctgggaccacaggtgtgcacctccatgcctggccaggtcctattctttttaactcttctattttctaggttttcttttaacactaatatcacagtttgcagttattttcaaaggtcacaaatggtttctttattgtccatgtcatcacatacttcaaattcagggagactctgtgaaggaaagtcaatctcgggacccccaaatcactaagccaaagggaaaagtcaagctgggaactgcttagggcaaacctgcctcccatcctattccaaaaaaagacagcttctaagataaaaattgctacgtacctccctcacgatttgtccacgggaatttccttgtggacaaaagacagagctcaaagccttccttctgctctctgaaataaatgcgtatctgattgcttcctttgaaaagactaatcagaaactcaaaagaatgtaacagcttgtctcctatctacctatgacatggaagccccctccctgcttgaagttgtcctgcctttctggaccaaaccaaaaaccaaagtacttcttttttttattttttttatttttttgagacggagtctcgctctgtcgcccaggctagagtgcagtcgtgtgatcttgggtcactgcaacccctgcctcccggattcaagcgattctcctgcctcagccttccaagtagctggggctatctatatgcatgtgtcaccatgccaggctaattttttttgggggggtatttttagtagagacggggtttcaccatattagccaggatcgtcttgatctcctgacctcatgacctgcccacctcagccttccaaagtactaggattacagccgtgagtcaccgcgcccagcccaatgtacttcctagatacattgattgatgtctcatgtttccctacaatgtgtaacgtcaagctgtgcccaaccaccttgggcacatgtcatcaggacttcctgaggctgtgtcacgggactgcgcgtccttaaccttggcaaaataaactttctaaattgaccgagacctgtctcagatattctcgtttcatagctctcagccaaattttcatctttcagacattttactccaaaatccaatctatagccaaggaaacttctctaaagcactatgaacatacaggttctaggttcttgtacctttcacagcttacattaaaatacgaaggtattaaaataccacgtgattaagctccctttacttatctgtcatcttcccccttcccccttatgggaatgttcttaactaaccaagctggccaactcatcatcacttaagcctggggtctgaacttcgaccaccgtgacttatcaaatactcatttttgtacatggaatacacatactctttatttctcgaagttatttttgtcatttcccttcctatggaaagcttgcctgtcttctgaaggtttccctgagcactgcagttctaccaaaacctctctctctgaccctgtacagcctttatagtctgcactcctggcattgaaataacttcattcagcctacatccatgcttgagagtgaggactggcccctgttcacatgtgttatttacacgcatattactgaatttgaaaattgtaattagtcgcggatgaccagtgacatttgttaagatgttatgtggactcagttgttgcctctcctttatgatttatctcgataccctaaaataagttaaacgatttcattttttacagcagttttaagttcacagaaaaatgaagaggaagatacagaggtttctcatctgtcccctatcccccccaccacacagccttccccattctcaacatacgccaccaaagagagaggtgcatttgttagaacctatagacctaggttgatacatcattatcactcaaaggtcagtttacttcaggatttaccgttggtattttatgttctatgggtttagacaaatttattgtgatatgtatccccgatatagtatcatacagcctctagaatatttttacctgggcaatttaattttaaaataataaacagaggatcatctagactggtggcccaccactcttttgaacatgagaaaccctatgtatttgccaaatttaataacatttaaaattaccataggatctacatgaaagccggctgtggttagagacttgggttccggagggagaatgcctgtgtttaatcctggcttactgcacattagtcaggagactttgaggaacttacagaatctctatcttataaacatggattttaacggtatctggttcatgatcaatcaacagccttcaacaaggataatgccttgaagaattcagagaacagtttttgttacatgaaaatcattcaataaatgttttaaagccagtgcacatgtatgcatataggatatgttattttcagtctatggacatgacagatatgatagatacacataagaattcaatagttgcagaaaatcaaaagtactctgtgtccatttattgggatatttggtagcaataactttcaaagactcttagattattgtttagttcatctactataaactaaggcctacctctatagtatgaagaattttaactctttatcactgaaacatcctgcttctcctatttctctaaatcagagtcaattacatttgtttattaaagggaacagagggacgggaacttcagagatctgtagaggaaaacaggtcttaaacattatcctaccctggaagcccctaatatttggggaggctacagaatgatataggaataacagttaatttcccccgtattacccagatttattatccaaacaacgtatttcatacttttttcatttatctggtttctcttttattgttgtctttatccacagagaaggtatgacccatgaaggcaaggactttatctatttcactagtacccagaataatgcccagcacccaacatgggtgtccaatgactgaaggactgcatcagtgaatgtatgtttacacaaatttattaaatttcattccacaaaaatcacaaaatgtaagtagtgacagagctgtaaagctcttgaaactatgaattcaaaaaatcagggccaggttcagtggctcattcctgtaatcccagcactttaggaggccgagctgggtagatcatgaggtcagcagttcaagaccagcctgacgaacatggtgaaaccctgtctctactaaaaatacaaaaattatctgggcgtggtggtgcgtgcctgtaatcccagctactcaggaggctgacgcaggagaattgcttgaacccaggagggggaggttgcagtgagccgagatcgcgccactgcactacagcctgggcaacagaatgagactcagtctcaaaaaaataataataaaaataaaaaaatcagaaaaaatcattctacttatttttgattctagaacagaaccttgctgtaaaggcccttagaacatatagcaagacaagatgaaaacaagaggaccacctggacttagttatcattgcccttctcaccaaaagttgcattctgagaaatatttatgatgctttcatttctgcttgattttaagtggctactttacatgctagcaaattagtgtatttgggcatgctcatatttgcttacagaggcaagttcaatacgtaaaaaatttggcagctattaggtataacatattcctttggctttaggtggaattctatgtcctgtattgtttactcaattggggaatgtcgacgatagcaaaacaattgtagtattcaagtgactattgactagagttcagtcaataagttcaacattataaggccaaaggcaattaagcagggactgatattagttgctggttacacgatttccctggacagttttaattactggacatgagagttctgaaatatgtggattagttaataactcaaagtaaaaaaaggaaagcattactcatttggcattacaaactgtgataaaatacacacacattctcattctgtaagccataaacactaagccataatttcaaaattagtaaactgcttgatatttgtaatatcttacataatatgtaaaggaccatttttagtttaagaataacacagactgccaaccacgtttaaaacattggtcctgtcaagacaaatagtgatgcttaaatgtaagtattcattaccatctagatcttacatcgaacacttaatatgtccatagagaaataagattatataattggaagggttcatcaaaatattaagtgaagttcccaaacatgtcaaatataaatgaattcccaaatctgtgaacacttttgctttgaatactgggttttttttttttttttggaattgaacataatattatatgccacaactttctgcaccttcatctgtattaatgtaattaagtaagccctggttcttcatcagtattaaacattttagtcaacatgaagagctgtgtcgaatgctgtataaaggctcgtttcaaatgagtttttgatgaacaacggctcatggaacttaaagatgatgtcccaaaacagataaactggtgaatgcatcagagaaagaaggcaaaggtttctgaggacctccaaagctctgttctgcataaaacaggcttggtgtgattcgcaaactttcatgcttatgttctcataaggcagttgggatagaaaaccagctcaggtgtgtgttaggcctaaagaagtccacctacagggaagtttatttttgagacagggacagatttaaagataactgtttttatacaatggaaatgatagaaatttttttttttttggttctaaggagcaggaagtttaataggcaagaaggaagggagaagacaggaagacagaaggaagaagccctcctccctctgtacgggggagcattttccttccaccttctcccttccttcttacctactaaactctctgccccttaaaaaaaaaaattccaccatataaaaacaattcttgcttcttataacctgagactgatttagctttcaaccaggaaaatcctaaccaatagggttacttcaatacattttggcaatccaactcttaaacatgtgcataccctcccaacacacacacacacacacacacacacacacacacacaccaatttcaccgtcgaacgaacacgtcaggattatcactgccttgccatggtcatgctttgtgtctccactatctatgcctttcattaacttaaagcttgtccacagttttgggaaaaaatgtgctttgacgtagatgtcctgctagagtttgaggtcttcgctttctcattactcaatcatttacttggatgatgccagatttggaacaattaattccgtgtttcactctggacctctcaaagcctgctaagtatgtaaagttaatactcaaatgttttcctttgcttaaaggataactttcaaagagtttattcgcaattacactcctccttctataccaacagtacctctctgtttctagcagagtgctttacttctcttaatactgcataagaaaattgtttccaaaccttactcatctgagagtacccacaactcacaccttgtactgatcactctatcatcttttaatgcctgttctattgtcaagacccaggttcaatgtcatattctataaagttttccccaaatccatctgtgctaatgagaaagtcaaagctgtacatcgaacactcagcttatgttcttttctgtcttattaactcttctgtgtggatcctttctttctaatttaaccaataagaatataaacatcagagctcttggcatttatttgttgagatatgaaaccacaagccagataaaaatttagaacattttaaacaatgtcatcatccgtacatatgatttttaaaaatctcccagacaatttatgaggtgttaatttctactgtgattcatggaaagcagtgtttcatggttagtttgtcaggaaaggatatggtgcttgaactcacctaaagaatgaacaggtcttgccgatgcagagagtacaagtgagattgacaatactgcgagcaagaacaagagacaaagtttttcagatataatggaatcctttggaagattaaaatccctatctggatacacaagctaggattagaataagacaggcttggattctgtaattctctctcattataatacatggcttcaatttcttcatctcgctaatcttagaaagcttcacaaagagccatgaaggagaaaccactgagtccttttcctaatgagatgaaggagctcaccacagagtcatttttctaataagtggtgaactttttgtttaatttttatttttaactgacctttcaagacctattcagttcatgtttatgaaacaaaatcttgaaatcttagaaaaataataaaaccaagcaaaggaatcaaagaaagaacctcttgttttctagcaggaaaggtgaaactcaaattttgtgagtattataaaccaacgtgaatgttttaaaggattattttatcattaatctattatttataatacatattataaaaatattatttgttatcaacctgatcatttgctatactttgcttttacaagttttatacttataaacaggtaggtttactttgtgacacctcattgcttggaaacaacctgcatattctttaaatttaaaactataaaactatgcatgttacaatgaaaaggtgtctaatagagagacaagatatttcaaaggatgaaaaacttaagtgtgatttgcttaaggtctcaattagtgaaataattgggtatcattaacagaaacaactgactcaatctatcacaaaaaatgaaagtaactggacacataaagagaatatactatattctacctgtatatgatattcagaaactcacaaaattatatccataaagtcagcacattttattatatgcaacttacgctgcaataaaaatggttaacaaataaagggaaaggatatttctgtagaacggattagagcatgaaaaaaaggtaacagcaagaataggaagaaaggatgaagaacaatagacctacagtgctcctgttacatggagaacaaaaccagaagatttcagaggagcagagaacactgtggaaggtatcaagtaaccttcggtctcctgcatgtacatacttctaataataagtgagtttaggagctggggtttatcggtgaacgggaggcaaactagtgaacaaagtatgagtacataaaacatctgatagatgagttttattgaaattaagggtagagttaggatgaaaggtgaatgttgcaactccttcaaaaattcgttttttacacaaagctgtgggctcccccacagctaggggagagtccgtccgctgtgtgcccctagttcccgactgttctttgctcagagctctctcatcacttctcaggtctgcttccacctggcaaataccaatgataagtcaacttcgaaggctgcttttgagccatccttcctttgatgctttttttttttttaactctgcttaagaacttactactcctttgtttatcttgccaggcacctaacagagcacccaggatgcgttcccttactttgtcctgtgcctgaaccacagctggagagtctgatggggaggggccatgcacagtactcctcctccccgaccccagcacagaacacccaggccgcctcccagagggactgggaagcatcaatggtgggcatgggagggagcaatacagtactgattctcatttgagaatagctgttgatcacaagactctcaggttctgttccacagctgttgacagtatacaggagtttgaagtatgctaggtccacacatctcctctgtcaaacctttctccttaaaaaaaaaagtagagtggtgacaaatcataacattcctctttttctaaacacttttaagtgttactttcttcaaacaagttttagaaaaccttgggtggaagatttaatgaagatgcataatctcatatttactctggatgaagaatcccatgcaactccattaagaatcaacagatgcatcaatgatagactggataaagaacatgtggcacacgtacactgtggaatactatgcagccataaaaaggaatgagatcatgtcctttgcaggggcatggatggagctggaagccattatcctcagcaaactaactcaggaacagaaaaccaaacaccgcatcttctcacttataagtgggagctgaacaatgagaacacatggacacaggaaagggaacaacacatactggagcctgtcagggatgaggtgggcgaaggtagagcactaggaaaaatagctaatgaatgctgggcttaatacctaggtgatgggttgacaggtgcagcaaaccactatggtacatgtttacctttggaacaaacctgtgcatgtacccaataacttaaaataaaaataaaaataaaaaatcaacaggttgccttgcttctgagacctgcatggccatgggcctctgactggattaggaatctttgctaaactgaccctcctgctctccgaagtagcaattccaagaattgacttttgaacaacagttttgaaaacaaccttgagtaagatgacatcttgaagttcactctggaacattctaaatagtccccttcagtcaaaatgttgctgctgtttttaataacagggaaaataaaaatatttaccagcttaaaaaataaaaagacattcatgaattataaatcatctgaaaggttccgtaggagaacacactgccctttacaaaatgaacctcattaccagtccagaacacactgagaatcacaaataaacgtttccaagaaacatttttaataaccactaatacaaccgtatttctattgctaagtacaaaaattctaccgtgtagagtttcttgtctattctgtggaaggaaagaaagagcatccttttgcgggaaaatgttaggtagcaaaataaataataatagcgggattcatcatatcttctctttgtcttagttctttaatggataacattattaaagaaaattatttaaaagtctctaaaaagttaattatgaattttcatcatagactgtagacttctaaaatgacaaaattacccttagggtctcaaaatatacttttaaaagtaggtactctcaaaaaagaatgattatttaaaatgctgaaaagaatctggcgatatttttatttataatgttcacagtttagggttaagcaaattattttataccatacataatttgcatttgagtaatgtggcatattatataatatttaattagatgcaatatctggcagaaaaaagtatggatctccatttaaggagattcaaattttctttacaaaattcagtggatgatgctatagctcatacagtgtaaaccaacggttctcaaccatggcaatgatggtggaagtgtgtggaaaaattagtagggagtgtagataatcagaatcttctcagaaagtttttcaaatatacgtcgctccacggacctttctgcaaagatctccctttctctactgacagaagaaatagcgatggactcaacatcatttctgtcacctgtaatttcgtacttagaacatgcatgaatagcctatcttgcaatcaccaatgtatggataatttgtaattatttaaaacatgtatacttcatgaaagttataaaattgatacagtttttatcaattttgcaaggaattagatatacagtataattatgaaaagtaatgaaaacactttggtgttaaggaaatatttcaatttttcccaaactggggatttctaaatatttcaagaaaagtaatctagaagacaaatagtagttgacttagcattgcctgcgaccttgaattaaaagattttctttaaaaaaaatcttaaagtgattttactaaaatccagagtacagatacagaaaagcattgggatacgaagagacccgatcatcaagctcaacagtccccagcatttttggcaccagggaccagttctctggcagacaatttttccatggacagcagggttgggggacggttttgggatgaaactgttccacctcagatcatcaggcattagattctcacaagtagcacacaacctagatccctcacacatgcagttcacagtaggtttcatgctatgagaatctaatgccgatgccgatgtgagacgaggcggatctcaggcagtaatgctggttccctggctgctcacctccagctacgcagactggttcctaacaggccaacgtctgatacaggccttcatccaaggcaggtggggacccgtgatctagctaaatactcaagccccagtctctattaacacgtaagtcaaatttaatacgctggtagcaccttacattgtcatttaagtcatttgcatttgtaatccctgtgctatccccaagtatacttggaaaacagagacttttacttattttatattttattcagcattgagtgtcttactgtactcacaaatcagttgtctgggacttgattacagtacttattgcaatcagtaagaatctcagttgtttatttacttatctattgtttatgtggtgtctggcagagactaggatttcaataaatatttgcttgactgaaattcaatttcagaaatttgaatttttgtagtactattttctcccttcctaatctgatgtttcagtgccattatacagaaattgactgcttttgattacagaacattttcaaccaaacataaccacatcgatcaactctgtattttctaattctgtacatttcttcttttaaccattcttaccttctactggtcatttaaagaaaaccaatttttccaaaagtattttgtttgtttgcttgtgtgcttgcttaatggaatgcctgtcctttcaaatgttctggatatgtgtgagttgtcgaggcaggagaaagggagtggcagttgtcctaaccagcctgagtgagcttggaagtgcttcctactgcatctctatgctgatggggcaaaacaccctagagaaggctccaaaaaccctatggtaaagaaaactgcttaattttgttttaataaagtcttagtaaactccatgggtagtatggtttggctctgtgtccaaatctaacttccaattgtaatccctacacgtgttgaggaagcgtcctgtaattttggatcatggtagttatttttcccatgctgttctcatgctagtgggtgagttctcatcagatatgatggttttataagtgtttgacagttcctccttcaccctctgtctctcctgccaccttgtgaagaaggttcctccttccccttcaccataattgtaagtttcctgaggccttcccacccatgaagaactgtgagtcaattagacctccttcttttaaaaatttcccagtctctggtattttttttatagcagtgtgaaaattgagtaatacaatgggtattaaaaataacacatagttctatgttctagagactccattctaagaacatactttctggaaaccatgatgtaagacaacccagcgtctatcaagaacatgcatagtcatccaaagacacaaaaccctaatccccagtcgcctgtcattcaaaagtgtgctcacatagtcttcctgctgtgtacaattgcaattatcctctccaagaaaaggaaacgcgcacagcctttatctctttacccctagattctactacggcatatttcttttttgactgaaaggcaggagtacttattgaacagatatttttgactcatcttatattctgatactgcggcatgaacgaagctcttctttccggcccttgtatctcgtgtcatatgaatatcactcttttctgagtgtctctttaacgtctgaaaccatttggacattacaaatataatctaactaatattttaaaatatgactgaataattgataacattctatcttacagagtgtctagttctgggagaaagattattctatgagccagctgcatctgagtgtcctgggggcactttaaaatatacagattctttcatttgactattggaaaaatagtttaactaggtctattgttggtgctgcttatttgataaagaaatctcttcaacaaacctctggataaatgcttaggatgacctttatgaactgtaatttttttcaatattttaaaaataaacagtaatgtatttaaaatatgtaattttttatatatacacaatacatgatacataaaattttaacatataatatataaaaactatatattttcatgtcctatatattacatattttatattaaaattttatgtatttatatactgtacatatatattttttcaatatattttttccaaaatatttctaatatctggcaattgctaattgtttgaaagtcccacaacatatctgacctaaaatttctcttttaattccctgtccattaccttacatgtaccccatgaaataagaaataaataaaatacttttccacataacccttcaaattattatactccatactgaattagactacgttatctgcagacaaaaagtgtataatgaaattgctatagcataacagatgatatgaccaatgagctcagtaattcacaaatgtctctataatacaaaaggggaaagtaaatatagcattaaatacttttattcacaaatcaacatatttcataaacaaatatatttaactcggcatcatttaagtcaacttatgccatgtttaaattagttcaactatttaggaagtgtctagttagtataaacagtattttaggagtgaagaaataaagataaacaatttctagtcatcaatgtggctgaagttaataatggcatgaaagtccaaaaaacaaaagacagagatgtggccggggaggcagagggtcagagagaagggctctcactcagaggcaacagaagacgcatttgagaaagacagtgcttgacttgtgtcagataaacacagttgacccgattgagagaatgggggaaacttcttacaagtagcaagggcagttcagtgaaatgagaaaggcaaggcgaaaagcttctgattcatgaaactatgagtaatttgctcatctgaagcttggcagaggttggggttagagtgacagggacaaagtcatgaaggacctttctcttgaagtttggacaatgtcattgacagatctaacttaaggacttaaggtgatcagatctgagattaggaaagatcaccctggcagctgtgtggaaaatgaagcagatactaaatacagccagaaagctgttacagtgatctgggtgaaaataataaaataataacttcctcttattgaatagttattgcactctagacactgttgttaaaggctttctatacattatctcattttcattcttacaacggtcctaggaggtaaggaatattaggtctttaaacatgaggaaattgaagcttggagaagttaaattaatttcttcaagatcacaaaggagagctgggacattattcaaagaaaatctagatttccaaaagcatgtttttaatcgtgctgggaaacaaagacaagatgatcacatagtgcaggaatgctgatggtggaaggtcagattaacagaaacgcctgaatttttagaggatttaggaagggaaatcagcgtaggagtccgtgaacagttaaatggagaggccgcttgtagaacagatgctaactaaattcccaggtttttactgcaaacgagcaacaagagaggggaaagagccagccatgatggctcactcctgtaatcccagcactttgggaggccgaggcgggcggatcacctgaggtcaggagttccagaccagcctgcccaacatggtcaaaccccatctctactaaaaatacaaaaattagccgggcgtcgtggcaggcgcctgtaatcccagctactcgggaggctgaagcagaagaatcgcttgaactcgggagggagaggttgcagtgaaccaagatcgcaccattgcactccagcctggggacaagagcaagactttgtttcaaaaaaaaaaaaaaaaaaaaaaaaaaaaaaaaaaaaaaaaaaagaggggaaagaagtttccgtgtgattattgtttttaagacacatctcactctgtcacccaggctagtgcagtgacatgaacatagctcactgcagcctcaaactccttggctcaagtgatcctactacctcagcctctgcagtagctgggagaacaggcatctgccaatacactggctaattttttgtatttttttttatttttttgtagagatggagttttgctatgtcgaccaggctggtctgaatctccacaaacaatccacctacctgggccttctaaagtgctgagattacaggcatgagccactgcatctggccttcagtgtgactcttgattcccttcagaatataaatcattgtcatttacatagacatgcattttctctctccctaggtggaatgtaagctccgtgaacatttagacaacatctgtcttgttcattattctgttcagtgcctaaaactgaatatgtatctggtaaaaagtaaaactgctaatagtttcactaaagaaacaaatataggaacaatgaaaaagtaatggttaccatcctgataagtcacaataactcaatctgtagtaattctcttaaaaatgaaggtaaattaaaggaaggtgattgccaggtaatattgtatctttgagtcacttaaactaggtagccaatcagaaagagttcattgaatggttaaatttctagtgttttctgtcatcattatagacaccatcctaaccagattcatttttttttttaagagaaagatttcccaactgtggcggtggaattgtgaccccctaaagattcatatataaagtcctaacccccagcatgggactatatttggagagaagattttgtaatagatgtttaaattaaaatgaggtcattagggtggtccctaatccgacatgactggtgttgttataagaaagggaaattagaattcaaaacacacagagagtgacaatgtgagcaaatacaggaaggtggtcattcacaagccaaagaaagaggcctcagaaaagagcaatcctgctgatacctcgatcttgggcttccaacctcctgaaccttgacaaaataaatgtctattgctgaagcttcccagtctatggtactttgttatgggagccctagcaaagtaatatgcttcccaatatggtagactgggttggaaaaaatgtcttactctaatcacatggaaattctgaacgaaatatagcaatatggtgtttgatgcatagctcagctcacaatcgagagagaggaattcctcgatggtagaaggaaccaggctactcttgtagactggtgtggggagtagagttaaaaatgactccttggctaactgcaggtagaaggaggtgctgaactatggaggttgatacctgaggcctctgtgttggattgggggagtttaggctgtatgtcccattgtgtgcagcaatttggagccaagggacgaacataaagactctttttacttggggctgccctggcctcaacacaggaaatagagggactctgtccataggacgtaaggaacagggggagcctcatgtgccaccttcctcaggctgagggtacaaagagggcagagacctcgaggctggagcctctgtcgttgctcaccgtggatgggaaattcaatttgcagaagctgtccaaaggcaagaaacaaatataaaactggccaggagcccaagactactgggggtcttcagcaaagatgaatgtttaacctactctgaaggttttccacagcctggggcacctgtgggaagcatagcaggaaggctgggtgcaggtgagctccatcagtgcgtccctatggctcccagggagaagtcacaggggaaagaggcaggagaggaaaagagcacagtgtccagtcgtcccgcagagtaaaatacacatgaaatcaacggaaaagtctcaatgaacgtttaaagtaaacacatctgaaatggcccaaggattgaaaaactagaaaccataagaaaaaacagggtcttggaagaaaatatcaggtcgatttagaaattttgataaaaactgggtaattaaataaaaatatcacttgatagttcaaataggccactaagctgacttgataactagtgatttggaaaatctggggcaagaacacaaaatatcgcccaaggaaaagcaagttctgataaccttcgcctggaggttattctaaggggggattaattcctgtctgcatgctttcctctgcccagtaccaacacaagataaaatatatatacgtatcttcagtgtgctcttattcaaggtactatgaaatacatatatttatacacattttatatacatttgcatgttaaatatataatgtatatgtgtatacatttaaacgcatataaacatattctaaagtacattaatacttcaattatatatttaaataaacatatgaagtaaataaaaatatattattaaatatataaatttataaatatatttaatacaatataaactttatatattgatatataatggaatattatatatatatatatatgtatctctgtctctctcaaattacattgagtaagtgtgccaggagaagatggtgggggtggttatttaaaaagaaaaatggcttctgggtgcggtggctcacgcttgtgatcccagcactttgggagactcagatgggtggatcacaagctcaggagatggagaccaccctggctaacaaggtgaaaccccgtctctactaaaaatacaaaaaattagcccagcatggggccacatgcctgtaatcccagctacttgggagtctgaggcaggtaaaatgcttgaacccgggaggtggaggatgacatgagccaagatcgcaccactgcgctctagcctgggagacagagtaagactctgtctcaaaaataataataataataaataaaaataaaagaacaatgagaaaaaagacttacataactagaaaatggcctgagtccaaacataaaaggaccatgccctatcctgagacaaatgatggtgctcttggatgtgtacttgagtgacatgtgaggtgacggacagatgtgcccaggccttttctagttagcaactaaagaaaataaaattaggcaaaatcatgacatgatatttcagaaaacagtcttatgtaaatagcaaattattataagagaagtttggtaaaatggatgaaattctcaacaattttctcacaaaaaaaaaaaaccatgatccttttattactcatacttggaaaggcaaatttgaagtaaaaaatgttaatcatgctatgaaatgaggtggtgagaatcatcacacttataaaagagcacttgtttaggtcattttctatttatccaataaactgaagggcaaattaaacctttgttttgactatttattgatagccaaagtttccaggaaattaatgttaaattgcatagttttcgtaccagtgattctcagaagacaaattgtttagtaatagctgcattttcaaacaaaggtgtgaaagtaccttttatttttgtaaagcaaaatttattttcagagaaagtatttttgggacatctgtcctgaaaaaaaaagtgctatggaaggttttcaacaaaggacagagaaatttgaaaaaaaaatatattggtactaaattagaaatatagtctgtaagagaattatttttgcagtcggaaaagccaggaatacttctttactgtaggtaaatttaaaaaaaaaatccattaaagtctttgagtctaaaaacaatttcaatataattccagaatttccttcagtttggtgtgtttatgtagtttttgtttgcttttgttttttgtttttaattttcctcacaggagccttaaaaaaggtcccgaaccaagtagttttcttctatcataataatgatctttgttaataagatggtgatgatggcacaaataataccagctggattaagtgcctactacaggaaagggactgagctggctggctactgtgcacatctcatttgcggtacagttttaaactcaagtcagtgatttgaaatatgtggcttcctaagagtctacagagaaaatctagaagagattttctcaggagaaatcccataaaatgcatgttcactgccatgaagaagaaattaggcaatgcccctggaagtcaatcaatgggactgaccgtggttgaagctggatggcatagaccagtgaacctcttctatttcatttcttcaggctcaaatgtctgcgaatccattagctcttgacctctactcatgatcctcagtgcaaatagcatcattcaaaattggctgaggatacatgtaggtgagagtacacttcagtgtgggagatgtaatttaatgatggtcacttccaaccacgcatttccagaacggaaaaccctttgatttgtacatggcacacacagaactgtctaataatctgtaggtcaaaaataaaaccagaaggatgcaggactacctactcttactctgaacccttctcacaattttttttcccatgtcaaagcagaaatggctaattgcttgcaggaaaatttcccttattttccttatccctttatcagagcaaagatagtaagtgaaatagaagagaacagaaagaaggggctttagaatactgaagatatttaagatctaggatttgtttatttttgatgagatttgcagcatctttttcctctaattgggcaactagtaaacatttcacaaatagataataatagtgacggtgtgtttttttctctctctcttttttcacttgtgatattaaaggtgttttgtttcctccttctttcttttgggaccactgcctgttggtttcgtgctgaggcacatacatgactgtactatctaaagtttctatttcagagaggtctaatctggatatattttagtagacatccatgccgatggatggaagaagacaattttcaaaaagggtgcttgattgacatacaagtctcgcaattagaaaaaggaaaattttctataaaggcaaatccacgggaattactggcagtaatattaatgatattaggctgcctgactacaaggtgtgatcttagggatactgggaaaggtcttctgccagaatcggtccccgctgcacctcaaatccccaccattaaagtcattcatttgagttaagaaaattgccactaggacctctattaaaatgcaaatgtgttccccgggtggggaaacacattaaatcattatcaaccattaacactttagaccaaattagtttcagatttattagccaattactcaagtacagaaggaatgcggagcaggagagtgtagtttaagttggtttttggaaacctgggatgcttaaagacccatccggtggtgtggtgtcttgccatagcttttatctttttattagtcagctttgtgtttttgttttgttttgttttgttttgttttgttttgttttgtttttgagacagactctccctctcttgcccaggctggagtgcagtggcgcgataccggctcactgccatctccgcctcccgggttccagtgattttcctgcctcagcctcccgggtagctgggactacaggcggctgccaccacgcctagttaattttttatttttagtagagacggggtttcaccatatgataatgcataaagttctcacataacaatataaaaaagtggaacgtctcttaacaaaacagaggtcaggacccagagctccagctgctcgccactgcctcacggcctcctccccaaaccccaaacctggcccctgaggcaactccacggacaggtaagttctgagaagcttgggctggagatcattctaggagggtgtcattctaatctgcatgctttcttctgtccttttaattttcctatcttttgaagatgggcagaagccaaaagtggaggtggagataaaatttgggcttgtggggaggccgaggagggtggatcacttgaggtcaggagttcaaaaccagcctggccaacatggtaaaaccccgtctccactaaaactacaaaaattagccaagcatggtggcaggtgcctgtaatcccagctactcgggagactgaggcaggaggatcacctgaacccgggagacagaggttgcagtgagccaagatcatgccattgcactccagtctgggtgacagaacgcgactctgtctcaaaaagaaaaaaaaaagaataccttgtgttctgcacaccaacaccaagctccacgtccaccgtgttgacgcctcctctgtcattccgccacctccctgagagtcagcagaaatatactcatcctaaacaaacagatgccatcttttttctctttaagaaaaagaaatctagacctttctcacacttgcaaagtttggggtcagggggtcaagaatttaaattaatatgtgtaagaaattaaaaaatgtgcatcaactgaaagacaaaaataaaatctccccaaaaaggaaatggaaattctaagtcaaaatacataagcgctttcatatgcttcatcttacttaacttttcagaaatactttaataattttgcccaattgaacataacagatagagaaggcccaaagagaagtcggaactttcccaagttcatagggttattgaataacacagctgagattcaaattcacaccactcatccaaaaacacaggccctttccccagaaagacatacttgtctttaatttcatttaaaagaagctaggcagttcaaatttactcgagaatacaaatttccacttgtagaaattatgccacttaaattttgctgaaataatagaggaaaaataatgttaggaaaaatttgggattaaaatagactcaacattataaacagtaacattagatttttcttttgctccaaattcttaaaaccgaagaaaaaaatctgtatacctttagaataattgtataatttgactatgatccatagcagactttttggaaggtgtctagagaattctgctgctgtttttgtaaaattagactgtatttccctttatgctcacagatggcaataatttcatatcattttaacatttcaagcatttttttatgttattcagggtctgttatttaagtccagataattatccaaaaacactccagtcctctcatcacttatagttcagatccaaaaactagtaagattaacgtaactataaactaactatgctttagttattctattatttcgcagaaaaagaaaacgaagaaatatgaagaatgtctgagtgtttttatgaatttgaattcataacctaacctgtgtttggctctgacaaaattattaagggttacttaaagctaatttgacatgatttctgtttggtttacacaaagtaattcagaaatttacaaagcaatgcttcatcaaagagcaatattaaaattgaatataatataaacatgtaaaacagatacctttattcatctctgttttctatttacccattcccttgacaatctcatatggtttcacagcttaaataccacatataaattgataatcctcaaatctgtatctccagatcagacttccccttttaattgcacgtatatatatccaacggtccaccctgaacttctctgcggatgcctcactgacatccaaaatttaacgtgaacaaaaatgatctcctgatttttcccttcaaaatcatttctcttccagattcatcttaattttggcaactgttcccttctaggcgttcaactcaaacaccaaggtatcaccctcagcccctctctttctctcacacatatccaacttgtcagcaaattctgttatctcccccttcaaaacgagcccgtcctcctatctctagcactacccctctggaccaaaccaaagtggactttgcttggattacgggaattgcctcctaaagggtccttggctctgtcctggttcctctagagtctattcttcacataatagctaaaattgtcttgtaaatcgtcttcgttaaatgtgtatcaggtcctgtgatgactgcttaaatcttaccagtggtccaaagagcacaggggccagggcagattccaaagccaaccaatagtaagggagctgacagagaagctgctgttagagctgggttgggggcagggactcttagtcgggagactcacagagctgtgagatgacctgcctggtgagccaggctgacttcacacttcagcgaggaatccccctgagcaggcgccacccaatggggactgctcatctagagaacagaaggctgtctgccaagaatccttacacttcaagacaatgccagctcttcatccatctccctcaacacccagaaagggcacaaagaaggtcatgtggctgaggaaatgtcttcttcaagagaaaacaggcatgacatcaagtgactgatcactgaatttggaaggccaacacaaggatgggactttttcataaatgtatacaagggacatcaagattaatatctgaaaaacagaatttttcagttattaatagaaggtttttaaagtattcataatacttcaacatccattatctatgtttacacttacctacttttaattgacagataaattttaggcacagatgttaaaggaatttactatattcttatagaaatgagtagcagaatatggattaacacaggtctcccgaattcctggcctattcagcatttaagaaaagtatttaaattctaaatatatctgataattagaggactattcaagatgattttaattttgtagtcttgtgagaattaactaaaaactgaggtctaaataaacaagtgtggcaggaaagaaatcagtgtctcgcctttttccttgccattttcaaacatctcttagcaactaatgaatttgaaacaaccaaattttgtgtgtatatagattgaaattaattctctagaagattaagcaaaaaaatcatatctagactttaacaatgagatccaataggttaaaaaatgaaacttagtataattccatttcaacaaaatccaagtctcctggtatagaagcctgggttgatgaggacacattttctcctctttattcctgaatatcacaaagaaaaataggaaaaataagtcctaccttcttccctctctgccccgagaaaaactatttttttctaatcatgagaaaataatcattaggaaaaaaaactagggtatacagtgagatatttgggagtcaggagaaaaatttgatgaggagtaacagtattaacaggttccaaatacataacatagctaccttggtaatggcaggatgaaaatagggcctcaaagaagcatctctgaccctgcccttctctctctctctctccatatatatatatatatacacacacacacgtatatatacacacacatatatacacacatatatatacacacacacatatacatacatatatacatatatacacacacactatatatatacacatacactatatatatacacacactatatatatatatatacacacacacccctttctatatatgtatctacctatgacaagattcagttacaaacctatcaatctgtctgtctgtctacctatctatctatctatccatccatccatccatccatacatccatccatccatccacaagcagtaggaactatatatatttctacaacggggaaagcactggtgtgagtgggaaggaatttacagaactgtgattccgaagaggctgggtaaccaagagaatcacatacagtggagccatgtttgcaggaagcaatcagtctctgtcagaaactgtcagattgtcaataaaagcatacaaaggtagactatctgaccctttcagatcttaccgccaccccaggaatctcttcacattaagtccaagaatatttaatagctttttattaaattatctaaaaataaataggatgactaaagtattgatacagaagaagtataaaacagtggcaaacaatagtaaagtttataaaatctatcaaacttattttattttattatttgttttgagactgggtcttgctctgtaccccaggctggagggcagtggcacaatcacagctccctgcagcctctacctccctggatcaggagatcctcccacttcctcaaagtacctggtatgacaggcacatgccaccatgcccagcatatattttacattatttttgtacagacagggtctacctatgtagcccaggctggtctcaaactcctgggcttaagtgattctcctgtctcagcctcccaaaatgttgggattacaggtgtgagccaccatgctaaaccatacaaatctatcaaaattttaaaaaacatatataacgatttcttatattaacaatcaattatcactattggtaaaattcacctaaatatacataaattggagtcaacttaacatgataaaacacatctagttcaccactaaaaccaggctgattcttaagcaggaatgaaatcttagaaacatcactcctgaagacaggaactagaaaagaataactaatattcccgctgtcaattaatattttacattaagtactagctaagggaatttgaaaaaagaaagaaaaaatttataaaacatgaaaaggaggagataaacatatagtacgattgaattttgatattattttaaactggaaaaccaaataaaatcaatttttaaaaaatctattttaaactaagaaagaattcaataggtgacaggaagtaaattatcataaaagactagtttttctattaaaaaacaaccaattttataaaagaaaatactctttttaaagcaatagaaacttaaaatataaggaaattaacatgaaatattcaagaccaaatttttaaagatataatactccctaaaaagtaccaaaatgtaaatgaatgaaaatacgtatctttgaactctatgacattgtattaaaaaatgagaatgttcattatacactgacaggaaaaatgagaacgttcattatatattgatatgaaaaactttgaagatatgtaggtatgagaaaaaaggaaaacaactgaagtttatattatgttttcactggtgaagaaaaaaaagagagagagctagaattttgttttaatgtggttggtttctgcacaaagaagctctgaatgatgaacaagaaactaaagacaatgatggcctggagaaaggcaggtgaaaaaaagactacacagctagagaaagtgcaggggtgggggagactagatggcacacattgtcatgttttagattttgcattttgtgcaagttatcttcaggactaaattaacaaagtagataaataaatgaagcctaataagaaataagggttttctaatctatttccttctctctcacgtgccaatgcgcttgagcctgctcattctctttctctccctcccttcctgccctataattctctgttgcattaaaagcatcattataagtctcaggcatttgctgcttcctttcttccagaaatggactctcattttcttcaagcgcattgtaagtaatttagtccccacccccacctacaaaaaaaaaatcttcacaacaaacttatttttaagaattattgcatcctttctaagatagcatagaactttgggatggtaaggtcaataaaaacttgaatccttttcctattttgttcaaaagctaaatttccatttatttgtacttccagatgaaagtaatttgatttatgtatttcagtaaaagctacccagttttaaattacctaaagaattcctaatatgcacttacgattttcaaagtacaaattattatttccctttgagagcttgaactattgctgccttttactttcataaataaaattttatctcattaaagtagtataaaatatgggaaaggactccctatgcagggctcacatatctatattcgacctcactttttattgattttaacagttgttgatagctaatgtcacctcactttaaattttttgtctacattttacctacaaaataatcagtcattctcaccaagtttaagtgcttacttacagatcattaaatattttaaagaaattattcctgtggtgaggctttttctaaatgaaatattttttatgtaaaataccacctcttaatctgtggtttggagtttttgtatttttgcttcacaaagctagacgtatacatacatataacatatatatatatatatttatatttcatatacttttgttccttgatgtttcttagtaataatatataaagggaatgtatcatttttggaaaagttggaaaaatttttccaaatatcacagaaagcaatgtgaaattccttcttctcaaaatctattgcaccagaataacatggtaccatgtattatctcaaggaaaatatgacaaactatattaaatgcaaaactatcagctactacttctcatttgaataattttttttgttttttgagatggagtcttgctctgtcactcatgctggagtgcagaggcatgatctcggcgcactataacctctgcctcctgggttcaagcaagtctcctgcctcagccccctgaatagctgagattaaaggcacatgccaccatgccaggctaatttctgtatttaaatagagacagggtttcaccatgttggccaggctgctctcctctcgaattcctaaactcgattgatccacctgccttggcttcccaaagagctgggattacaggtgtgagccaccacgactggctaaataattttcttatttggaatatttataaagtttctgaaaaatcatcttggtccatactttgtgacttagaattccatctaaagatcaacaacggccataaggaacacagaaggaaagtctagaagccaagggaaaaccaagatcctagtgccgtctctggtacaaacatacctggtgaccttgatcaaacatcttaactttcgtgaatctacaattcaccagctcttaagcttgccctgcctacttcaccggaagacaatttttatttgaatggaatttaaataaacagttaattattgtgtttatagcattattcataaaaccactctaataataaacctctcaagagtaacatgagggttaaggaggaagtatgaaaaaggctttggaaacttacaaatgcaactcggcaataaagttcttccagcaaaagactaatcaaattaaactattgcgatccatatactttgtccctatccatgtaatttactgaaacataggaattgtgttttcctcatccatatttcctcatgcctagtatcatgtttaacatatagaaagaagaaataaatacatgtgattttgtagttggtgggtttgatgagtagaacaatctctttttattctactgcctagtgatagacaagtataaactaagaatcatcaaatataaaaaagaatgaatctgactactacaaatcagattctgaacaatttgaaatacaaactattctggaagatgctcaacatcacttatcaccagggatatacaaatcaaaactatgaaatattacctcacatctgttagtatggctattatcaaaacaatgaaagataaatgttgacaaagatgtaaagaaatgaactgctgtgcactgtttgtgtgaatatagattggtatagccaataatggaagagtatggaggttcctcaaaaaattaaacatagaaatatcatataacccagcaatccccctgttgtatctaaaaccaaaggaaatgaaaccagcacctcatagaaatagctgcactcccatgttcactgaggtatcattcacaatagccaaggtatgtaaagaacctaggcatccaccaatgcatgagtggaacatgattcagctttacaaaaggagatactgtcatttgtgaaaacatggatgaaactgaagggcattatgtcaagagaaataaaccaaacacgaaagaaaaactagaatttatttcatatctataatcttacaaaaacggaatacaaagaaacaggagaagaacgatggttattggagtgggctggcatcgaatgaggagatgtcagtccaaagtatgaagttgaacttatgtaggatgaataagtcaagaaatctaatatatagcatgaaaactataggtaatagtgttatgttgtatactggaaatttactaagagagaagatgtaagatttttacacacacacacatgctgactatgggaggtgattaaatatattaaatatattgctttgcttgagtacacttatttgactatgcatatcaagctatcatattatattccttaaatacagactgcaagaaagagaaaaaaattgttttggtgaagaaaatatatttaatatccatgcagattttaattttatcaaaggcaaacttaactaaatatggctacttctcccaatgctgtgtatctcttgaccgagtgaaaagtgatgccttctaagtgaagtgaaaatgcattttgtactgcagtctgaagtcactatatcctgcttccattaggacttgggaggattgctgattcttcaggagtatgctctgaatggggtagaactttccaaatgcatcagatagttaggaatgtctgtgttccttcttggaggagccctgaactacagggtgcataagtccacaggcaatgtaatagtctcagcatctcattactatcctcagcggaaaaaaaaagtttctaatttttctaatttgaatatgatgtcagctgatttttacggaaagaaaaatttggtagtcgtcaggaaaattacagtcacttgaactcaactacttgaatatttcaggaatacttgttttcttctacctcttaacaaagtcataaatactactggaatgacactgctttagatatctcaacaaaaaaagatttctcctctgtgaaatacaaagatcttactgctattttctatatccagctgatcttttcagatctaagctcggtggggtttcagcttagagtgctaaggtatcatttttctttacttgtggcattacaagagtctcactgagacactgctatgtaatatcttggcaaaacagtattgatctcctttcaaaagtgaatagaggtcagctttctgtctggatacttatatatctgacttgtacacctaacaccattaaaatctatttgagtgcattagtggaaatggattctattatatggtctcatggggaacccgccaggaagtcatagagtataacgtagacggctccttttaaagacatttcaggcaattttcttgccatcccttcacttcattcccactggctaactgggaatcatccaattactacaatagccaggattgatacccgggagttagaagaaaactctttcaaggaccgaggttcgctcaactcatgaaaaacatgttgccatttctgaaaacaaaaagagggtttaatactttggagtacataataatgtgaaatatacctgatacttatgattcaagtcactaaagtgtgttacctgacaacacgtccattttgtatcttgtaggatctgtgtatacctgtgcataataggaagaaatttattttgctgaaagtaaataccaaatattgtaaattgtatgaaaagaggacatttaaaaagcaaataataattagcagtttgtttagctaatgaccttacatatgtatctttctcagtttttaccacatttttgttgaatttctgatgaaaatgtccaggtatacataaataataatgaaaggaattttcatatgtgctgtaagaatctaaaatgtaaatgcaatatgctttcgaatgtaaaaaaaaaaaaacaaaaaaaaaacaaaacaaaacagtgcctgaatcatggaggaccttgtaaggtgttcccattgccttcccaaaactaactgtcatagggaatgagatttgtcctgcatatacagatctcttcaaaacatactttgagtaacttgcctagataagtgcatccaatctcgggcagaaagaacgtgaaaacaatttttaaaaatatgatgctctgtcatgaccattaaatatcaatcactgaatgattcttctagtactgaaaatagtttaaacaatctatatgcacttaagtgagccattgcaatttgtcattttcctgtaagacaactagacctcctcttgcaaacaaaataaaacatggatgttccagaatgcttttcatgagttttatgataataattatagtctcaaaacaaaatattaaccttgcagttttaagaacagtattatcaggctggctaatgaatactgatatataagctatgtcaaattgtgtgtaaacatagggttatctatatcactactgattatatgaagagctaataatgcccattaaaatataataagattttctagttttcttataacccatgtggcataccataaagtaaaatcagacttaaatatacaaataacagattcaaatataatatttacattacttataagtagctgggagttcatctttataagtactaatatagtagctctttatatatatatgtgtgtgtgtgtgtgtgtgtgtgtgtgtgtgtgtgtgtgtgtttatactcccagtgaaattctgttgaagaagaattgacataatatattatgtgatattatttggaaaaaataaatgtaagtttcacacagacattgaataaacttgctttgtattttaaattattgaacaccattctaaaagatgtatcttggtaagattaatcaacgattagctcttgaagcatttatcacgttttttaaaagttaagatatacagcatagccttgtagtatgaatcaagttgatatattcaagttgaatatagcctgtatgtttaaatttgaaatctgacggaagtatacttcactattaaaacctcaactataatatgaatgaaacaaatcatacaggtttttttcttttaagaaggttgttacagttgtataaatgattcgagtttaaaacataagcccataacattttggttgagggaaaagtcgtgaaagaacacgttttaaatatttatacttttgctattttaaacataaaaggggaaatgtgtgacttttgccatttgcgatccgaacttttcaaattaaatgtatcctgaaaggtatatatgttttacacattataaaagtgtaccttttataaagaatacattaaaaacaataaaagtcagagaataaagatgaaaaggttaaatttaagtcttattgcaagctgtttagtatcacgagcaaagtatcgaacttcattggtacatgaatgaccaagatctgattacttttcttcaacaccatttttcctaattagcattatcagcatccagttctagaaagtcctagcaaaattaattacataatagtaatgttgttttgcttgtgaaagcgcaataatataaacaaagtagattatttatggttgttgttctccatttctattattttcttaatttgatagctcagaaaatacatagttacgtgagctccacaagggcatatcgcacagagatttccattttgcgaactccattccaggatatttctagttttgagacctacgtgtatttcagaagcaacatggggcgcgtctcaaatgtccactttttaaagaagcctcttgaaaccacagctcatcctttcagaatctgcattctcagacaaattccagccttgcttttggcatcttgaagaaaatccccatttatctcagataacagagaaacaatttgctgtgcttatttagtagctggtaccttgagttacacaggatttgcgctgcgtttgagcctagctgctcggttggaactgagtgtaatgttcacgacgtggctaaaggagttttgagacctaccctccgacatcttgtagaccctggttgtgggactgggttcacattccagggggggttactttgacactctccagtagatacacggcattcgtcaagaagttattaggatttacagtggaattttggtatcacgaactagttgtaagaattttctcataatggatttttctggtcacggtgtgagttcacatcgtggacagttcaagccactgacaaatgatccgtgatacacagaacgcacatataacacacggggaggacaagacgtcatctgggcgagccatttgcatccagatgaatacaaaacctacagttggttgtattacacttggaagttttcagctgtggcttcatcacccatattagggtcagaaaaactcttgtgtgtttctacagccttgccccgcttctttgatcctttgtagtaatggcgactaagtgggtagcgggttctttaaaaaaaaaaaaagctttttgtattcctgaaagatagttattatcaccaaaagctttctcttctaatgactaaaaatagagcactctaccctttagtgtagttcacagaatttgtttttaatactccagctctttgtgctccttaagtctgcttcacttttttttacttcgtttttcaaataagacctcaatggacagggctttaatgagaatacaagcagtgctaaccagagggacaggaccacttccctgtctgacaggtgagacgtctagggcctcccatcagcttctgcaaaagatagaaaccctgaatcattatttcaaggtacttcatcatcctccctcctctgttgctctgctgctgtcctatttcatcagttctaattttattcattctccttctggaactttcacttcagcatgggctgggttatgactgcatgtcctttcctatgttctggcttgtattaaaaattgcaataacacaacaattgacttgaagatataattgacctgaagatgcaaatgacctgaaaagctgaaatagtattgagtttcaaaaacattattagaaatatgaagagctgaaaaaatagctttttatgaatttcttctggggattgtacatatgtacttaaaaaaaatacatggatgagatgattaggatggaaaatgagacccctatatgtcatactggaataccagcagaaaggtcatccaactgttttctaaatggagaaactgagattgatgtcagggctttctaccggctgagtagggtgaggaagctgaggcccttctgcagctgaatgtaacttctgcggggacacttcgctctcaatccaccgtaggccagtagctctccattctctctgagaaaggactgatcaatgatgaagagtccactcagcagggcacccaagcatttctgttttcacattaaaccagttaatgtctaccggtgaagtctgtaacaataattaagtaatttaattaagtgtttgagaaacccatgaacaaagaccatgaaataaaatgttcacaaaaacactaatgctctccattgaaagctttggaaaactccataagtgcactacccataagtcagtccctggaattatgcgtaagatagttctaaaagactggggaaaacaataaagagagagaatgatttggcactttcaaaaagcaagtgaaataatgccttctgggtgtgttttgcaaagaaaaatggtgcagaactccactatgcagatttattttcttacctaacgtcttctagctgttaatgacttccaagtttatatttccgtgatctggttcccacttgaaatccacggggaccagctctactagtcacctggaaataacttgcaaaggcaaattcctgtgttctgccagtaatcttcctctttcctctttttcttctctgaatctcagttaagggctgctctctgcttccaggtgctaaatttggaatatatatgtttggtacatgtatatgtttgggatatatatatctattatatatacatattggatatatatttagcttatatcaccaatatgtacccacctataccacatatatatatataccaaatacatctaatatatatatatacaaaatatatatatgtatatatatacaaaatatatatgtatatatatacaaaatatatatttatatacaaaatatatatatattttttctatttttttggtttattgttatatatagagagatgtagaatgtatatgtttgtaggtaaatatgtacatttggtatatttggtgtatatatttagacataagatcatacctatatatcaaatatatatattttatatatatatttatttggcatttatatattcgtatatttatatatatatttggtatatataagtgtgatcctacacctaatgatatgaagtaaaatgcatgtatatgatttgggttgaaataaaattttaatattaggtgtttatatattttagtggttctctttttaaaaatgctcatttgcttaagtaatttggtcctcattacatgatataagggacgtatttaggggagtttagtttggagactataaattcctgagggtaagaagcatttcagtcttgttaccaattgaacgtatattgcacagcagagtgctgccatgtagcaggttctcagcgactatttactaggtgaaataaataatctcccaatctttagcttatttggagctcttcatgtctttattcagctctgttactgataccatttaacacatgtccttcctattccaaataaaattcaaagacccatgtatgttagagaatcttaactagttaatattgcttaagtggataatgcttccacattgttttacatatttctatttgtgatcgtatttcagtagatgctcaattaatatttctaaatgtctgctgaaaaaaaaaataaccagatgtctgctgccacctaaaaaactcaaactcctttagttcaaaacacctcgaaacaaaaagctggcatctactgagattaataaaagaggggaaggggagaattattggagggagaaagaaggaatttgtctttgagcattacaacgttaaggtaacctgccagacgtccatgtggagatagagatggacagctgcattttagaggagggagactgtggtgatataaatctagaaggcgttagtatacagacggaaagagataaattcactgatgacctgaatatagacaggaaacacttggatgttcagccctaaattatttccatatctgaaaccaggacaaggaggaagactaaacaaagaacacaaggacaggctaatgagacgggagaaaaatcagaggtctcaggaaacaaataaaaatgctgtttaaataaagagggcattatcacagaaaattatgctgacgaggaaagaaaataagaataaaaacccgatcattatattcggaaatgcagtcatcgatgatccacacaaaggtgttttgttggtgtggaaattctgaagacagtaactgattgcagtaggttcaagagagaattggaagaaatgaaaaaaggggaaaaataaagtatccacaacttcttcaaagagatttgcggcagaggggagcagagaaatgatcaatagctgaaaggaaaagtgagtcacacaaaagttttctttaaggtgaatgaaatacacataatgcatttttatgctgttgagaatgatgcattaggcaaatttcgatattgctagagaaacatataaaaaaacaaaagacgttaatctgtgagcaggtgagaaaggggggaatgcaaactttgcatgagtatctatttggcaacagaagactagctgttgtttgaaagttccagtggcttttcaaagctgtgcttacaactcaaagttcctataaaactgtagggaaggatctcataaacaacttaacacatggatctatgtataatcaataatgaaataaaagttttccattgcaatcacagtaaaagcaaagatactcctaagtcctaatctttcttttgaattcctaaggtgataggaacctcatctgaaacttcagcgggagttttgattttcatcctttccatggaatgacttgtgcgcacacactgcagcctaaacacgggacaaatcacttctcctctcccgattctgaaactcgtgattcagagcacacctgctcccatgttaatgttttaactcctctcagaatggccagagaacaaaataaattgtatgacatctttattaccccttttcgtctccgcacttagaagcattgagaagtacttggagagattcccagaatgcaaagcatggtctcagtgtggaaaaagaaagggatggaaaagagggagacagaagaaaacaaaacaaaacaaaacaaaacaaaacatatatatatatacttttttatgttcagggaactcagaacaactgtgaagacagttcattaatcaaagacaaattcagttcaaagaaatgttgcaggctatatagaaagcccttgaaagatgaaaacatattcaaactaaatttgtaaatatgggaataaaaagtagttgagttaggtggggtcattcaaagaataatcagatttaagaataaagaaaatggccaggagcagtggctcacacctgtaatcccagcactttgggaggctgaggcaggcggatcacgaggtcaggagatggagaccatcctggctaacacggtgaaactccgtctctactaaaaatacaaaaaaattagccgggcgtggtggcgggcgcctgtagtcccagctactcgggaggctgagacaggagaatggtgtgaacccgggaagcggagcttgcagtgaggagagatcgtgccactgcactccagcctgggcgacagagcgagactccatttcaaaaaaacaaataaaaaaaaaaagaataaaggaaatgaataaatgaatagagacggagaagttgctgattttcttggtttttgtgcataatgctttatctaaagaaataagagccgtaacgagaaatgtctcccttgagaaaggctttcctgtgactaaaccgtgctttgtttccagtcattcctgaggcaaccagggccagtgttcctgcctattggggtgattttactcatttaggaaggcttgggagttctatgtcatggttttaaagttctaggcccaagacgctaacgaatgaagagtatggagggtctgtgggtcttgactcctgctgagagagaccattaccagctgtaacctgcttttgatttgcccatatgagaaaccatgagatggcttcgagtagcatttaactttccgagctgtaactgaaagttaaagagaaattccactactgtttggaagcgagaatcagtcctttcccactcagcctccacacaagatgcccacctcaacctgcttttgtcttggttagaggccaccttcctcatgggatccgtctttggaatcagcagtttttgctcccacctcataagcttaccggccattcagggactggagcaagctgcatgtgacacattcccccacctgtgcaagtacttttcatatttttccgtattggagtatcttggtcatttataatttatgatttcaacttgaaacaacttgccttggaaaggagcaaatattcattcagatatatgatgtcataactttccatttatctatttgttcttttgttcattaattattaaatacatgtttattgaatattttgaggagtgtgaggaataaaactgaataaaaatcaacccatccctgcactccaggagaaaggtgggaatgcacactttgcatgagtatcatttggaaactgaagactagcactgtttcaaagctccaatgggttcacgaggacccaggaacagcagccacagcagttactctagtagtttgggaagtgatgctggcttctaccacctactctatttatttagggttgggcgaacaactcacagtgtttttcttattgtgtatattgtcttctcacatgggctttagtactgtatttttattctaactgtctcttctaatattacattcttatagggccaaagataaaaataataatagtgagaacgatcacaacagcagcagtattaacaagaatgccagcgttatgagaaggaggagagaaaaaacgagaagactgaggagccagtgttgactgcatgcctcccccatgcccgtagctttacatctctcttgctaatctttccaacagtcccgcatccttatcttcatttcacagatggcaagtctgagattcagaggcttctaataatgttcccaggacccagtgtgcaaaagcgttcggtagcagaccgcagacaagaactcagatgtatcagaccccatgggtagaactctttctactctaacaaactgcatatggtgtaattgaaagacactctgctagattctagaaaccttaatgttaaattaagacacctgaagagttaatagatttaaatttcttctgcgtgtgtgtgtgtgtgtgtgtgtgtgtgtgtgtgtgtgtagtgtttttcccctgagattctcactctggacatgcagaatccaagcatttattctcactcacaagtgcttaagaacaagaattacttacaagggcttcattttcaccatcgattacttttcgagtaactttgccaaattccagtcttgcaatgcaattgaattttatttgtactaatggaaagcaacctgtcagagaagcactgctttcatgaccaccccagacagcagaagacactaaatcaaggcccctgggaatcgtgagctcatctgggcagccacacatctgccccagctgtatccttgctctgactaagcagacttcccttgtagtttacatcgtttttaacccttggcttgataaagactaagcaggcattttatagctctaattgtgcccaaatcctccaggatttagtaactccaggcagtaaatgagcttggaacttctttgcaggctagttgacatccacactcattcatttagcaagcatttatatgggccctaaaacatgtccagcctgctgggatggcagaggagatcgggaggcagcaagggcggagaaggagggaacaggtgcatttgtacctcagcacaaatctctagggctacgctcctctttcatttgcacggtttctttggaaaaaaaaaaatccccaaatgaaaaataactagaaaaaagaccgaggttggtatttaaaatgctgatattaaagcaaattagaatagaaggcaaccattcattccttcatttccttcattcatttattcagtcaatgtctaccaagtactgaaaaaagcgaaaccatgttgaacattacattccaaaacagactaattcaaaaagttcatttcctgaaccctagtatttgagaaacatcaacaatatgcagaaggaaaaataaatgactaaaaatgttgccctcaaagcaagcacaaattagccatgccaatgaccctaactctaacaagagccttttaccctagcaggttatagtgactcatgcccagaataaccatatcttggaaagaaggaaacagacatagagggaaggtaggtgtcggagaaggagctaatgtctactaaaatctattacaggactgccagttttacacataatcctctcaatggtgcaacaaggaagatagatagtgcattgcccatttaaactgacaaagctatgtggtgtaagacgttaaataacttacatgtttcaacaaaggcctggaaagcatttttatccaatagtctacactgcatttttaacacatctgaacaggtattttgttcactgactacctatttttcctttctcctatctatgacttaacaaagaagtatgtaggaacccatgaaagtaaaactggtaaacaaagaaacaaacttaacaacaacgacaaaatccttcatgactactactaaattatggaaaactgccttattttattatcactgaccattacaagaagtcaatttatttctatttctgaaattgacctgggtagctttttgaattctggaaaaaaacagacaaggatagcatttatggtaattagcaagaggctgtatgaagttagaattatgcccctatgcatgtgaagtgaagattctcttatcaaagaaagaagtccttcttacaaaaatattttgaagaatatcttaacatatttggagaaactgaggtgacaagttattttttattgcattgataaacatcaaaagagtttatttttatcaaaattttcatttacatttacaagctctattgaaatataatagagcttgtactgggacatttaaatatgtttacctggaaaattcccctgcatggtataaggatgtgttttgattttctagctttcaagaaatctattaaatccttttaaaaaatgtgatatattgagcagtactaaaaaagcaaattattgtttatggatgtgaatttcacagtatagcttattatatagttatttagagcttcctctgagtgttctatgcatgtttgtgcaatttttcttttgtttagtgagtccctgaaaaaaaaaggtgaaaagttgaataggaattctgtgactaataacttttcttgtgtggccagaagctctaagatttttttatttctacaaaataataactgttgaagatttagaaacgtatttggtagcgaagtataagtaaatgctgggtattaaattatatgctgtttaacaaaatacaactatactgtataacattatatttttaggtactggaaatactttttttattttaacaatgattcttagctcttacccatttgacatgagtgggccgttcaagcaaaagatacatctattgttttcataggcaaataaattattggctacttctttgaagatgttctgctcatgccatctttactctcatttttaagacctctcaaggacctgggtattttcagtcttggctctgtggactgaactctccttggtgaagattccatgtgtgtttaccccagccagcagcaggctggccacagtatttccttctcctaggaggtctggctttagcaaactactcgttatggcctgggattctgggaaagtttccatatggatgttataagatgttgctgagaagtgctcgggttgtttgaaatcacatcaaaattgatggagaacaagtcagttcagtagaagcaaattgctgctcgttaaaatttgggaaagtttccgcagggaagagcaaaaggtattttggagctggtattcaggatctttttatacatatgaggtaatgctccctcaccaatgaggaatgcccccttctctttcagaacctttattgctaataccaaatgcgagaggatacttgagtcatctcagcactgaaaaagcctaaggtcttctcatttagatttcactagctttttaaaccacatctccaatgccagctaccaagttaccaagccaggatctaaacctggattttctgttgccaagcccattgtctttctctcatcaatttatctgccccaaataaccttcttttttcagtaagggagaggattattacgtagatctgcaagtgttgtaggacgacagatttcctttcaaacattgaactttatgcaacattttaatgcaacttacattaaaggtcagaataattcacctttttaaggtctcttccctagaagcccacatacagctaagaaaagaagtgaaagacaattactaaatataatactactagcaatgatgatgagaagactaatagaagctagcacgcactgatgtcttccatgtgccagacacttatttgaacacttgacatcttcttgcttttatctccctaatatctccctaataagagaaaaggactgttagtcttcctagttgtcagccgaggatttgaattttagaggaatttttccaaggctgcctagatcttcaatggtggttctggaatctgaactgaggcctttctgattccagggtccaagatttacatacaacacgctactgctttactagagatttactgatgagcaggtaataagtagccaccggttgcaacataaaaatgttatcctatttaacactttcctgaactgagttcatagcttgattttcttacatttttatggagctgctggagacactcaggctattatggacatttgtattgccctgtgttagccttcatgaatatgcctgattttcattggaaagctttgtttctcacgagctgtgaggtgtttcttctactggattaactcattctgtcaccctaatgctttcaaatattaacttcttctctatgtttaattatctgtgcaggacagggaaaaatgctgtaaaaaatttaaaaagagacgtaaaagttctcacactttttattttcttcaggtcactgcacactctgttgtgtatccaggaaaatttaggtagttgattattcttggagatattcagataataaggagatcacaatggttggaggtgccaagaagattccaggagagagagagagagcaatgatttagaaattggtgaatgaatttgcatgaacagagagaagcagcaggcccctcaggtgggcaaatacaagaaaaactaaagaagtcagaactcagatactcaagcatacactgcggccatgacagcatgacagctgcgggaaaaccccagggaaggtgaacactcaatctaggaaaatgggtttgcacatattgtactggagctaaaaggcagggaaaggcagtgacacctaattatcaaaaggaatgatttttatgcataacttttgagaagataaatcgcaggaaaaagaataatttaagaaaaaaagttactgggagaaaatggtatactgcaaactttggaagcaggtttcatgtttgtgtccccactctaacacttttgtataaacaagtgccttcacttccccactgtgctgtctgatttgtggggtaagaaaatagctcctacctaatgcagagctggtatgtaagcgttcagtaaatgttatcagctgtcatcatcatcctctttgtaataattcctggggctcagtcacagcaaaccattccattatttattctctcatggctgcttctttatagcttgatttttgcatttaacattctatcataaagacatatgcacatgtaagtttattgcagcatgattcacaaaagaaaagacatgtaatcaacctacatgcccatcaatgatagactgaataaagaaaatgtggtacatccataccatggaatattatgcagccacaaaaaaagaatgagatcatgtcctctgcagggacatggatggaactggaggccattatctttagcaaactaacacgggaacagaaaaccaaatagtgcacgttctcacttataagtgggagctaactgataagaacacatggagacatggggaggaacaacacaccctgggatctttcaaagggtggagggttggaggagagagagagtcagaaaaaaaaaataactaatgggtactaggtttaatatctgggtgatgagataatctgtaccacaaattgccataacaaaaatttacctgtttaacaaacctgcacctgtacccctgaagttaaaataacaattaaaaaaaaacataaaacatcattaccagacacatgattgatgatttcccttatagacacggaagttattgccagcaaagactcaccttcttcatctctatctttatactagcactatattttacacattttttaccaaatggttgagataaaagaaaaagagacaggttggatgaatgcaaggaataaatcatttaattcggctgctgaagtacctaagcaataggtaatggcttaaatcaatgcaaaggcaatagaaaggccagagaagacatagaaacaaatagttctttggacaatggtagcatctaaagtaatgggcagcatatggtaggaaagggaggaggagtcaaatattgcaacccacaacaacaaagttaatcccagataataaggaaattgatagcaaaatttgtttgaaggaaaggcgagaaagtaaattatgaaatgttaattttcaggtaacagcctgccattgaagcaaagtaatgatagcatatcctttctccacatgtaacttggagaatgagagagaataagaaaagtggtaatagtaaaaacaaagataagattacatgccaacaccaggtgaatgggacaacagtaaagacacacacagttttctgtgcaaggtctcaaacagaattaaacagaatatcaggttagtttatttggtttgatagactttcaaatagtccgtttttattaaaaaagaatgtccctacagtcaaatatttatccatctgtattagttcattttcacgctgctataaacaactgcttgagaatgggttatttacagaggaaacatcttaattgactaacatttcagcatgggcgaagaggcctcagaaaactttcaatcgtagcaaaagggcagcaaacatgtttttcaaatggtggcagaaggagaagggctgagcgaagggggaaaagccccttataaaaccatcagatctcatgagaacaaacttgctatcaggagaacaggatggggaaaatcacctccatgattcaatgacatccacctggccactcccataacaggggaactacaattctagataagacttgaatggggacacaaagcctaactatatcaccatctagcatctgtattttaaatataattacattttccaacagcatcgtttctgtcattttttgacaaagtaaaaaaaatcagtatattatataaattttcattgatatattaattaaatttgctgtatcataatgattaatggtatgcatttctgaatacaggattaagcttgatacaataaacaaataagatggatgcccctgtctgagttcaactacagatggagaatagaaaaaatacacaggttgcttatttaggaactacatatagtcatctattatacttaaaattctgtgtgtttgtgtgtgtgtgtgtgtgtatgtgttagaaggcaatgtccaaaattttgaagggcttgaataatataccttctcttgggaaaataatcttaagtcttccatgctaaaacaagttaaaagttaaaggaatgtagtgtgagtaactgatatattctttttaaacacacacatgtgcacacacacatacatgtgaacatacacacgtgcacacacacatacatgtgaacatacacacacgcatacacacactttacttcctaatagctcattttagatcccgtgtatttgttcaataattctatctattaaagcaatcctatgttgttgagcctgccaagttcagctctgtaaatatagcaatgcagcaatttcacttggaactcctacagattaacagagcatagccatagttgacagaactagatattttatggaggaattttaccttactgtaaacttcacaaatgttcagctcagtcatattccctatttagtggccttatatctgatacctcccaactctctacaatataaagagaaaaggtcatgtgaatattatctaattgaatttgttgtaatgatagatgaagtaacaaaacttttctgtgctgtgactcaatgataataacttaaagaaaatcataataagctccagaagatcttttgactctaaatgagaacaggtctcctttgggtccgagaaacccacatgctcagtggttatcatggcattaacacaggaagccacaggcggacagtccacactttgtgtctatcactttttgtctagcattttgtgtctagcactttactaggagctcgtggtggtactttgctccctatcccttcccacaaagattctccagtccctctctttggagtcctttttcttacctgctgcaacagcctcctttgtgatctttccatgtctggcccccatccaccgttcctactcttcccagagggatctttctaaaactcagcattgacagccgtttctccaccctcccttcttcagttgctctctgcagcaacttaagctccatagtctgagctagggaaatagctgactggccagccgcctgcccaggcatcttcctttcccaccctgagcttcagcatcctggcagaggaatgccacagctctgggaatgatctctgagaactccaagcagaatctgatggctctctgtctctactgccattttatctgtatctccatcataattccctccctgcagggatgactgtgcaatgagagcctgagcaccctgagacgaacacattatcttattgttttcaccccaggaacaagtggaatcttagaatctctatgtgcaatttctgacataataatattagtaatagtctgtatttttgaaggtctttattatagggtcttacattttactaatgttgtgatatagctaacagaaaaagccatttaaatccaaggatttattgtagaaatacagtattagaatgaggaaatagcagcctctatttttttcttgcttactctgtttctgcaacactgaatgcaatcctagggtagagacaggctgggatgtgtttagaggaaagtgcaatggtaaatgacagaaattttctttctgtcttcaaatatggataagactcatgtgaaaaaggtattttaaatcattttttattatggtctcagatagcgtaacaagcaccaattgatgaaatgttgtggaagacacatctacgaggagtatgtgcagctctctggcttttcactaagaggatgagaatctactcaaggagggtgaggttgaagtgagccatctctgcactctagcatgggcaatagagcaagatcctgtctcaaaataaatgttctacctcttctcttaggtatattttcaaagcacaggtataggatatcctactgaagtttcaggatgaatcttaaagaacacgaactttaacgaacttcttccctgagacatcatgctccttttttccacaacagctaactttcctgactttaaagtttcaaaacaaaaaacacttattaacatatattaaaaacataattatttcttataataaaaattaacaggaagacacataaaaaataatttactagaaccgaaagtcctagtaattgctttaatcaattttcttcttaatccttatgctttaaggaatgaaaatattaaattggctcacaagatccatcctagtatctcctcttttccagagcaaatgtgtacacccttctttttcaagcacactagacacttatgtaagtgtcagaggcatttcaacagaagaccctagtgccacacgtgcagttcacttaacttttactaattaggcttaaagaagagcatctttgtgaaaatttattatatcacaatgaagatccttactgcattttaaaaacagggaatttttctctcagaccatactatgtctacattattctaattcagcatattgaaaggacactattattcttgccacaagattaaatactaaatgaccaggaaataactgtttttatttttaaatgttgaaatatgtaatatttatgtctttcataaacatacacaaatattatagtagaatccgtaagcatgatcaaaacaaaaataattgcatgttttgaataataagaagaatgaactggaggttttagatcttaacatgtgtctcgaggcttggacaacaggacctttgaggaacagtaggatgacaagaacacacacgagtttacttaggaatttaagatccgttcagtaaatcacatcttttccattgtcttcactactccaggttcccacatccctgacatagtagcttgttagaagtggagagtctcaggccccaacccagacctgcaggatgcaaatctgcttctaaacagtgccctggtgattcatgtacactttaaggagtttgggtgttatccttgtttttgagacaggatctcactctgtcacccaggctggagtacagtagcatgatcacagctcactgcagcttcgacttcctgggctcaaggaatcttcccatcttagcctccagagaagctgggactataggtccgcacgcaccaccacacccacttttttttttttttttttttttttttttttttttttttttttttttttgagacggagtctctctctgtcgcccaggctggagtgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgcctcggcctcccaaagtgctgagattataggcatgagccactgcacctgaccaaggctgaattttgagaagcacatctctaagccaccgactgtatcatgagaaatttaagactgctgttttaaaaataaatgtcctactctggtcatttttcttatgactaagattagaggtatttggtgtttacttttagtcattcacatacacgcacacatacatatacacacatgtacatagaaaatattttataaatatattatttaaattaaaaatctgagcatgtaagagaaatgtttttttatttagccattattatttgtaagttgaattccttttattaatactgcttctattatgcttggaatccaaaagcaggtagtgttaacatggagcatttttcagtgttgacaatcaggttggttttattaaagatgcaaatgtgaaaatggcaagtggcagaaagaaaaacaaatgtatggtctattaaatgccatgtcagaaatgctaaaagcccaattatataaatcgcagaaaatttttctgtagagcatttttatatatcaaattgcagttacaattctaacttaatggtctgtttataagagacatgtctatcagaacggttaaaaaaaatctgaaaataaattgtaaaaatgtataaatgataccaaaagtgcattatctacaactaaaggagaaacatggtcaactgtcaaccacatgcttcactgtgtttggagaattacagctattttctaagtgtttttgtttgtattttattacattaattattacattaaaattggctctgctaagagtcagtatataatctgaaaataaatataccaagaaaaataaccaaacttttaacagaggagatcacattcttttagacataatctatttcaagaaaaatagccaaacttttgatagaggaggtcacattattttagacataatctattttaaaatgtgtgaaaaatttgatgaaggaccaaattctaaacaagaaatatcctcaggtcagtatatttccattacaattctgaacactaaatggacaaaaaccaaacagcccaacaaaaaacgttcacaggatggaaattatcatcatgaaacacagggagtggtatcttcaaagcaaaaaatgaacgtgtgtcaagaatgagcagagtagagcgcttctcacgggccggtcagaaacaccggagcgtcaagtaccatgaacctcctgctttgagttcatgatgttctttccaagccagagtcaaccgtcattaaccacagagagtggctatcctgattattgggtcattccctggatagtcaaacgctattcaaattttacaagttgcttttccaatttacaccttaatcatttgtgagtttagttaatttgagtcaaagctttcttctgctctaaccacttctggatgtataaaggagattttctctgaactataaattttaggtacagaccttgaagttttgcctattacacttgagaggccttcgataccctcaggtgctatgaaaacctctttatcgcaaaagcaagcttcttgcggtccacttttctctgtccgttcccactcaagttctagttgctccctatatccagccaagccgattaaagctagaagtttataaaccacagcactttctctcttcccagagtgattccatgagatgacggactctaaaacaaacgtgtgttaaagtcacgctctagagcctgcatccacgccaggctggcacacgcagccccgtttttcttatgcggctttgatgatgattcaattaaggcaggtatgagcaggagctaatacaaaagctaatacgcagaggtgctcagggacgccaatttctttgggttccctataaagagcgtcgcagtccaggccaaacacagggactgactgacggtcacctctgcaggctcggggggcacaggcaagtccccacttggaaagtacagctcaggggcttgaactttgcctttttaatgtaacttcccttcttccattttgctttcctgagttctactgatgtgtgtgctgtgctagccacaacttctttccatttcagtgtttcgtattgtctcttctccaacctctcagttcggttctagcctgcgcaggacacagcttcccaatcctgggtctgcggcactgtcccaaaatgctctccataagtgaggaattatatttatttagcataggtttttctttgtgataatggtatatgaattacctgtctatatttagagtagctacctcaatgatttacaattcacacaaaataatatctttggttcgtggtagcaaaaattagccattttcataggagcaactctaacaatattattctcaattttgaaaatgaccagtctctggaccttgtcagatattattttacataatgcttttctcaggtcatggtttaatgataattatactaattagtgtatgaagctagggttcttgttcactgaaatcttgtagaatttcttcattaacttccaaggagtaaaaaacataaaacacccataagaaagtatgtttttctaatttagtagtctcagacattaaagttgaactgaattttttcaccataattctaatggctcagtatgtataaaaatccaaatcaacattttaaaaaatagttcttcaactatttcaaatcagacacatttgaaaacatacacttgtttcaaacatcaacctatcataataaacttgtgttaaattgaactaatatatattcttttttatataaatttagtttttggtcaataaaatctcgagaaatgcgtaagaatggcatgtcaaaatccatacatttaaatcaaattcatacttttaaaattagatttatcttatgtaggtaagttctaatcaatgaaaccttaattttgtatacatacaaagttatagctatccagttgtctcagcagtttttggtcctagagagaattgtatttttcctctggcagaaaattaaaaacactattgcagcctaatggattacactctggttttattactaagagaaagaaatgctatacagtttagttacaaatgatttagtaacagcacctaagctttaataagtattaaatataaatatgtagctctcaaagaatgactatgtatagtattgaaagaaagctctcttagatactatttaacactgtggtatcatatattctttcttagagtaacttaacattttaagaacccattcaggcttttgtttgttcatctgactattcacttattgaaatgtagcagacatttcttagatgctagaaataaagagagagagagggagaagtagaatgtagagagagagtagagagaagtagaaataaaagaaaaagaaaacacagattttaagctttcacaattcttagctactgagggctatcattaacttagcatactttaatggagtaacactctccaacatatttaaatctataggaacacgcatttttgaacttctaccacaagtacagtgagatgctagtacaaatgaggggtgaagaagatgcaaagaaaatctcacactctgctgtatagaagggcttctgagcttgatccaggctcagccacttccgtgcaatcaagtcagctaacttttgagccaccatttccccatttggtatctcatcggtacgctttgaagtacaggctaagaatcaagatatggtttagaaaaagaaaatcttctaaactgtaaaatattatgaaattgagtttttattaagataatttttgttactgtcagcccctcacatcagaaaccccgtgacttcacttgtgctcctcctgctgttaaattaagccctctttgggccctgtttcttgggctttgcaccttttcatccaaaattctttgtccaattccgccctaaaacccccttttccatggaatcaccgaaaacgtatggccaacaaattccagccagactagatcttcttctaggtgacgtacttagagcctggtgccctttttgaaagaattcactcagaatagcgactgtaggcactttggcaggggttcaagggctatggttttaagcgttagtccttttcattatcctgcaaatctcattttaaggcaaatgcagcattttcttcttgcgaatggaagtggacttgctcaccacaatatcaggctccctcaagaatgagtgattcgtgtctttatcatcggtgatgagagcaattaaaaggtctgttttacatgatcagtgaagacgaagggcttgcccaagtgagaatgaaggaatgtgatctattctagcgagcatgcattttgtccaccacagctgggtaggataattatacaatccaacctgggcagcacaaactatgcagttcatttatgcatctgctgctgagcacatactctgagctgctggggctaatccacaatccacctcggtgggagtcaccggtagaaccttcactacagcagcgaggtcattctgaaggcatcataccatcaaaagataactgtgtgggttctctctcagagaaaaatagtgatacctggcatgtgacatactctgcaaacaacattctttaaaagcataattgacttagatcataaaagaattgtgggacactctagtgtaatgaatctgatgattcaaatgccatcccaaattagagagagggaagaacaggaataatttctcaagcagggaactcgtgagaaggcggttcagagaagccactgagtagggagggcctccccaccagaatggatcaccatcctctggggctagagctgcctgcacgacacaggaatggcaggtgctttcggctcctgctcctaagaggttgaagagatttggccaatctttacttatagggggagaggaaaggagtccttgttttcttgtctcttggagaatttctaccttcagtaatgaacacagcattttattgagacatgcctttttcataagtagtattgaaaacaagccctattttctactctgaacggagcctgctcttctcatttatttcataaatatgaagaatttgctatatgatagttaatattctaggatacggttttcatggcgagacacacaactaacaagattggtaagagcaatacaatagtgtgttaaaaggtggtacttatgtcagagaaaatttaagcaggaaagagaagagaaaatgccctcctaagtagagaaacattttaaaacccaaagcaaatcactacactgatatttgtcttaatttatgatcctcctacggtgactatattgtcacctgctaaatacactgaatgttgtgcttctctctttattctggagttagcatcattatcaaccttctgctttatactcagttgttgattttgcatgccttgtggcacaaggcttttccacctaccatcatcctggtctctagatgaatgagatgccaatgtcctgtggcccaagcacatcgaatactgtgtaaagcctgggatagaggctaaaaaaaacatcgaaacccagccaaagcatcatttgtaaatgtctctattcatcaactgttcaggtctcttttctgtcataacacgcaccaggatatctgttgttgctttaagcaaaggataatcaatgacaaatacactatttattgcagaaactaccatatgttctgccttctacttaccacaccgtatattggctctgctgatgtattagtttcactaagttatccatcttccaaactctatgtagaagtagaaataaaaacagggcactcagctgtgcccccaccctctgttgaaatatgactgatgaaaatccttccttagaagaacaatgacatgctaccaaccaactcacagagaaaacccacaacatgtttctactccatcaccttggcacataaacatcatgctcaaattcctttctcttaaatggaaacaagaagaaaagcaattcaagcaaccgattacaatctttagaaagcacacaagcaaatcatcatcctttctacaagagaagccagagtgcaccatctgagttggaaatgtgtgcatatggaaatttgttttcttagcatggttttctgctcctttgaatactttttaaatctgaaactaaggaagtcacattttatttgctgctgcagtatcatatttatgacccaagtaagggtgaaactctggaaagtgtggctggctgtgcgtcagttcccattccttgttagtttctttgtaactgttcgtgaaacggtatttatcaaagaacagacatcaggattattgggttcagcattctgagaagactcacggggagaaatcatagtgttttcattctaaattatttattgactggaatgtctccagaatttaaatttttagtctaaaattcaagtttgtagggggtgaatagcccacacctgagttgcagatattcaaagaatactcaaagtaaaatgcatttttacagacttaattactggttaattattgaataggtatttagtagcgtgttagcatcaccattgtgaacatatgccccttcgggagagttcaccactgtgaacatacgccccttcaggagagttattcaacaaagttattccggtcctgttactctgaaggttctctgctgcagacactgggcagtaattctgcttccttaactcactacaattcttctaataagttctaagctactggcattaattaatattttccctttgtcacggtgaccagttctgacccaaaactgtgtgtgtgtgcctgtgtgcgtgtgtgtgtgtgtgagcgcacgctcgcctgcccatgcagtctccactcgctttgctaatttcactgccacatctaatattgtcatgagtcatagattatcacagaaaagaaaatctattgattgatatggattagaatattcttaacaaatctgaaaactttttcattaaagggttaaatgttatctttagagagaatatgctcattttataaattttactacagatttcttccaaggttacttttagtttgacattggagtatcacaaaatcttacattaaacgtaaaagccatttaaatgttcagcatagttgctaagcggtccttgatagtgtaaacacttcatatattctgaaggtgtttagaggtattgccgtttggccatggaaataaggttaagacccttcttgagaaaggaattccaagaaccattagtgatgacttgtggttagcacgtgtattattttatttttattttactctagacttctaaaaccatgcttgtttattcaggaaaatgtcaatgatcttgtacagaggataattatctgttcttggaatgtaccagcgtcaaaagtttcactttaataattccagtttagtaatttttaatttataaatttaccaagttagcaatttcaacttaagaaattcattgcaataattttaataattacatatttcataaataatatacaccatctagatgcattaaaatgtgtaagtctgggcctgtatgacacattgtttaaaccataagatgttttgctggtaatttggaaagccagggtgtggatttacggcaaaaagagaaatgcaacttcaaaatcccgggtcttgttttgtctctagattgtcaagcgccactaatagaaaattagccaaggtcttcatggttccctcaagtgcctgtttaataaaacccttgtttaattgaaaaaaaaataataattattattatttttttgagatggagtctcgctctgtcgcccaggctggagtgcagtgggcgatctcggctcaccgcaagctccgcctcccgggttcaccccattctcctgcctcagcctcccgagtagctgggactacaggcgcccgccaccacgcccggctaattttttttgtatttttagtagagacagggtttcaccgtgttagccacgatggtctcgatctcccgacattgtgatccgcccgcctcggcctcccacagtgctgggattacagggtgaaccaccatgcccggccctgacttttacttttactcacctctctagaaactgctgaacagaaaattgagttgcttttttaaaaagtagtttagggttatcaagattcaatttccttaggataaatatgtgttgcaattaaatggtttagaaaaccttggattaaataatatctaaaactcttatgggcaatgcctcttaatttcatagtcattattatattttaatgttaagattttcctatattttgaaaattttatcagcataggtcagatcttttttcactttataagtaattctgagtggttcgtgatccagcaatgagactaagagaataccaaggacatacacatctaaataaaattaaaggaatctagtttattacaaattcattgtgattaaactgtgtattgagtttcccaatagaaacttgacttttgtcagtaaataccgaattacttcccaaggaaaaaaaaaaaaaagtagtattagcataaaatgtttcgttggttgcttttttatgcttgtttcagtatcaagggtctactgatagctgatgagatattgggatttagtgaagggactgtgaacacccagagaagcagtactaggtcttactaatttggatagctccattgcctggcataatgttggtgcttacagccatgtctgtattgacactttaagggaaggctttaacctggattgtcagacccttatatggtggctatttgctaagattatcaaatctttcaggaggttcctcacaccaggtaaagtttgatatacatgtgcatcgttaaagagagcatgtctgcctgggagcagtggctcaggcctgtaatcccagcactttgggaggccgaggtgggtggatcacctgaggtaaggaattccagaccagcctggccaacatggcgaagacccatctctactaaaaatacacaaattaggcagacattgtggcacgcacctgcagtcccagctacttgggaggctgaggcaggagaatcgcttgaacccaggaagtggaggttgcagtgagagtgagccgagatagcgccactgcactccagcctggacgacagagcaagactctgtctcagggggggtggcggggcaggaaaagagagcatctctataaaattaatttgatttcctcagtagttcattaccctaaatagcataaaaagtgtcctggattttgtggaatcatgagctagataactttctaaagttattttatccctttaattccaagattttatgatcctaatagcttaatctcacctacagataaaaaacagagtttattcaggataaataaatagcagcctcaagggtgaaaaatgccactatcaccctcagtgaattattttaacatttttaatggtcagctaccctttctctgaaacacagaccaattttattttccctgtcagtctgctgtggagttaggagcttggtgtctgacattgaggacctctgcgtttgcattctagctctgccccgtacatgcagagtccacatgatgtcttcggtttcatgttctctgtccgaaaatagtgcattggtgtgcagtttagtttccaattaatcatccactttctcagtaaagtgttagttccagagtcaggaagatccatgtaatctgagagtgggggaagtgcaaagaatatatacatatacacgactgtatatatgcgtgtatacacaaaatactgattagtatctacattaaatatgtatatgcaaactgtgtatatattaatacaaaaacatatgtatattcatgtctgtgtgtgtgtacatgtatcacatatatatatcacatgtatatatcatatatatgtatctcagttgctctttagttccttaccacttctctaggaagtagaaaaaaaatcacttcatcataaacagtactatcatatcttaatttttttgtctcagtgtataactgtgtacttgtcttgacaatacaatttcatttatgagcatttaaaataaccctctttcaccttgcttgaaattgctttatgtatttctctgtgagcaatcttttttattctcttgaacaatagatgaaacaaaagctctgaatttctgtaaggtcataggtatggactgaacttgtgactgattgtttcataaaaccttaggtactacctcgggtgatgaaggagagatctttgctagtggctttggttataagggctaaaacgtgaatacctctttgaaactcaaagttaaaactctgtacccagatgcacagagtgaaaacgaagtgaattaaatgcatgagtgaaattctagaaaaatgtaggggagcaagagagaggggaaaattgatgtgccatattttctctccagcagataaaatctgatggtgaaatgggattgctctacacaggggtggtttacctttggggcaacgaaaaagttgcttcttggatttgctccgtggaaggacaaaagtgaggtattgcagactaaacaggagagaaggcatcagtacctggagaaagaaggatggaggcaaagttcctgaaataacaagttgaggaactaggcagatcagcatgtcttttctcccaaagatcctgcaccacactttccagcgctattacagggcttcccagtggcgtgatgatgctcacagcagagccaaagaaaatcattactttaaaatacaattatggatggtttggtatataacgacagttattatttatccaatgcataataagagaaaatacatattactttatctcatttaaccctcacaccatccttaaaagatggatgctatttttggaaacattttatggataagaaaagcgaggcttagaaagctgaagtcacttgtctgagatcatacatacaggaggcaatggagacaggagtaaggcccgggtccccatgatgagctcatttgcttttttctgctgttctgggctgagtcacaaaagaaaatttcccttatattgtagaggatgatgaggaattttggaatacatttaaatgaccaggataaaaggggctagcactgtctgctttcattttgtcgatattgtaaggtctgtttttgtctcttccctactttccaccataaaccacacacacacacacacacacacacacacacacacacacacacatgcgcacacactcctttgtgtcttatgaattttcccctccattcttctttttcatttcgtacaagcccacactcgttgctcggtatactaagtcttgggttcatgattgcacctgccttccatcacttctcattggcacccatgaacctgacatcctcacagtatcaggcgtctcactgttccgcagcaggacatgaccttttgatgctgccttcttctcaggttccctggtgtctcttctgaccttctgctcctttaacagctaataccaccttcaaggcagagctcaagtataaacagtttacattctgatgggaacattccctttcctccccaccactgcctcctcctttactccatcgcactttcttcatcctgttattatttcgcactgtgataattgaactagattcctttacttcttctaagctagaaggtggcagggagttgttttcctgttcatctgttaccagcacatgcgagatgctttatgtgctgccaatttaaaaaagcaaatgaacagcttcaaatacaggaagagtaaaaatagtctgcccagctaaagattcgctttgaaggttgttaacattgacataacataaaaggaaaaatgtatgcgttgctcaccatatttagaaatgtgaaatatgaatcgtatgttacattaaacatttattcttggtggtagcaataaaatagacacttctgattgagcaaagcatgggctgaaacctgtgcactccaccattcatctctacaactcttaacagtcgggatctgccatttccatgtctcagagaagaaaataagattgactaagaagacaattgccagaaattgcactgttacccggtagagaaagtagaatttgaccaacattcaacttgaaaccttgtgttctggctacagcgctatcccacccacatcaggtattaattgatctgtagtgtcatatcccaactgggtcacatacaaataagtagtaactaacttgtatacttcccaaattagcatctgtgtcatgcatgcaatttttgcacttccaagtttagcataaatgcactcccaaaattagcgtctatgtactgcacactttgtttttttttttttaaagccaagtagggccaggcgcagtggctcatgtctgtaatcctagaactttgggaggcagaggtgggtggatcatgaggtcaggagatcgagacaatcctggctaacatggtgaaaccctgtctactaaaaatacaataatttagccaagcatggtggtgggcgcctgtagtcccagctactcaggaggctgaggcaggagattcgtttgaacccaggaagcagaggttgcagtgagccgagatcgcaccactgcactccagcctgggtgacggagcaagacttaaaaaaacaaagtcggatgagtgtggtggttcacacctgtaatccaagcactttgtgaatccaaggtgggtggatcacaaggtcgggagttcgaaaccagcctggccaacatagtgaaaccctgtctctactaaaaacacaaaaaatcagccgggcatggtggcatgtgcctgtgatcccagctacttgggaggctgaggcagaagaattgcttgaacccgggaggcggaagttgcagtgagccgatatggtgccactgcactccagcctggtgacagagggacactgtctcaaataaataattaaataaataagcaaaagcaaagtcataggccaaattttaaagttctcttgtaaaaatctcatgtccacgcagtatttcctgagtctttgttgtttatactcatgtaggacaatatttatgactttgccttcaacttggaaatattttcttctttatagcacttgacaatcttatgttcacttttccttttgggatattatcttctgctttgcaattagctataaccttcaaagtgctgctttctcctgaaatacttggttctgatgacttcaagtacttatttactatcttaatttttttatttaaataaatttactgtttctatgattgacatttatttttggcataacgttaaaattgatgtttcctgctttcaactctgtcttatacacctgtcctgattttctatttgatgtaattttttgatgttctactgtcacgttgattttatcagatggaaagttacttttcatcgtctccagcccccagaatctgccaaacacatctgtcaatggcattattagttttcaataattcgcagttaaagtttcacacaattttgaatcttgcttccgttttctgtatgtagagttacatattcattgctttttgaatctccctccaaaatgtcttcatgaacgctattttttccattcttaacgacactatcttattgttacattaaatcactcctagatgaaaccacaccaacctggtccaacgtgagaaactcataatgggctgctcggccttcagttttttcctttccagtgaactctacacattacctaaaacactggtttcattgtattattaacaaaatcaaactatatgatgaattatttagtatgtgtgagtattaagtcatttgctaattgtttagttcacaaatacaaatgctaaatctccaacctttttaaaacaaagacctttattctatgtatgttccaaaaaattctttttcacaggagtatatagtaagcatattctgtatcaattaaactttatgaattctataattgcacacacatttctggaaaactgttgatctatttaacatctagcataatatagggcatcatgatgatgaaatgggttatacagaaaagagctagtataaaatcacattgccatcatgcaaaattgagaaagttttaaatattgaagatttccagaaacaccataactcatcaattcaggcatactggccatatttttaaaagtaacacttggtttttttctgacccgaccaagttgaagaacagtggtgagttcatcatgacagtccagtttcctaaacgctaaaagttaatttggggaggaaataaattatatataaatgtaaataatatttgttttaaccccatgcttaatattattctggtctactccaacgaggtatgtataatgctattgaaatagagcatgcgttctagacttgtttttgcagatgtatcttcactttggctcactaattgtctcactccaggattaacttcgccctggaggatcagaaaaaatagaagctagacagtcaatttctagttttcaccccatggttccatatttcttttggagttacaggaaacaggtaaaataaatgtagcagcttcctgggagtcatcttgggcattttaggtctatattttctatgtctgctggataatagaagagctgggcccaggtataacacagtgactgaaaaagggtggacttcactttttaacctgaaagcaaacttggcagtccaaatcatcctttaaccggaaacagctgtgaaagctgaatgtttttaaaagaaacctgttcaaacacataagctggtgaggaaagagtgcagatatagaatatatttagattttattagtagactgttcttatacaatatgcaggaatgcattgtgtttaagaaactgaaacagaaatggcaagaaacaggataagtaggacaaagaacaaacacaaacataagtcacattagtactgagaatagatgcgaataaccagatttcacttctataaacatgactggatttactttatcaatattagtttagctgttttacttcaggttctccttagagaaaacaacttgcaattgactacattttaaaagtttgcaaaatgataatggaaataaaagatatacgtgactaatcataacctggctatcatgtcttgaatttctcctgtgtgctagctaggccccaactcagtctttaagatgattcaatatacacaaaaactcgttcatctatacaatagtcaccaattatgagctgtgatcctggagagcaggaaggttaactgacttattcaacatcaaacagataatgagtaccgcagctaggcacactgcaagagggagaactgggatttgcatccctaccatgtaggtgacacagactattctggataggctaagtctgagcaatagcctacaggagacatatctctaccaagttggattatgtgctctcttcagcttttatgaataacacatcataattttgtgtaaaaagcgacattatgctgggcatggtggcttatgtctgtaatcctatcactttgggagggtgaggcaagcagatcacttgaggccaggagtttgagacaagcctggccaacatggtgaaaccctgtttctactaaaaataggaaaattagcgaggcacggtggcgcacacctgtaatcccagctactggggaagctgaggcagaagaatcgcttgaacctgggaggcagcggttgaagggagccgacattgtgccacctgcactccatcctgggcaacagagagagactttgtctcaaaaaaaaaaaaaaaaaaaaaggaaaagagaagaaagcaccacattatccttgagacaggatttactgcacaaactccctttaggatatcttctttccttctctctgcgttacttttctcaggtgagaaatttccactgaaaccaaccaaaggaaataattggcaacattgaccaaccaaaatggtggtgtttttctgcttggaggtgtttgcatttccttctgataacaagagttacctggctctgatgctgttcctgtctttatctgggtaaggaggaagcccaccgactataatgaaggatttatatttcagctgtttcccaacgttgccttttgaatgttatgcttaattcgctggttctgattctttgtgttatttagaatttgcctctatgtattatgcattttcaagttgcacccaatcctggtagaatgagcaaggccatagattgtagaacacaaaatggcataaaggtgacataaaggaagcgtgagcaaggaaggagctcagaaaagaaagagatccctttggactgtgctggtcagtagggccttctagaaggaagtagtgagaggcagaaacgtcagtgtattagtccattttctcactgctataccaagacttggcaatttataaacaaaagatgtttaattgactcagttccacatggctggggaggcctcaggaaacttacaatcatggcaaaaggaatagtggacacatcttacatggcagcaggtaagataaagagagtaaaaagcccaggggaaactgccattaatgaaaccaccagatctggtgagaagtccctcaatgtcatgagaacagcatgggagaaccttcccccataatccaaccacctcccaccaggtctctccctcaaaacctggggattacaattcacaaagtgatttgggtgaggacacaaagcttaaccacatcattcagtggtgagggatgagggggatttcagtagcagacggtggagggtttgcctgttgcacagagtgaagtgcattgcatgactttgtaagaatgtcttaaataaggttccccaggaaacagatgcggagatggagttgatgtgcagaaaagttattaagatatgctctgggagcaatatctgttaaagagtgagggaaatgcatttgggctgagggagaaggtgaactttgacacatttgtaaaggcctcagcctgcctgcagctataattcttgttagtgttgtcttgacttgaggccagaggctctggtctctttaacctcaccatcagtgtcgttggatgatgactgccctcaggaaggatgccaccagggaaggaagctctttcacaagccaagagggcatctggtctgaaagccccagcagccagcaatgccaataaagggcagtggacagggccagcatgcaagaggctattatccaatggcatctgagcatctctgaaaaaattttaagttcaagggtacatgtgcagaatgtgcagatttgttacacaggtaaatgtgtggcatgctggtttgctgcacctatcaacccatcacctaggtattaagcccagcatgcactaggatttttttcctaatgctctccctttccccgaaccatccccctgtcaggtccccatgtgtgttgttcccctccctacgtccatgtgttctcattgctcaactcccacttataagtgagaatatgtggtgtttggttttcggttgctgcattagcttgctgagaataatggcttccagctctatccatgttcctgaaaaagacaagatctcattcatttttatggctgcatagtattccatagtacatatgtaccagtttctttatccagtgtgtcactgatggacatttgggttgattccatgtgtttgctattgtgaatagtactgcaatgaatataggcatgcatgtgtatttataatagcatgacttatatttctttgggtatatacctaaacatggaattactaggtcaaagggtatttctggttttagaactttgaggaatcaccacagtgtcttccacaatggttgaactaatttacattccaccaacagtgtaaaagtcttcctatttctctgcaacctctccagcacctgttgtttctagactttttaataagcatcattctgactggcatgagatctaagcatcttaatggctcacacaggatgtctgcaatagtcataggctgcaacatcagtgaaccacaaagtgcattctaataaatctatgtaattatctattgttatatgcactatttttagagtactatttgcttaaaaaggaatgcaaatataccagcctttggcatgtgaagataattcttctaatccttataaacttctgtgctggtttcctagtgaaatcaacatgaaggtgaatcgaggacatgtctgctgcacaaatgagattaaaattctcagctgactttatgatacctttgtggctagaagagtccatggcatttcctaaatgcctaatatgctactgactaatcctgtgagaattaaaacccattaatttcccaatcaatagaaagcttttaaatttgaatattctttagacatatattattggcaagcaggaatatttttatttctagaataattatacctatgaaaaaatagaaaaatataaaatacagcacaatattgttgtataagtatgctggtatcatgagtaacattttgtctatttcctttgttcatattcttcaaatttactctaataaaaggtgtattttgtaataatgattaagtttggggaaagtattttatcagctaagttttagaactaaatttagatctgtcaaaaacaaaaacacgcaaaaagatctgctgcattaggaaggaattcccatagaataatcataatgcctgtaatatacaactcatgtcatgaccttttagaaagtgtgcagcagaagttatggtagcatatctttctcaagcttatttataatttattgacttatttcagaccaaagttgcattattagcttccacactcacctccctttatcattgtgagtagcagtttggtgtcagaatacacagtatgttgtatctcggagcccagagtgattattagcagaagtatgtgtttgttaatcagactgcaggtaaatgtattcagtgaatatgcaaaagagtcttctacacgtaaaggaaatgaaaaaagtcactatgaaagcgaaatctaagggactagctgaaggttggtgtctaccagagtagccaggaggtcacaggagactatggaacattcaaagtgggctcttcagaacaggaaagcatggtcagtgtaaaatgcacaagggattttgaacaactaatggaaacaaaatgtaaaagtcaatttttacattaattacatcttgaaatcgtgttacttggtgtgtgtgtgtgtatatatatatatacacacatatatatacacacaattacataaaatatgttgctgaaataaattttacctgtttcctttataatttctagtgtgaatactaaacatttaatattgcatatgtagtttcatcataaattgtatatgtacttgggcagctctgacttagagtttgaaattccttatgttaacatagctgcgatggttacctcttattataaaccatttatctttaacactcccaaatgaaatcattataattcagaagcatatagactacctttattaaaataattaggtgtttttgctcaattaaatgatgcactgtttattctgaagtaatgaattagggcagaattatatttaactactgagcatgtaacttgttttatctttttgtcttaatattgtgaataaacctggtagtaaataaaatagcaaaatagtaccatgcatctatctatctatctatctatctatctatctatctatctatctatctatctacctacctatctatctatctatcaatctatctatctatctatctatctatctatctatctatctatctatctatctagattcccagtggaaaagcaaccaaaattaacatggaaaactcaattacaacttttaatatattaagactcaggatactgattaagaccaaataagtctcaaatgatgtaagtatagtagctggtgttttaaactcaatttcccctataaaataatggaactgaaataaatgtaaaaggtaagatgtcaccacctagcaaaagagaaccaaaatatctcgtatatttataattgttgtgctaaaatcatatctgcatggtacctgcttgcgctattttaaaatctaaactaatgggataattgtgtggtttacgggtaattggggagagagaaagaatagctgtttactggtataacatttaataagtttatatttataccagtaaactttgtttactgctatacatttaataaaatccattttatcggtattctgagctattacatatattttcatgctatatcaaacgtgtattttctcaagcatctcagttatttaacatgctgtgatttaaattacagatatcaaatttacataggtaagcatatatgtctcctaaaaaacatcaaaaaagtaacctacatttcaaaaattcatagtcccatcaacacaggaagaaccagtgcatccctctgagcctgagtgatgggccccgcatttgcataggacgcagcgtctccacctctgctgtagctgtgtggttctctatcaataaggtcattattcaggcccagatgcatcaccagagcgagctattgtgcttcctccatctcaattcagtgctcctgcagcctgaatctcctctgagctctttgaaatgaggccaaaaaaatgtatctaaattacaccatttactaacgcgaagaaaagatctttctttggtatgtattggagttaataatatttattaggcatctcatttatacaccctgccatagcagcattgtaggtagggttataattttaaaagtctagactggcttatatttctcaatatctggtggcgtgtgggaggagacagataaggaagccctctgcaaagacagactgtgagtttaccctgcacccctagcaagacttccagggtacagctgtaacatccagtgtcaaaaattgttgaatggacagaaaagataccaaactcagcatgaagttacaaagacgaagaggttaatacaggaaataaaaactgtcaacgatcaatttaacagcttaaagatctgggggtagaattgacttcaaaactgttattccgtgttttctttctgaaaactcttttggacaaaggaagaacagtccttcgtgaatttcatgtgctttgtagatataaagtaactctttccctcctgaatgatctcatccccaattatcacagcaagatttcctattgcattcacagtccttcctgttctaggtttttaggcagttaattcagtctgtgctgagagtaaaatataggtcacttacaaagaagggtgcattatttataatagtgacatgatgagagctccataatcattcaataatttattgatgacttcttataatgtatcaaccatttttctatggttggggcaccatagaaagagcagatctattgtcttacttgctgcgtattttctgaatgacttatgcctccactctttgacctcattttaccaattatacttaatggattaaatggtcactgagatataaataaagattgagtttcaagcaagttttgattgaagtatattattaagcagaaaatatgcaatgtactggttctggaataccatttcaagaggcagggcagtcgtttctaactatatgttaacttatctaaaagactgcaattaaaattattaaaggatcatggtttaatttccatttgaaatattttcctgaacggaaagaaaactaaaatacatgattaagccacgactacataaccctgagcacttcaaaatattgagtctgaacaaattatattccttatgccacttatgacatgtcaaaatatcagaccctgatagaaaaccaacgtctagtttttcatttagatcttacaagaagcagctgctagatgcccatgaattacgctggcaacagacagcactctgtctgcatcatctatgcaatctccacctccagagaggtaatctactttatatgagatttcgcattattcttgtttttcttgctttctctaaggagcacccactgctgaaatcatgagagtgaccatgtgtttttcagaggtagataataaaagttagacagtcgtattgtacagagattagggaaatatattctctataatattgggggtagaggtgagactatctttttgaaaacatatagtagagcaaaatgtataaatttagaacctagaaattagtatcaattcacaaaggagcaatcatgagattaataattttctggcatattacttttttacaattttatcaagtttggattcaaacaaattgaagataattttacgttatcgtctgtattcttaaaagtattaagtcgagaagacaattagtattccaaggaatggaattcttcaaattaagtgttctgcccaaattggaaaccagccaagctgctctctaaaaatatcaatttaaactactgttttctaaaaaagagtggaaagatttttgtctactggatttagataattctctttggtgttcttaacccacttttcaaaacataaaaatttgttaaaaaaaaaaaaacccatctctactaaaaatacgaaaaattagccgggtgttgtggcggctgcctgtagtcccagctactctggaggctgcggcaggagaatggtgtgaacccaggaggcagagcttgcggtgagcagagatcgcgccactgcactccagcctgggcgacagagcgagactccatctcaaaaaaaaaaaaaaaaaaaaaacaacaacaacaaaaaaaaacctttgctgaggatggttatttgaaggtaatttccatgttgcacactctttatttaaaattctagagctgtttattgaataccctggaatggctatttcttgtttaattaagcaactgcatgttttcgcacctatgtagagagctatcacacagcatgaggaacaggtatgcaacgcatgggctcattcactgggttcaaatcttgggtctccctctgatgttcacacagttaatatagctcgtgactttttttctttattttttagaaactgtgttcttccgtctcataaaaaaaatggcatagctcttacctaggctgaatcttacaataatgactttccatatgtgccacacaaagagtttagctattaaacagctctaactcaggggtagcaatcccttctgtgactgggatcattttcacttcattgttctccacaaaactgaagaagcacatcatcggattgtcagataatacattgaggattatagtctttcaagataattcactgtatactgtttcaaagcgtaattcaattaaatgcagttcagttcaaaaagtgtttgcagatgcctatttagtttaaaattatactgctgggaaggaaatggaaggcaaagaaagaaatggaaataactcactaattgatcaactgagatatggacaatgctatcaacctcctgagcagctgagaaaaaattggatgcaaggcagaaaactgctcactaaagatatatccaagcaaacttgctgtgctggagcaaacgaaggagtggctaattcagattgtgcccaattgggcaggcatcaagaggaggaattttagttggggtttaaattattgggataatttccataatagagagagcctgggggttgatgaaaggtagctggatgtggagttaacaatagttagagagagcttagtaactgggctgatttctcttggcccagaagctaatctgttgatttacaaacatttatatcattaaatgccaaaagggtttgaagaatcgagcttagctaattccacatagtttccaaacatttatgtaaagattaaaaaatgtattacatagtttggcattcattcaaatatatattttttaatctttacataaatgtttggaaactatgtggaaatctagctagaagaaagacattttttcaaaggttattacattaataatattttacagccaaataaacttttgataaaatgtacaatgctttgtgtactagtcctgtagacctgatgcattttccatgaacatatgttgcctactaacagagcatgtgctggtgcgttggcaacaagtggaatgaggtatggagtagcagaatatcctgtcgtgactatcttacctgctagttacctttttcattcggtgagccaactatgtatgcatgatgtgggggcctggtgtaaggttgttaggacacaagaagaaattaggtttgtggattgaacgagaacatcgtccaaagccgtgagacagagttctccttcgatcacgaatatatacagaaggctaacgtgctttacaaagaaaagaagagagctgcaaccagaaagtcaggcaactatgcaacgacctaaaattcactgcattgcattgtcaggataattgagaaatatgctttctgcccaaatcttgcccaacatgcagcagggcatttattgcgtgtttactgaatgaaaaagcaacaaaatcaattaataataaataactcaggcactcccatggagcccatggtggctcctgagggaatgaactccgaactcaggcttccaagtaaacagaacctccactaatcctacggtgtttcttcacgcctgatttatgaaggtttgtacgcacaatgagagttggattctacatatgttacatcaatggacattatgttaaccatgatttcttatgatttctcatatgtataaatatataaatatacattaaatcttatgttgatattttccgcagggcttgaagattaggccctattaaaaatatgtacagagacactttgactgagttaagataagaagatagtctaaaaaagaaaatatttcttagctcttgtcttcttggaaaaatgtactatggatacaactaaataatacctttcaggaaatactgctttataatgttatctaaagtacaaatcctcccaactttttatatctaaaaatgatttggatttcgacaaagcgatgcagtgggttaataacagtttggacataccatgttaatgaacactgaaaagcccttagcttattgaaggccataatttgcagatgtacactgtcgagtcccaaatggatgcaaggtgaaaagaaacaaaacttttaaatgccaattaaaacaagtagagttgactatcatggtgatagaaaatagacatttattttcaaatgtagagacttgtgaagaaaatcacatttgcctttacgaaacataatccctttctttttattctggtacctgtgcactatcattctcattaaaacatcatcctgaccaatcccgcacatagctcactggggctctgcctccctcaccgctggctgctggtctacctgcctgagaccaacttacccccacatggattagtatctcaccatcctgtcctgtgtgttctggggcctctcctccctttccgcattcatcaacacagtcctccctaggacctgcgacctgctattactttaagcttcttcgtctttcgttattctacatttagctacccacagtcacctttttatgaaagcattcacaggtacccaggctggatgaaacaccacttctgtgctcaggcttgattttgcatttatttatcctttgtgcaattatttgcttacttaaggggttggtgttcccaaacacttatttacccgaggcactggagcacccaactgcccaggagtgtccctctcctgagtgatgctactagctagtttacagtgtaggcacatcttattgtaaaagatgaattaataaaacaaatggaaagtaaattttgcatccttcgtactcgagggcgtgggtcaatctagcacagagtgtggagcatggtgggcattcaattcacatttacgttcaacagacacatgcgttgagttagtcttctttttaatgtcttcagccccttgcataggaccttccacccagcagttatgtgttctctcataactgtaaaagaaaattataaacagatgttttggaaaacaaaactagtggtgaaaattagcaggacattgatggatgactttgggaagatgccttttatgttggaatgagcttcccatgagtgctgctctgtgggctcctccttcatgtcagcccctaacctccgagagagcacaggtaagaacccaccacactcattcgtatactcgcctatgatcgtaacatgagccggtacacagaggaagacaagtccatcaaagcttcctgttctttccattcagaaaatccttccatacagtctgccgggtgtcagcgactgtgttaaacgtcagggaaacaaaaatgcattatttgcagttgattctcttaaaggccttggtgcttagctccttagctgagttatttgggatgaaactctgtggtaatcatttgtttgagcctcttctgtagaaaatgctttggattgcacgagctcagagctgtttctgatttgttctgtttacctggtcttctctgcgtggaaggggtgatacccgcaaagtacagtcaatcacagatgggagggaaaggtgttggcgttcccaaacacttacccgaggcactggagcaccaaactccccaggagtgtccctctccttagtgatgctactggcttgtttacagtataggcacatcttatgggaagagaggaattaataaaacaaatggaaatagaagcagttattattcatatgggaaggggaggtggctgagacatgacttccacttctcccctttttcctagccgagtcttccagcaatcttgatagacgttattgattcctcaccatttacctaaaagtcaggtaaataaattaacttgtgactaaactgttatttcatgtgaagaagagaccaatatacctgactgtaaggtactacaaagccatctcggggaatatcatttagaatgtgtgaggcaaacagttaacagcttggggcttgcagatggacagatctggttcaaaatctacttgctctatgaccttgaccatttatttcacctttcttgattttagctttgtaagatgtggctaataacaccacatacctcatggctttatagataagatgaaatgaagagatgcatataaaacactggaaaaggcagccagaacaaattgagtgcctgaaagtacacctgaaggaatctttctcagtgtgattaataagctactacaattaccgtttaagtaagtatactatgggttttattcaatgagggaattatgcatgaggagcaaacaagtgcaattttactattcttggcattttgggaaaactttagaataaggtattatctgaagatcacttatgaagataaatacctatgtattaatataacatttgaaaaaaattatgaaatacttagaatattttcttttgaagtaaaaatacctatgtcaccaaacagcaattttgccaatgttgcaaaataagcattgtaaattaatgaatattctaagataatttctgatctaaatttcatctgttgaaaaagaaacgggaggcttggaaaggctgacggatttgtggagctgcacgtcagttgcataggaggtgggaaacgaagtgaagtccaaaccaggtaagtcaaggcacagcctgctgcccctcccttgccttttacaatgtgaattgccacgtttagcattttctacttggcattttaaaaagcttatgttgttgttattatgttctcttaaagaatatatgcatcccaccactaacatcattttttcctttaataaaaatcatgaatcctcatgattaattgggattaaaaataagaacaataacaagttatttactctcaaaagcaaaagctggacagaaactctctctccctccctttttgcagaaagacattattctgttactccggttcctttctcccattcaggaaataaatcacagaggacacaaatgcatgaaaagatacttcatgctcatagatcaaaatacttaacgttgttacaatacccatagtaccagaagcaacatacagattcaatacatattcctatatataaatttttatattcctatatacttataaattactgtatatatatattcctatatacatattcatatatgtattcctaattacatataaaatttgtaaatatatatgtgtatgggaatatatattatatataattagcaactatatatgtacatagaaatatatatataatatgtaattaagctattatatatatatgtagtacgtaattaagcttttatatattatatatatttcctaattcttatcaaaatcccaatagcattcttcacagaattttttttttaatttctaaaatgtgtgtggaaccctaaaagacctcaaatagccaaagcaattctgagaaaaaaatcaaaagttgaaggcattacacttcctgatttaaaattatagtacaaagttatagtaatcaaaacctatggcattggcataagaaaaggcacatggaccagcggaagagaatagagagctgaaataaatccaagcatatatggtcagctaattttcaacaagagtacaaaaaggatacaatggggaaagaataatcttgtcaaaaaatggtgttaggaaaacaagattttctcatgcaaaagaatgaaattggaccctttataccatacataaaaatcaactcaaaatgaataaaaatcctaaacataagacctgaaaccatgaaaatcccagaatacacaggggaaatgctcgttaacattggccttgacgatgatttcccatatatcacaccaaaaattcaggctacagaacaaacaataaataaatgagactacatcacactaaaaagcttctgcacagcaaaggaaataatcaacaaaatgaaaaggcaacttacagattcagaaagcaatatttccaaaccatatatcagataaggagttaatattcaagatttgtaaataactcatagcactcaacatataacctcatgttaaaattggtgaagatatgattcagtttaaacacacattacacagagaagactgaggcccagaaatggaggccgctttgcctaaaattagcaattttcaagaggcagagctggatgaggaagtcagtctacattctgtaattccaagtttctaataccaatgttctctaccatatctaattgtattaaagtttctcccagctgacaataaataagtcgattaaaaagaacaccaggctttgggccctcttcagggaaattgcattgctactgcagagaagcttgcattccattttaaaatatcaaatccaaatcaaaacattactttaaatacacatcctccgtgcgaagctcagtcgtgagaatgcgcagttatgctgcattactgattcatttagaagttattagtttgctgctaggcattttccactctaaggaacgaaatcctgaaaagaaatgggatgttgaaatattgagtaattaaatgttgaaacgtccgtgaattcctgattaacaccatgatttctacgcagtcaaattaaaacatacgcaaagtaaaaacttcacccgtgtcccctgtgtccagcatgtcaggctagcggagggagaagtctatatgagagatgatggctgtcatttcacagcgcaagttgttgactttccacatccctgatgttcccaaagtttgtttttatttccatcaacgataccttttctgttgtggttttaatccacgagggagtctgtgctcaaagcggtgggcatgaagggagcctccagaatctgcccctcggctgctactctagcccatcccggggatctcgtgataattcctgcaacaatgatcacaaacattctggcttcaaacaagacccatgtctcgtttcactgctctgcaggttaaaagtcccacgtcggtctcactgggctaaaaccaggtatcggcaggctgtatttcttcctgcaggcttgacggggaataggcttccagggtcatttgggtccaccgagagcagaagtcagttccttgtggtggtagggatgaagtcctgttttcttgctggctgatgtccacgcatcattctctgcttccagcagcagcctgggctcctcaaatcctcacactcctctatcctaaaagtcagcaacagtgaaccagtcctttacacgtcaaatctctccttcacgtcatctttacgcatcttctatccttgctttttttctgactccattcaaagaaagttctcggcctttgaggacttgagtggttaggttgggtccaccctgataatccagaatgatctccctattttaaggcctatagctttaattatatcatgagcgtcatccggtcatggagcaaaacataatataacattcacaggatctggtattacagcatggatattttgagaaaagtttttagcagtcacatatgtcttaaagtgtattgaaaaatatcaaagtgttttgaattaaaattttttcttagtatttttatcataaagaaaaatgtaaagatgtggaatctgaaggtacagaaaagaagccataaaaatgtatctgtgaaaggatgtgcattgagttaagtttgaggcttgaattcagatgaagtggattcagatcccggaagaacctcttggctaacagatcagtcttccagggcttaaggtactcatctaatttcggatactaacatttcctaagtttgatatgtatgtctgcttctgaatcattccatgaaatgtggatttaatcctgttattaatgatgaataacgtaagaaattgggtttcttacaatacttcatccctgcaacattgctggaatataacacatgggacatttaaagatacatggatgagtatgacttctagcactgaccaattaacaagaaatgctcatacaggttgaatatctcttatctgaaatgtttgccaccagaagtatttcagatttcagatttttttcagatttgggaatatttgcatatatattaccagttgagtgtccctaattaaaaataaagtatcagaaatctgaaatgttcctgtgagcatttccttctggcctttcctttgaatgacatgtcacagctcaaaaagtttcagactttggggtatttcagattttggaattatagattagggatactcaatctacaccaagctagcagtttggtgtttataaacttgcagttctgccttctaagctcactgactggtggctttttgtttcaggaaagcagaaactgaccagaaaatcccaatagctccttgtttctgcagcagttgctttactaacgtatcgctgtttgggggaggcctgtgcaccccagagcagcacagagattctttgtgttcatggataaagaatactctcagattgcttcctcaaccagtttttatgattcagttgaaagaaagttacttttactttcacactgaatcctcctttctcgtctatatcaggataccaaggattcctcaggagtgtttgtcatctccttttgggttattgaacgagcactgcaatgtgtttgtgcagcctttatcgtcaggctttgcacgccacgctagtgtataagcaccactcttatgatgaacattacccatttcccttaaatactgatataatcatattaaggaagcaattaatattatcaatctacatgccatgtcataaattcccaataaagttaaaaaaataaaaatttaattgtgtgaattacttttgaaactcaccagtgcccaaactattaaatacgctttctaacacaaaaatcctactcttggctgggtgcagtggctcacgcctgaaatctcagcactttttgaggcagaggtgggtggatcgcctcaggtcaggagttcaagaccagcctggccaacatggtgaaaccccaactctactaaaaatacaaaatattagctgggcatggcgatagatgcctgtaatcccagctactcaggaggctgaggcaggagagggttcacttgaacccaggaggtggaggtggcagtgagccaatatcgtgccactgcctaccagcctgggtgacagagcgaggctgtctcaaaaaataaaaataaaataatcatcttttctttccttttaaatagacagcatttgcgaatggggcaatgttaaattaacagtgcagtttgaatcttactttcctgagcaagttatagtaattgagggcaggtctctcaaaactgaaggaaatccatgagtaagatcagagaaccaaagcattcttgaatcccacctccagttggaaacatccgcatgtaaatgtaaattaattatggtagtaagtatactcctctaacaatgccatttagagtaatatgcttgatatttttttacatataggaaataaagtactttataaaaaagaatatcatcatgtccaggcagacatatagacattctgataatacagaattaataccaaaagtaagtttgggagttaatcaactgatgtggtttggatccatttccccaccctaacttcatgttcaattgtaacctctaatgttggagatggcagaagtattggctcatgggggtggatccttcatgaatggtttggtgccatgcctttgttgctattctcataacagacttcccaggagaccttgttgtttaaaagcctgtagcacctccccgccaacccccactcgctctttctctcttcctcctactggaggcatgtgaagtgttgattccttgtttaccttccgccatgactgaaagttacctgaggcctccgcagaagccaggcagcttccagcatgatgttctctgtacagcctgcaaaaccttgagcaaattaaaccccttttgtttacaaattacccagcctcaggtatttctttaaagcagtgtgagaatggactaatatatgaacaataggaaatcaagatatacaagagcaacagaaggaaaaatttaaaaggtactaaagagcaacagaaggaaatatttaaaataatatgtgtaaacagaattttccccaggaaaccatgcagtaattctaatattctcaacatcaactagaatttgattatttttttctgattgtaggacatatcactaaaataggaaaaatagagcttgaggatgaatcatagaaaaactgcaatgattacatcaggtccagcataaagtctccagaggaatcaaggtgatatgtagcagtgaatagatggaaggaacactacgaatttttatagaaaagtgttattcaaagatagtgtttagagtttataaacttccatgaagtatacaataaaacagaatctaaataaagtctgtgcttattgacttcaattagaaattaagatattggaagggtataaaataagcaatcattttccttgtaagaattcaggggttcctatcagaaggaccaagggtaacaaatatgatttatttatgaaagacagaataaaaaagatattttaagcaactaatcaatgttaattacaagcaaactttagacaacacttttattttcaaaaacatcatcttatgctgtttaagaggaaagactgctggaccaaggcagcgtctgtcatggcccacgtggggatgggatatctccagaatgtgtcctgccatccaagagtctgctcactcgtgtggatgtggatgcactggggatgggtcctcttaggcattaaaaccaatcagaaagttccccttaatattgttaagaaatatttcttcaatgtaatgtaccataggacagaaaaggcagagagaggacaagttagggagtggcacgccgcagccatcctgaattagtcaaggcagttggagtccatgaccaacattaaatgagacggagggaacagcaacctcagaaatgccagcacaaaaatccaggacttgagggcagtttgacaaattacagatgtgatgattctaggaaatgagtgtttggatctcagatttgaagaagcaggcaccggcccagattgccaggacaatcacagatgatccagaacaccaaggtgaagaagagatgaggcgacccacattagtttagaagagagcctgttcccatggtcactctaggaagtattttcacaaaggcctaaatatagagaaacatggagttcatttcaagaccctcctgaaaatttaaactagcagcatgtatataatattacttgttgctagttttaatattaatatgaaaatattgctactaagttttgaacaactgcacagtgctactactatatctactatacgttaactcaggttattcttatggtgcctctagagaattcttcggatcctcatgttatattaggcagcactcgggctcagagaacaagaagcagagttgtggttaggaaccaacagcgtctcagggccccataggaatggtggcaccatatttctgtgaaattccactacgggctgcattgttctccacttctgcataaacgttcgcgttcaatgatacctccaggtactatcacatagaaaatatttaaataggggggttgtgaactgacataagtcaggattctttaccacagggagacaaccagaacactggcttgattccaattttaattttgtagcaaagtgccacatactacactcagttatattttagaaaaagttgtgaaaatacaaggaatattatattagagccagacgatttaaattttaattctcttactgatttctgattctggagcttccataaattattttactgttttctgcttatcttcatctttaaaaggagatcataacacttccacaacgttactaagattaaaggcactggtgtttgtaaaattacgagctaacaattatttgtcaatatcaatttagcgtattcttgtaaaacaggtgactgatttctatctagtaaagttcggtgtgttgcatggtgaactccagcctgtatcctactgaaaacattttatttagatcagtccttggtaataatgctgccagacaatagattcacagtgagctccacattgagacggataattaaacacagtccatttcaacttcctgttttaccttgtggttgttattttaccaaagacagctaaaccatgctgagaagcagagcatcctctctgaagcaggaggcaaggcagtgcgagaaacaattaagtctaattgactcagtaggtggacgaaaccagaaaactgggactagtaaatgagagagtgcctttggtagatgagatgtctggttttgagcttggggatgatgaagagagagagatgtctcagggggacatctcaaaagaacattctcccttaggtcacaattgttagggacagatgtgtgcctagactcctataataagatcagatttaagaataaaacaatcatcccagtgtatacctgaaacataacacattttttaaaagcagtacacagagctgttgttccttatcagctaatcctacatgtgcagtaagaatgtacataccctttgattgtttttagagaatttgcttttaaaatactgtattagcttggtacagaagtgattgcagttttgccgttaaaaacaatggtgaaactgcaattacttctgcaccaacctaatgcatgtgtgtttcaaaatgtaatacatgcacatgtatctacacaaaaagaagtcaaagagtaaacatgaccagggaagcatgtggtgtttcagacttcacatctacaaatctcaactaacggcaactatgcacttgacttctgacacactgaaataaatcctcaaataaactacctatcccacatcaaagggctactccctataatacggttgtagtagggatgtgtgacaaatacgttttacatagggttaagcttttggtttcatgatggcaaattcttaaatatattcccgttctagatggtagtggagagttaaaattcagacacataaacacacacaggcatactggtgcaatattttaaaattaggatcagtataaacatataaaatacagtttatgtataaattaatataaatatacattacatataaaacaaatatgtcataaaattttccattcattaaaattacttatgaaaatattcagatttgcaattattaatgaataatctatatcagacatcagcaaactgtggcacatgggctggtcatctaattttgcaaataaaaaggtcagagctatttgatgataccatatgtggcctatgatatccccattgttttgatgatttttccacaaaacttgattttcttctcattcctttcaatttattgattctagagctccggtggtaatttgaagtacctggactttttccaggaattgtaatgtattttctgcatgagataatgcacaaaaagcactttgcactgtaagtggcacggtataagcatacagcaaatcataactttatagatcaatacttcccgctaggaagatcaacctggaaattccgtgagagggaggtcatgtgcaggtcctacttctaccactattgaccctctgaccttcatgggagtggtctagatctgagtcaaatacacctgagtagcactgtccaatcagaaatactttccatgggactatgcccattttatagtgttaatctttaggattaaaagctctcatagtggtttgtttaggagaacataacatacacttcattagggctgcttagaatagcagatgagatgcaatgatcaaaagtcagatagtatttactttcaagaactgctatacaatgtagttaggacaaaagaataaatgattaacatttacaatatatggaagcaacctgcttatcctgtgggttttaaatagccataatgttaagaatgtttagaaagaattgataggtgggtgtttaacagtataggtatgcaatgaccagattgatatatcttaatcaacatttcaggaattgacagctgtacatacagaatccttacgagaggccgtatcctcattttaaaactgcttttattgtttaaaattttagaactcctccttgggaattaactgaagtcttcggtttaaaatattttccagtggtggcaaacatatgctaactggtctgattaatattgttatgttaacgtctcccagcctcctgtagaaattgacattacttctgaatcccttccatgtataggggttttaccaaaattttcacaatatatttatttttaaaaaatcaagggaaactaactcgaactggctcaaaggataattttttacagaagagttcataatccctttaaaacttttattactaccagcaacattacccctgtgaaagagaaaactcaccacaatgtatatttaatgaagctcattaatttatttttttcttatttccctatgcagagtcctaaacccaatgcagttagagaaaaggaacattaaccaagggttataaatgtcaagaacaaaacggatatcatgtttagctcaaaggaacacaggaagcattagctgtacgcctccagcacttctcaagcttctctggcaagctggctttagcatttttataaatagtctccattgcaacatttcatcactgaaaaatccagacacgaatgtataaaaccaaaggaaagtgtaaataagaaataaatcctgctaattgcggtttgctgatgccagagcccttttggcaatgacgacccaggggattcctgggcctggaagcctgctaagcagcatcttccacttccaaacagcagcagcaactgctccccaggcttgctgcttcggggccttgctttttcttttttctttttttttttctccaataagaaaataaatacaccttactttggccaaatgattgttaaataaattcttggcttttcagcaaacattcttttctcttctctttcacaaacaatggaagcaacaagccattcaattctgagaccctcatggggcacgtacttcaggatgtctgttgaatatgatacacccgcgttttgtattttagcaacatttactacagtcacagacttgtgccataattggccagaccttcagcatctttgacaacctagtgcgcctatgataggggattatgtgtaaaaatgcaaacaaacaaaacctttatttatgactgccctgaaggtgtgcagattggcatgctttctgagcccaggctttgtctctgtatactgcgctatataatggggctttggctctactgcataatctagaactaattaggacattaagcaggtgtgatttaaaaatcagtggaactcaaggcagttcattctgattgatcagtcgatctgtctgtctgtctgtctgtctacctacctacctacctatcatctctctctggctcctttatatagcccttttaaccttttatctgaagaaaagagaaacgaacctgccttgatgttttgtgcccaaggtcctattgtaattattattatttatatttatttttttccataagttattggggtacaggtggtatttggttacatgaacaagttatttagtagtgatttgtgagatcctggtgcacccatcacccgagtggtatacactgcaccatgtatgttgtcttttatttctgacccccttcccactcttctctaccaagtccccaaaatccattgtatcatttttatgcctttgtgtcctcatagcttagctcccccgtctcagtgagaacatacaatgtttggttttccgttcctcagttactccacttaaaacaataatctccaatctcatccagttcactgaaaacgctgttcattcattccttattgtaattattttttaaaagcataagtctttataaggctcaagcaatgacctgtttttgtcactatctctcaatcaaaggtcagtgtcttaccttaaatagggtaattaccacctgcaaatagcttttcctgcttctgaacctcattttcctttctgtgtcccgccgtcttgttaagatacactctcatcttctggtggtgtcttttctttcgagtgcaggtgtcacctgcaatcccacatagtggctgtgctttgtgcccaacctagcaaatacatctccgcaagaaaggaaagaagcctgaagggcattatgtggtgaggcacaatggctaagcatgatgagggaatgccctcctgcagtggatcagcatcatgaaaacaaaaactctcccacacaaaacacacggggtcacacttggtttacaaccacgcatgaaacaagagatccctttctagatcactctcttctctatagtcatttatcttacccccatccaagaatgcttactgtcagatttataaataactgaccgtcatcttatctgatgtttagcatggaggcaacataatctcagacaccagccttttagaaagagatcacatacaagagataattaaaaatcataaggccaataggataataaaagtttcacttttgtgggtcaattagatcttatttcaaatctagtcttttgtctattgttgtactttctgatcctgtacttaatcaaatgtcctcaatgtattcaactgtaaaatggtatcggtcatgaagaagtcaggtgatggagtatatatgcacatttctgggaacactagaaatgcttactatatggtaaccattcttaatcacagcaattaatatgtgaggaataatgatcatgcagcttctcacctaggccagtaaaacatcattcacgatgacggttccatattttagtttacatatcgagagggtcaggaacatggagtgacttataccacatacccagctagtaaataaaaatcaagacttacaaaaagctctttgtaaaaaatatacaaatgacaataaaataaactctgacttcatttctccagagtttccactcttgcctctatttatgcacctttctcagtccaaaattatagcccactaaacaccaattatttcaaattacagtagcacaagcagctaggctatgccttttaaaaagacattacagtagggaggaggaaggggagagaggttgctcaatgggtacaaagttacagttaggaagaaagagttctgctgttctattgcacagtagagtgactctgcttaataatgtatatctcaaaatagctagaaaagagggttttcaatatccttaccaaaagtaaaagataaacctttgagatgatgaatatgctagttaccttgatttgatcataacacaatgtatctaagcattaaaactactgattataccccataaatatgtacaattattatgtaggtcaattaaaaaataaaactttataaaagacaccacagttttattttcattacatatagaatttgaacactttagatttaaagaaatcttatttaaggaccagaattgtagattttggtctatccatagcaaaaccataaatatgctctaagacattttagttttgtgccactgagcttagaaacacctacatttcacattctttgtaggtactgaaaataaactctgcatgtacagctattttttactgtatatttttgtacaatatagctctactgtgactcatacttctgcagatgagtattttatctttgtcgctttaatttgaatccaaaaaaatgaaaatacatgaattttggctatattattttctagttagtaatagtttccaagattcctgattatatctattttcacatggtccaccaatttaaatttagaaagcacaactcaagctatttttttcaataaatgctaaaagctttatgatgtacatgttttttggaggcagaaaagtgccatatttggattcttataaaacaatgtttttaaagacactcaaaaaaaaaaaaagacgacttcagattagaaagaattgggtcaaatgtgagatccagatggtcatgtctggaaatggtagcattaactctataaacactgacctctttcataaacttcaataaatgattgtaaaatcaattcagtccacagatattcaatcacagagttaacatgtcatatgtaatcagcaaattcatctctccaacccacctgaaattttgtagatagttgaaatacacttaacattaggcattaaataagaattgtatttcgtgaaacatatcatgatgtccactgtcagaacaggaaatcaagatggtgaataatacactcaaaaccacacaaggtaaaactgtcctccagccagagtgccccaagacccgcagcgccacagcctcctaatcagaggctgggagagagctgtacagtggctgttccagctgaaactacattctgactcctcactctcaattcagtgctttggctttggtaatctgctgccctggtcagaacaatgtatccaagattaaaccggaagtattgtcattaaataaagaaaaacattaaaacgtttatgcaaattacatggctttccctggttctaaggaaaacctagctgtgagttgttcaaatgtgtgggttagcagtttctcattgcagtgcctcttttcacttggcctcctgctccagggagctcttgtcatgaacaggctgaagccagcccgaagcctgtactcagaagggtgtcaattattcatcctccaaacttgagtggaaactgcaagcatatcctctttctagtaggtcatccagctggtgatgcctcatttgtaactgtggaggctttgacacaaggcatcaaccagcctaaggaaaacattcttatattggtgatatcactcctctaaagcaaatactttatgtcggcttttgtgacatatttccacacactgaatttgaccgtgaataaaagttggctcaatatagagttaaaagagcttaaaagttcccacagattggatgaggtgcatggctacaattaatcagtacgattagtgaaaattatggataaaaaaagtgtatttgataatttgtaaactttaacatatttttgagggattgtcataggatttggttctctatgtcttgacatttattagaagatagccaagggtacacagaataagtcagttgcctgattcatatttatgtactcaagtaaaagtttgttcttacaaaatgaatattttatttgacttgtttgaacattgcggcctattgtaattggaaaagtcaagcccaagtaaacaggctttaccttcctctagttctataactaaagatttggctcccaactcaaatagaaaagcgtgtagcattctgtctaggaaaattccccctgcagggtcatttaatgaactgtgctaccttgtaacacaagcaattacaaagggaagaacaaactcatatggattttttaaaattttgaacccgtgattaaaataacacttgcattgaaattttaactgctgttttacatagaccaaatatcttcactggatgagaggagacagaccctttagtgttttaagatttagttttttctacctgacacaatttgtttcctttataattatttcacttactgttaaatttcttttttcaccgatggttttaaatatccattatgcctccattaaaagaagggcaaatatttttgaaaattcagaaggacctagtggaagagaatgtagataatgtattggaatgttaataagagatttaaatgaagtcatatctgcaaagatcttaaacacaattctctcttcatataacatgaaaagaagaatctcagcaaagcattgtgggttggcaggaagactagaaggatatgattccattaaaactaaatttgctgaggtctattccagcccttgagcgaatctcatactgacagcattgaaagtttatgtttgtaaagatgactaaattaggctcataagtggtaaaaaaatgcaatactaaaatggaagtcctcaagttttaactgatatcagaaattctgaaatcagttctgggcactgaattattagaagtggatatttatataactatcaggcaagaaggaatctctctgggtcatgagtgccttctttcttctttcaggagaatttttaaaccatgtggaaaagatagcatgtttccatagctttgctgaatatgactcctagcctgatctattctgctgctcctagaagattgtaccagctcatgcctgttagtctagagcagtcatgaggaggtgaacattggcaaaggtgattttcataatggggcacattgggcaagttactggggtgcaaagcattggtggaagactttgctcttaggctgatggtgtggaggtggtctcagagctggtatggaagaggtacctcagttcagaatctcttaggtaccaaaatgcccccacagtgggttagatcaccattagctcatgcagccctttgctaagctttggacctcaagaccagcagagacttagaaagctgattaccctagacagcaccagagagcttggtttcctgaaatgctgtgattcacatccatctccatagtcctgagccacttggaagtcatctgacttcagggggctctgagaacctcagctcacacacagactcagagtcccagactttgcttttagagaaaaatacaaactgacaaaatgaagaaaggagaaaggaagggaggatcaccctttataatagagcacatcttactctcagtgcatcatacaaataatagtacttttattctcccgggaaccttataagatataagtgttgcccagactcgttaaatggtgaaactgtcacttggaaatgattaaagatgttcttcatgatcctaagacacaacggggcctggattttaacccaaacagtgacagcaccaaagactgaaccctcctcagtcatgcccctgaattaaagttttcaacaattataggaaagacatcctgcatggtagccaggttagtgcagcttacccagcagtggctggagcttcctaagaaatagaatagccaacatttgtacataaattataaaaatacgaataaaatggctactgtgcagatgtgtaagaccaaaaaaaataaatatcctgtttgcttctaaaaatggattttaacagccacttatgagccctgacaacccacctgctctaccatcttggctcttaagcaagaatcttatttcaccaattcaattcactaacgggttaaaaaatatccatttaggactattttttctttcttctttctttgttctagaagtaaacactcctacaaccaggtttattttaaaaatgtgaatttgggtataatattttacagcagttgagattaaaatggcaggtgcagaacatgcatcggtcaagtaaatgaataaataatcacttctaatgtggcatctccagcattcatcatgtatcttgctgattctctgttgaacaccacagatatctcattttattttattggcaatgagatgtaaattggtggttggtagttttctgcttttagacaagatgcttatatttagagagcatttaaaatacagcagtgtggcatttgaggcatcaacattcgtaagatgatgcttgaatctctctctgatctgagcctgaatccaatctagaatacgttcttttacaaaattctgttctatctggttttcttcaacatgcaagaacaatttgtgaaagtagtccattatctttatttttttttcttaacacatgtttcttttgcctcaaacttcaagcatgcatacatagatttgtcaattaatcctaaaagactgaggtctacacaattcagactatgaatgatacttccaagaaaatagtaattatttaagtgaaatgctaagaaataagataaaagtagtttagctagtacttcatttaaaaggcactttttaaatcttaatgtttttaaggcaatattgttggtatactaactgaagactggagagaccccgtgtgtgtggcaatgtggaaggaagcagatagagcagtcaccacttctaattactggtaatttctaatattagatctaattactgatagcagggtgatactcggcctccgctggctcaacttttagagggaaactatccgcctatacccctccgggttcggccgctgtagcggagctcggaaagagtggcgcagggtcgcggggccccgccagggggcgcgcctgggggccgcgcctccttccccgcccagagatgctctctgatcacccctcttttctagagctctgcctcacttaccggcgcggtcgcagccctcagcccactcaggataatggcgacagctgaggtactgaacactggtaaaaaattgtatgagggtaaaacaaaagaagtctacgaaaagtcctcctgcagtccaaggacaagattacagcaggaaatgtagctagaaagaatcacctggaaggaaaagctgcaatctcaaagaaaatcaccagttgtatttttcagttattataggaagcaggtattaaaactgccttcaccagaaaatgtggggagacagctttcattgcaccccagtgcgaaatgattccaattgaatgggtttgcagaagaatagcaactggttcttttctcaaaagaaatcctggtgtcaaggaaggatataagtttacccacctaaagtggagttgtttttcaaggatgctgccaataatgacccacagtggtctgaggaacagctgattgctgcaaaattttgcttcgctggacttgttacaggccagactgaattggatatcatgagtcatgctacacaggctatatttgaaatgctggagaaatcctggttgccccagaattgtacactggttgatatgaagattgaatttggtgttgatgtaaccacaaagaaattgttcttgctgatgtaattgacaatgattcctggagactctggccatcaggagatcgaagccaacagaaagacaaacagtgttatcgggatctcaaagaagtaactcctgaagggctccaaatggtaaagaaaaactttgagtgggttgcagagaaagtagagttgcttttgaaatcagaaagtcagtgcagggttgtagtgttgatgggctctacttctgatcttggtcactgtgaaaaaatcaagaaggcctgtggaaattttggcattccatgtgaactttgagtaacatctgcgcataaaggaccagatgaaactctgagggttaaagctgagtatgaaagggatggcattcctactgtatttgtggcagtggcaggcagaagtaatggtttgggaccagtgatgtctgggaacactgcatatccagttatcacctgtcctcccctcacaccagactggggagctcaggatgtgtggtcttctctttgactacccagggtcttggctgttcaaccacactttctccagaaggatcagctcaatttactgctcagatatttggggtagacaaccatttagtatggagcaaactgtgagcaagcattttgaacacatgtatttccttgaagcaggctgacaagaaaatcagagaatgtaatttataagaaacaatgccattgaaatttttaggggaaaaactacaaatttctaatttagctgaaggaaaatcaagcaatatgaaaaggtaattataaattagagaacacaaataaaatgtattagtgaatcaatgcttctctagatccatactaataaacatgaaaacctaaaaaaaataaaaaaaaataaagggaaactatcatgcttaacttaacatgacatctgcttttgaaacattttatacattttaaatttatgacacagaaactctccctgctccttcctgactccagggcaggcacatgcccagtgttttcaggtgttggaggttggcagcatatgagaaggacagactgtagatgcagagttctgacatgaactgagatcagacagcacttaaattcatggttaggactctcagccttgaaatcagactaccagggtctcactccttgttccacagtttatttattcaacttcttgggacctcagaatcaccatccagaaaaggtaatcatgagaaagctacctcttgggattcttgtaagagttcactgaaaatgaaatacaatgttgtatgttcagatgaatgctttgtgcttagaaaatattcaataaatattatttgtagttaatataaagaagctatcctgccactgtttctcatctatgaagatgatctgaattataatccccggtttctaataccaaacatgcacaacaccatctgtggtttaaaagcagtcaactatagacaataaagtatgaatttcagctctgtgtctttgtagctctctggctctgggtgatttttacctacactctcgtatctaatattgatagtactgtgtatccccagagtttacaaaataacgcatttaaacgcctggcacctggtttacattggataaatgctaaagccacctcacctatataattttactgtgcatctacctgggatctaccaccaaagcttttgttcacaatctggcaccctaggtttgggaataaactgtttttctcactccagtgtggggaagtttgtgttgcatttttgaatgctggcatactagctgtatgtcagaatttagcatgttccagaatgtacttatttatgatcctgtataagataaaggttgattgtatagcaatgctcccaacatagttcatgtagtaaattttttaagttatcactgtgtaatttagggaagagatgccattttggttcttgctattttgtttatggaaaataagtctaactttcttaatctcttttagtactcttttattttacagacttgcctaagtaatagaatttagtagtagccatcagatctgttctgccagagaaaaatgtacccgaaaaacgtatcttaaaggtgctatttctctcttcccttcatgtgcaactcaatggaggccaagttatagtgatgaaaaggaatccaggattatgtgtgaatcttcagagaattctaggaggaaaacattcgatgagttttgtgggaaaatactaagctccatcacttgtgatatccaatattcagttcctttggacaaacaagacaaatacatacagttcaacataataagaatattgtatcacatccaagctgagagccaaatctgagagcacaacacattcaaaatagccataaaaagaataaaataactaggaatacagctaaccaggaaggtgaaatacctctaccacgagaattacaaaacagaaagaaatcagagatgacacaaactaatggaaaaacattccatgctcatggacaggaagaatcaatattgttaaaataaatagccatacttcccagagcaatttacagattcaaaactattcctttcaaactaccaataacattttccacagaatgagaaaaaaactcttctaaaatttatttggaaccaaaaaagagaccgaaaagctaaggcaatcctaagcaagaataacaaagctggaagcatcacacagcccgactttaagctatacaaccaagctacagtaactaaaacagcacggtactggtacaaaagcagacacatagaccaatgcaacaggttacagaacccagaaataaagccacatttctataaccatctgatattttacaaagccagcaaaaagaagcaaccaggaaaggactcccctattcaataaatggtgctaagataaatggctagccatatgcagaagaccaaaactaaattcctacctttcaccatataagaaaatcaacacaacatgaattaaagacttaaacggaaaacctaaactataaaaaccctagaaggaaacataggaaataccattttggacctaggccctggcaaagacttaacggcaaagactccaaaagcaactaagacaaaagtaaaaattgacaagtgggacctaattagactaaaaagttctgcactgcaaaataaactatcaggagagtaaatgggaaacacaagctagtagggagagagacggtgagagagacggtgagagagacggtgagaagagacggggagaagagacggggagggagaaacttttaagtgagacaagaaacaaacacatggagataagccaagaaaacagaccactggtcttgagaggagaggtgcgtggaagaagcagaggcagaaggaacgtgcctggggttgcaggggctttgcctgtcatggacacagaccttcacgaaggtgggcctctttccataccaggctttcttactacttcttggtgtggacttgtttttactcctttctttgacaatgttttccaattttctttccaattcagccctttgactccctgaaagtttatgtgttgtgggtgggaccccatcccttggtctataaggtttgtgatcttgaaaagtgaacctaattttctcaccacagcgctcaaggagtaacaaacaatccaatcccctaaagttgtataagagccactggaaaaatgttttgtctctttttggctagaaactaacgtgaggaaatctgaagcaggaccttaagcagcaatgttaccaacgtaagggttgagctcacttaaaaatgggcccaacacagaaggctagttaagacatggagagagaggccaggatctggtaccattgtgcaagccaatagttcaagtattttctgacgaagaagttcaatttccttcattagcatcgtgtgctaaacatttcactttgagattcctccagtttgggtggcattctctgacactgacctacaaaattccaacagatatactttttttcaaaaaaaaatttttttagcttgcattcagcaacaattggttcatcttattcgaaaaggtagattaatttagtttctttatgttagttttcctttttttttaaatacaagattgtttatccaagtgtcctttatagtgtgtgtctcaaaggttaatcctaaatcctatctcactagaaaagtggtgacattcttacccaagattcactgcctggttttaactttaattctttctatatggagatcccttcctccgtattttctaacagaatctctctccttattttattctttccttcctccttcctatctttctttcccataggtatttatgaaataaacacaattagccagacacaaaagtagagattaaatgtatagaactgaaaaataacagtgataaaacaagcaaacacatcctaactacacccctataaaggtgcatggtccctaagagttctaaaattcttaaagtagtccagtagcaagaaggaatttgctttaaaaaataaaactctagtttcaattccagagacatttcgtcttttcatctctactcaatattcagcagtggtacagccaatcagtctatctttgaactcatcagctgttctgaatattcttcattttctattcccgttccctgggcagttgtggttgctgtctgtgctttgggtgatcacgcacccattcagccatacaccacactcaacagttgtcagcacgtccatgcaagaaactgttgaatagagtctcttatggccctcttttagactactgttttctaatcttttgtaattatatgggacactcaatttataatcaatgggtccagaaccaaaaggaacaattctaggaagagctgccaagaagctgcattcaattacaccgatgcccattactacggggtgttttgtcactcagtaccatgcgttccaggcgtacttgtaatatttaaagtgaccaagtgtttccaaagctcaattttaacaggtctctccagcaaacctttccacctactggttttgtgctctctgccagcacatttgagttcatatagagttcagtatgattaaaaagggatgcaaattatatatgtatatggaatatatgtgtatatatgtgtatgcaatatatatatatatatatatatatctccacacacatacataagccattaagccattgcataatttgacattcaaacatccaagtggaaaatataatatagcactgtcatatacaattttttcttttgtcttagaaatatagcataacaggtcagcaggtaccaaattctttaaccttcaatgtccttgatcatggagtaattatgagtaaataaaaattaattgcagcacaagacatgatcatgagttagttttccttcatatttacaagacctaatctatgtatttgttttaggctggaaaaatagaacctattctctcaaatgataacacagaagaggcatttttattatagtactataactactacactgatatcattttgaaacatagaataaattttgtttcaaaatatggtaaaaatttcaccttttccctcctcccccagctctttatcactttctcctccagctccatcccctctctcctccccaccatctcccacgccatctccctggttcccagacacctacaccagggcacagtcatagctgttctgcttgcagaaattatttctatcatttactgatacaaactttttagtttgaggcattgctcactatcatactgtttcaaaaaaaaatacagcactaattattgctgtcaatagcaatgttgacgcctctgctcaggagaagaaagtgtacatggagaggttggaggccaaatcttcttttacaggggaaatgacattcattgggatgtggacattcgttttaccatcttgaaagaaatctttctatgacaaatcatggtcagtgatctagaaagcaggccacaaccccagaataggaaaaaaaaaaaaaaaaaactcctctgattaaaagtttgttaataagaatgatcaggtagcatgtctgatgaataaaaatgtgatgtaagttgaggtttgtgtgaaaatgaactggcacttctgttaggaatagttaactacaaaggcttacaggagtatttgcatacattttaaaagcagtttcttataaaactatcttagtgctcttgaaataatttgccttaaggttggatttatatttttctcaaaacttctggagataagtcagataagtactgttccctcatataatgctttattctctaatagacagtcaaactcaatattgttctcttcaattgttaaatatattattttacattttaacaggtcacttggatcatttttatcacactttttgtcagtaatattttgaaaaatcccacattgtatataaaaggcctaccattttgatattcttgcaatttttgttaaaagaaggtctctgcatttccttagaaatgagtgactatttctcatataggagggatttcttttctaacatccccattagaaaatcaagacactattacatttaattatcttatttatgacagcatttaaaacaaaatggttcctcattgctcttaaaatccagtacaaaatgggcagcaagtcactgtgttctgtcccctgctctcctctccatctctgcctgactctccctcccccacgtccacctatgtgctgagagattcttccccttctctcacccctcacacgcctctgggctgcaaggctgatgtgctccatagtcaggaacctccccattgtccccataccttctttcttctgctgactgctattggcccatctctcttaaggccatgtggcagagtattttctcaggaaaaaagctctgaacagattattgagccatttgaattccatgcccaaattcggggactctgaagtagtttgaatagaagcactcaatggtccaagttacaatttaggaaaactgacctccaagacaagaactggagtcaggtgatgatgactgcagattgcaggtggcaagaaattaaatcaggagttggtcatttagaacgctgggaagggagtcctactattgtttccatggtggagtaaagccagagaagagaaagaatggtgccttaggaagttgggtagaaaggtcaaagaaagatgtggggggtgggtgggtgtgtgtttaagtttctgctgtctttaatatatggaaggtaatagtgaagaatcaggtggaatagatacagcaaaaaataacaacagtagacagaaactggtaaagacgtctaagaatgtagtagccacatttttaggtgaaaagacgcttaaccagctcacatattgaggtgcaatcagaacacatttctaggtctgctggtgtcatagctttttttttttttttttttttttttttttttttttttgagatggagtcctgctctgtcgcctaggctggagtgcagtgacacgatcttggctcactgcaagctccgcctcccaggttcaagcaattctcctgcctcagccttccgagtagctgggattacaggtacccagcaccacgccaggctaacttttgtatttttagtagagatggggtttcaccgtgttagccaggatggtctcgatatcctgacctgcccacctcggccttccaaagttctggtattgcaggcatgagccaccgcacccggccagctttcttaagctttttttcaaattttctgttttttcttctttaaccataacaacacacacttgttcctcagaaaggaatttctaggataaatgagtacaatatggaaaataattatcttctgtgaactgggatccgcagatccaggcggagaggcatcctgacaggtcctccagggctcttgtcagttacctccgtacctgtgcacgccttcaggtactctgagtgcaattcataaatcacactaagtactgtactgaggcagcccttcttcaaattaaacacaaatgagctataaatggaaccatgaggtgttgttctcatgttaaggtagactgaaaatattgccactaagggaaatactcaaggctttttaagccatcactacttgatattatgttatttcttttaagcctctctgatatgtcataaagcaaagaaacaaatacagctaagggcaaggcttcaggtatttaaaatgtaacactcaccaggagagccactggcattacaaagacaagtaaatgttcttattccacaaggagtttactgtctgtggagagatccaggaccaaaaaaacttaagcctcatcaaggtggtttcgacaatgaagggaagaaaatgcaggaagaccagctccccctgcatctagttgctccaaaagcctgcatgaaaatgcctcctttgctgtgaggctggaacaaggagctggccagaggatttggcagaaggcattccatggagatgagatgacaagcgaccaacgtgatgatcttcacatatcctcagccagacccagctttataaagtttattcctgatctccctgtctaagggcatttactttaggaaacttgcatttgcaattttctcctctgcccctttgtaatgtatgtaaatatctttgagagcttcttgacagttttaccaccgagaatggtctttctcaatgacctgggagccatccctcagacacgctctcagactagagagcacccctgtctcccactcactgtgggaggctgcagacctcggctccaagaccactgattagcaaacacaggtggcatacccatggggaaaaacactgggaaacaaatgagcaaccaactcaacgtggtggactcatccattgaccatttccctccttgtaccagggctcaaaatccctcccattttttatttcagtggagccgaattcagtccccttccccttttgcaatcacggtgagtaaattcccctttgcatgtttatcttgtgcagtacaatttctcttggacaattgcaaaggtctggggtcaggcaagccgcacatatgcacacaactgaaacgctatggacacattaggtctctgagtgtggctgcatggagggggcaggacagagcggccctgattgcctggtcatcaggcctttgtaatgccacccaaagtgaggtacatcttattccataaagaaagggagactgtcagctaattcttaagagagaagcaacagattctgtccatgtgttctggaatgcagtgagaatcgaatcagagatgaatacagatgtgattgcagaggccatggaagaaatgagacaaacccaggcagcagcatctcaggctccaggcaggcagctgactgaagcccacacagtaaggacaggtttccaatgagggagatgaggtttcatcctttactatgcatggtgagttttaactgttttgaaaactatgttttaaaacaatgatgctgctcttgcttttgtggcagctgagagtgcacctggaatgaagcaggagaaagggagcatctgtgaaagagtgttccgcctgaatctagggatcaagctgccacttcaaaagctgaaaacagcaaaagcagaacacctaagtaccaaatataggtcatgtttttattatgttggcgcaaaagtcattgtggtctttgccagcacttttaatgcaaaaaccacaattccttttgcaccaacctgacctaatagcaaaaataagtacaatataaaagtacgaaattattccagggtatggggggagagagaaaaagagattgaaacagtataaagcgaagatatagaaatcatgataaaattatctgaagctaataggaatgctttccttaagattcacaagcaacaaagatacctccttaactgggataggtacatacaaatgtagaagataagtaacttttataaatgctgagactaatcattcagagaaatttaaaaatacttgtgctcatgtaacaaaaaatgtataattatcaagagaaaccatataaagacatttcctcatggattttacgaaaatcatcttaaatacttataaaattccacagaagggcatgacagatctccataaatgaagacatacatatgtgcctagactacagttttcccaaatgcatctatgcaaaattattccagccaaaatctcgaagcatttttatttttttattatactttaagttctagggtacatgcgcacaacgtgcaggtttcttaagtatgtgtaaatgtgccatgttggcatgctgtacccaataactcatcatttacattaggtatatctcctaatgctatccctccccacttcccccacccaatgacaggccccggtgtgtgatgttccccttcttgtgtccaagtgttctcattgttcagttcccacctatgagtgagaacatgcggtgtttgttttctgtccttgcgctagtttgctgagaatgatggtttctagcttcatccatgtccctacaaaggacatgaactcatccttttttatggctgcatagtattccatggtgtatatgtgcatttttaatgactaaaaatattctaatttttaagggagatattttatttttaaaaaggagatgagattttgcaatatataaaatgtctattaaaaagtacagaattgaaaattgcttactctgatatgtgaacagacaggttagtatctgacaactagtcacaggcaagctaaggtggaaaataaactctcaaaaagttaccacactgtgtgttggaatgctttttcaataaaaattcgtctaaaacctggtcaattctttcaagaaaactataccagtcttccaccatacaccaaactaattttcagaaaaataccaatttgttaaaaaaaagtagaaacttacatttattaataggtatgtaacattatgctgataaaaacctcattagtagaacttcaaaagtagaaactgggagaagaaaaataatcattttggctgcctaaagtttcatataacctctgtatatcacagatgccataaataaatgaaaagataaagtaagacctcagaccaaagtaaaaattcagcaactgtttgcatcggccattcttgatctgccctccaaattcactctccatgcttctgcacgcccacatcctccttcctcaactcctccatcctctgatatccaggggggtttccagcaggagcgtgggctggtgaggacagaggtcagggcttgcattggccgaccctgcgcatctttccttccgggccatgggtcacgcccctgggatcttgatcaactcaatacatgagagatgtgcttacataaagtcactacatgacaggcactcacaagggaataagaaaaaatgttttgaaaactgtaagagtgaaacggtaagggataacaccgatgtagctcaccagttcataaaaggaatgatcaattggtaaagaagtttatcaaagatgttcaatttaatttataatcaaagacatgactggtaatacaatgacgagtaattttagccctagatcatataagtgttttaaaatagtcatcctcagcccggccaccatggcaaaaccccctctctactaaaaatacaaaaattagccaggcgcgtaatggtgtgtgcctgtagccccagctactctagagcctggggcaggagaattgcttgaacccaggaggcggaggttgcagtgagctgagattgcaccactgcactgcagcctgtgtgagagagcaagactccgtctcaaaaaaaaaaaaaaaaaaaaaaaaaaaaaagtaatccctgggcactcacacaagtatctgaaaaattgggactttattttcactgctttggagattatcaatacaatatttattaaaaacaaaattggcattacatgtcaaaaagctttacatttgacctggaaattttacgtataggaatgtctctttaaaaaaaaaagtgacaatatgcaaagagataagtattagaatgctctttccagcattagaaactttaacctgtgtaagaaagtactcaaacattcaacagacctggactggtaaaatgaactatgcatgcagctttcgaaagcgatgcatgtaccctcgaacatgcagactacactgatgcttctcattttttctaacataagaaaagtttgtaaagacatcaatcaaaatacagtaattatgttaattactgttactattacaccaaaaatttgaatgatataaaattgaatatcctgtgtattttttatataaagcgtatcctttttgtttcctatataattgttattaatacaagaaaggaaaattggccggccgtgacggctcatgcctataaccccagcacgttgggaagccaaggcggatggatcacctgaggtcaggagttggagacgagactagcaaaacccaatcgcaactaaaaatacaaaaaattagctgggcatggtggtgcacacatgtaatcccacctactcgtgaggctgaggcaggaagatttcttgaacctgggaggtggaggttgcagtgagctgagatcagagatcacgccactgtactccaggctgggtgacaagagcaagacttcatctcaaaaaaaaaaaaaaaaggaaaattaaaaattaatcacctttgtcttaggtttaattcctgggaaatcaatgctgacacaagtattcatgtgagagtgatttttaagaagagttttctgataaagacctcagaccgtcagaggcagagcagggaaggacgcctagcaaaggggtagagtcacagacccatctttggtgcaatcccccagggggctgtggagcctcagagttgtccaggtcagctacgttgggctaagttctgcagcaaccctcattccagagctgcattgcttaaggcctctggccactttggtgggatgggcttttgggtgagacaccacctaggaggtgggtttcgggacctggggagggcacctgagtggtgggtgcagggcacaaagtccaagccctgaaacctcaactttaattcttccctttcacacatggaacttacgtcttgtactcatcacagattctgtaatatcggaaataaatctcctgattgttattttttaaaagcagacttctttccttagttttatcccaagttgtaagcacaactgcttgcctgatgtcttcaatatcttggattcaccatttaatacgtaaaaagtaaaagggaaaaaaacctacagatctgaaatgataaattcatgagccaaaataaagaaaagaaaaattggtgtcattttacattttttgtatcttaccttaaatcaatgtcttacttcagactgtctgtgcccttttcctacttctggtcatttcttagctaaatcttattgcggccaccttgaggactgatctatgactttctcagcattttcaggtcacctttaattgcaaaatgaaatatgaagtatcacagacaaggagggtggaagtggaagatgtgagctataaattgctgctgctgctgccagaacccagtactgagcagattcaaagtgagagacaccctctccccgtgggttctatttcggccagtcagctactcttagcggacttgacagcctcagatggcttttttttttcttttcttcaaattgaggggcgcaagtacttaatgtcattttgaagggcagcagttactaaattagaaacaaatcttttctattaatttaactcttttgcatatctcaatcatctcagttagtgagcacctctatgccgctttgacacactctggattctgaaaccatctttatctacaccagtgtcctcagcctgtccaataatggagccctgtccttctacacaaggcagcctaaactacccaccaccccacattaataataggaaaaacacagaaactttgtgaggcaaaaagaaaaaaaaatacaactgagagtaaaaagagaaatgaatacagctactcttttctaaaatgacaaaggatagaattattgtttcagactactgagacttggcaagcccaatgtattttaagcataggtactatttgcaaggcagcattcgtactgtgattcaaggtaactggtacattttgatcatctcttcctttcatatttactgcatccatcattgaagcaaggctcagcattttgcttccctggtgtagacagaccatttgcaaagggcattaatggacgtagctatatagcctagttgaagttgatgacatatagaaaatattaagtgtccacagacagttttaaggccatctggagggatctcaaaatcgaagagcaattgcacaaaggaactcatttagattagttatgctatctataggatgctcattttgcatcaaagtacaattggcttaaactagtagtgtttgcccttttcccttttcctctgcctgcctcagccaaggcttcgtggtttcaggctcatcttgacctatgactggtcctccaactaggaacaagcaaaatgagtgtgtgcgcgcgtgtgtgtgtgtgtgtgtgtgtgtgtagggatagtgagaagcatccccgtggttaacttaactttgggaattaacctttatcatgtgtgccatctcacagtggacttgaaaacaaaccacgaaatcaaacaataaaaacaagacaccacttaagaaaagacagagtgtgaatttccaagcaacttgaaactttataatttcaaactatagtttatgaagagatcacaatgtttttttcttacacttaattcacaatgactctaggtatcctgtctgtttctaggcatggatttccatgcttctgataactttgtaatacctcattaatactgtgaaaggctttgttttcttgttttgatattatcttccaaagagaatgtttaaatatgtcaacaatcatttattgttatactcattctcgcttcctgacatagaaaatccgtgacgtcatagggaaggacagactccaataatacttagtttttgaaaaatatagtatgtccttagagatgcaaatatcatgtcatatccgtgtgttttcaaatcgtgtgacattaaccactggagagaggcagaataaagtgatcttagtgctggcttctacaagaaattatattttcagaatctttatgttattagagccagcagtaaagtcaccagatatcatttggttttctccggtgccatttctaattcaataaaaacagatcttgatattgtgttacagaaaagtacaattgcttagtcttatttaaaagatcatgtatatgatttttttgcccatacaatggactatatatgaatataagctatttgttaatattctttaagttgatcctggccactttccaaagtgaggataaattccaaacttttgaatataaattcatggtttatggtttactgagaaatgttatccaaacagaaacatcgataaagcaattccctttagtgttcagtgaagaattcatggaaataagccttcgaaatataaaaagggtttcagttactattaactaccagtgatgtactcaacatagttattagatacccagtctagatttgtctcttgtctcttttataggaaggggttttgcatgataggagaggagggttaggggtcagaaagccctaggttggaatctgcccgacattcaacagaccagaactaccagagacaaatttgactgtaaatctcagctgttttatttataaaatcgaaagccaggattctactattgttttgtagatcttaattactgaaaagatctatgtcttctatcctccatccaatagaattcaaaatgaaaacatatcagtaaaataaagttaagctcatttctgcttttttccacgaatgtctattctagtaaccttttaaaatactaatataatttttttcaaagaacgttattggtatttatttagtccttctctttgttggtgctctacatttgagctcatagaatatccttgacacagtaattatgtgtgtgttacatattttttgtaagaatttaatgagagccaagtgttaactgcctgagaaagcagctagcccacagagcctccataaatacgatgggcattcatgcaagacaagtctttacagatgtatcgtaagtcaaagacggcaggagccacaactctactcacatattggaaagccacatcttttaaatgccaacaaaacagtattaggggtgtgttctatttcatggttatttggttatttgttcaaccattaaaattatttccacaataacgagaaactatttcctttatacatcaaaactagatgcccttgtattctgaatggaaccaaataatgaattaattttcaggaaatttaaaccatatttaactagatgagttaaaatacaccttctaaagctccaggaaaataagcctctaattattgaagctggaaaaccaacagagcagaagcaattaataattgaaaaactcatgctatggaatgttcagaaattttaaatataatagagaatcattgattttgatgcaggtattttaagacgccaaattacaaagctttctatgcaattactgaataaattgccagtcatatacagacttcggtgtagatttttttttttttatttaaaaagggattcctgactgactttatattaccaccagacaaaagaatggacgtgagagagagagagagggagggaggaacactgggagggagggaattagggagggaggaaggaaggaaggaaagtacgaaggaagacaggggatataaaaggcagagagagataatattacaaagaatttttactgacttttagtgatcaaaatataaaaccaatattatgttcatacattatatccttatgactgctatatgaaatgcctgcaagccttcaagaaaagtatcttagtatttgttctgtttacatgatacaatttattcctaggggacctaatacagatatgattactgatactatttaacaaatacagacatggctcattgtctaacagcctgtacccaatccttctctacatatgcttccctaataaaagagaaaagaaaacacttaaagcggtttacttaacaaaaagggataggaacttgaaattaatttccacttcctggtaaacacataggattaatttaaatctagtagaaggtagaattatacagaaaacaaactttgtaatggagcagctccaatttggagtttcaagtacccaagtatccaactgataatataatactggcatataaaatgaggtatagacctgattctgcagggacgatgttttttccccctggatgtcagtttactcgtttgtatagagagataatatctgcgataatcatagtcctaaaattatatttcaagaatatatgtattgcacctgtccatctctttcatggatgtatttagtatatctttttattctatgcaatatgcttcatgttatagaacacttcaatatcctctgaaaattgtgaagcactctgccaattcgtggtcttattctcatggtgatctaatgtgataaattatttcttggtcttcatgtgaccgagtccttgcctactacagccaggaggctcagtgggttgagaagcctgcgtcgagaagtcagcgagtgaaacgccaccactctgcattgtcactctgccacactccctcatcacatcacttaaccttcccctctcacttgctctaaatgtgaaatggagaggaagacgctgagccaaaactgaggaagtgctacatacattaaattacctagtgcttgtgaaccatctttaaacacataaattattttaaaataaaatactttgcatgcagatgacagaacagacctcataaagcattatattataatttgttcaaattccagaccctgtcatattccattaatgaatacaggatgattcagggtgaacacgttgagatgaaatgtggtcctggaacatggaaaactcgaaagtggaagctcattgtgggatgcagcacagatatgctaaattattgtgaacgtaaccattcatggtgactcaaatgcgatggcttgtggacctcagagcagtaaacctgagcctttgctagacgattttttaattaccaagggcttttctttctcacacaaactaaatactcaaagaattatctgagtcctcccatgaaacagacagtgagatgacggaaacccggattttcggtgtcatttacagacccacaatctctaattttaaaatgaacccagcaaaaacgtttaattacctaactttcaaaagtctctaggaagtgataactcaattgcatgtgaagcacccagacagccacactctagacaaccaccagctctctaggtgcaatttcaaacctatagcttactgaggatcatgcagtgtgcacatgctcggagacctgacccaagtcccgctacaccctaggaaggtggcctagttccaccctagatgggaggctggctctgtcagttttcagcgttgcagtattgaactcgtgtctcacctccagcctgtggatgaagcaaagttctttgccataaaagtcccctggatgatgttagtgccatcaacaccctgcctgcttcccacgcccatctgtgggccatctatttagtttacattgcattcacttctttcctctggagctcttttcctgccaccgtgctactagcatattaacaaagagagaaatcttgacgataatcatatttttcaaaaaggtaattaactttctcttctcatccagaaacagtaattaaaatcatcctgaaaccatacaaagaaaagaagcatttgaaccatggtcgcagtgcctgtgagtttcatgtagagtatgctttgttgagcccattcattgaacgatgaacttcatttgaaaaccacccatttgatcacaaaaatctagtcctgtgacaaccttaaattctcatgctatgaatttgagggaagcagtaaaagatgaaggtgtcataaaaaaataataaaactgcagcctgaaagatggtcttacccttcctaggagttgaatgagcaagtacagatgcatgcctgcgctcttaagctattatttatgttcaattctatgtggcattttgatttttcaaaagaaccacatacaaagactaacttcaaatgttatctggactacctcatcatctcaaaatagacttatcttgaaatagaaaaagaattaaatatttttattctttttaaccacagactaatacattctcatagaaaattaatgggaaatacagaagactactcgagtaatttaggactgtgattaaagtggatgacattattgtacccaacttttcattcccatctgcctgtccaccactcacccgggggttcggcagcttctcccacagaaagcaaaccttatttcccagccacattgactttggacatggccctatgacaggcctcggctaatttccaagggtagggtgacagcactgacttaaaacctattcagggcagtactctcctgagcttccctcactgccgggtgggaaacgtgctccaggcagccaaacattctcacaaaaatgaaagactcatggggcacacttgagctgaaaccttgtcttatagccaagctgagcccagcccatcctgaatcacctaaaccccagacaaaccagagagcaggacaccagtacgtgttcattgttccgtgggcctgagctttggaatgggttgttactcagcatttttacagtaatagtaatgacagtaataatcctaatacatatgaatatacataatactgtacatgcacacgtacatacatgtgtagatacactataaatgttttcttatatgttaaactgaataaaaatactacctgtagtcttctgttaagaatcatatcacagtatgtaaactatcagctctatatctgacatagaataatggatccatagaagccagccataatattaataataatagcaagctatgttattgttaatattactagtaagaggaggagtatattctcaaaggtctccatgagggaagtacaagctctctttctactgcttttctaaattcaataaagcccaccctcagtaggagttcacttggaaaaacttcccaaacagtaaaatacaaatctgttgtgtatcccattgctctcgcccatagatagcacatctggttgacttttgtaaataatactcgtgtgggctcaatgtccttattagcatgcttacttgcaattatgtttcctgggtgctacacaaaagaggaatccaccaccacgattccggcggtgtggagtcacagagggcggcaggcagattggtttcattgccagcaccagtcggtcagcagcggtatagggttgctgcattaggaacgatgatcagagcatttactacagatgctggttgaaaaagggtgctaattatttgctttaaagaaagtgtgtaaatctatctttccaccaccccttcctgcgacaatcattggtagggcactatctagattatagacccttttgctaagttctgtgaattcaaaggaaaaagacggaaacatggatctaaagaattaagctcttgtaacttacttgaagcttgtatctgtactctcaaataataatcatagtgaataaaacacatcctcttggatcccttgtggtagaaaaaggctttcagtgatacaacttaatatgttcctagacacttatcataatgggtgtgatactaatggtttcacccaaaaattaaatagaacacagccagcaatcataccaacagcctttggacaatcggtttcaaccatttagaacatactggtttaaaaatctactgtcgcttgaacacgcccactcagaaagtttgcctaatgggagaacattaaaacataaacttatttagaaccttggtatcatttttcatattccccaggccaacaggcatgtaataaagtgatagtgctttcatgatttaaaagttatctctccatgtctctccaacaagtctggatccaatattctttttctatgtttacaaaaaactgagctggattatttggggtcagagatagaaatcattcttcaagaacataagagatccagaaaatcttgtttaaaattggaggacattttgctcttgatcttattgagttgtcttgccgagttttactttccagtcacacagatgagtacagcttcactgcctctggctgcagaataaaactgaatgaaacagatggaccttattaccaataaaaggagccatagctattaattcagggacaactgttacatacattcatgataaatacacgtcttgatatcatctgaattcactgatattattctttaggagaaaagatagagttttatgaattaggaaaaaatacttctaatgaagggcaataagaaaatcattaaatgtgttatacatattaataatattatacatctatagcaagagtttccggtgtatcaccatgggatgaaacaactgcttctaaaatctcccatctgatactcaacattttaagcagtaaggagtataagttaaatttccaaacattacctgcaatctaagaatactgtatgtataaactaacaagagacttccaggggattgccaatagacatgaataagaatctcagactaagttctactcttcagtaaagaggccttaggtttaaaagcctagacccatgagctctactccctacagctagaccaaaaggtaaagctgtgctctccagtagaaataatatgcaagccacatatgtaattttaacttttctaggggccatatttaaaaaggctaaaactgagtttgatatctagcctagcatatccaaaacatctgtcatttcaacatgtaataagtgaaaattgagataattcatgtttttttacactaaatatttgaaatatactgtgtattttatgcttctagtacatatcattgtggaccacctgcatgtctacaactcaacagccacatggggcaagcggttgccatattaaacagtgccattcaaatccaagtccggccacttaccaagtatattaacctaaatcagtttcttcacctgtttcttctcctgcaaacggggtaattacagtattgtcaggaatatcaagtgaatatatgccaagtgcttagaatgagggttagctcaatataaatgttatacaaaaataccagttaaagttagctcatttggtaactatttccttagcctttagaaacacaaaaccttagttaaggatttaagcctaccattttatataattctaaaatattttatgtaaacttcaagaactgagcagtattaactcacatccattccctgtcatgtattaaaagtaaatggatgcagatttttcatttatgtgaaatgatttacctaataaaattcaaattgattttctcatagtcaaatttaatatgttcctcaacttatttttcttttgtaaatgcacagcttgcatttttgtttttgacttttgataatttattccatagccattcataacgtgattgtaccttcaaactcactatgcagggaaactaaacaaggccttttcttgctttgccacctagtaccacccgagtcatgtttgatgttattatttggcaattgtctgtaacacttagtaaaatacacgtgtgtgtgtgtgtgcgcacgcgcgtatgtgtgtgtatgtggggggtggtggctgtgtgtctgtataattgctactttcccttaggggttccaggaaaatatgcagataatatgattttgtattacatagaaaatttcatagaaactttataatgttccaatgtcaatgagattccgtcatctggaaattttcataattcatatgtaacaatatatttgctctgaaataattgaaaaagctgaagaaagtgcctcgcatatcaccaatataataaatcatataaagaacgaagacgagaactttataaattagttcaaagagatcaaatgatttataagaaaactgtaacagccttgtgtctgaatcagataaaattaactgctacctctcctgaaatatgagattaaagaatggcataaaatagtgatgatattaaagacaagaaagtaaagagatatttgttgtaagagtttcattttctgtactattccacccagtgaaatgggcatcacacttaaacgattaatcagtaaagtaattcgaccctgttagagaaaggtattctgtaagtggaaagcatttttatggcaacacataaatgatcaagtgagaaaaataaggctgtagtggcatcaaccatcactgcttcattaatttctcctcatttctggaaaatggtgaatcacgaggttcaacaagagaactgaagacaattcaattttattgaatttcaatttaacctgcttaaattaggaatgtcaaacctagtattaattgggaatattgactcggagagagaagtttcttctttcaaactaccttgagtattggccccctgtatttttaaccattaaaattagttttttttaagtaatgtattatgttgaatcatataaaattgttgctatttgattatttttgttctagaagaatacaacttcaaaaaatacaattttatcaaatttaggggattggtggcaatgtattgctgccatagaaacaagaggtatttcccaatattgacatggaaaaataaacacatgtgaggctcatcctttggcaataattaaaatgtcttataacacattcacttcaaaattttgatggggctgtcataactggactttttaagttgaaatgatttctattggctcattgagtcacagaaataagaaaaaaaatgaatactgattcattttttttgcttcgtttaaatcttttagtctctttcaaacattcagtttattttaggaatatggtttaaaataccaagttttgcatagacataggaaaagatgtgattttttttcttctatgagacagtgaaatcagtgccacagctgcctcaaatcatagaactgttccctaatgaattgactgtttctccgtatagaattttctgataggcgcattagaataagtcatagaaatacatgctggttttttaaaataataaacgaaagacagaaagtaacagcttccaattacagcaggagtcaagcccaagaaaagacaaggtcctgtcatttataaaactttggctttgacatcatcgaaaattcctacgcagctggacaggagtctcaggaatgagaacacaaccaattatgcccttctgtgaagctcactggctgcttcgtgtgcagcgagataaacacagctgtctgttcactgccttgcctacgtctctaagtgagacacaaccagtcgaagtctgtatttcacagatgaatagttctaagtttgtcggggaggtgggggtttttctcccagtttgggatagtggctgcttccaatcaaagacagatgcttccagtctttttggtacaaacattcagttagatagaaggtataaattctactgctctatagcacagagtagtgactttgtcaatttctaagtaggtaaaaagagtacttgaaacgttcccgacacatagaaataatacttaagttgacagatatcccaaataccccaaatttgatcattatacattctatgtttgcaacaaaatatcacatataccacatgaatttatcaattatatattaaagtcaatccaagcaagctttttttaaaaaaacctacatacaatattttcatagatcatttaaacaaagattcttattctctataatttagtccattaagcaaataaaatatgaaagaaacatgtaaaaaatactattaaaagaaattgcctttcttcacaaagcatctggaaaagaccttgagtttgtgttctcatgcatttttgtagatgctcttatggaggaaaacacatttctaatactccacttttcatagggaatctattgttattgatatgttatcgctatgttttattacacccttgagaaacaggtaatattgcttgtatcagtttatagcaacactaaatcatgcatttcttgacaaaaatgtaagaataaacaattccacaaaaatagtcttgcccttatttatctgttaaaactcacaccaacactggaatccacaagaaacaaaacacaaacccatttttaagatccctctggcagaggtagatatttatgcatgatttacatagttgagaaaaactatttctaaaaatatgttaagctctcgctaaatccctgacaaaagcctcagtcactaatgcatacactaaacgaaatactgcatgttttgggcttaggaatatattcaaggagcaaatgtgcttagaaaaatcaaacatgaaatgcttgtagtaatgatctttctgttaaaaaataaacaaatcactccccccacagagccggggctgtgatgagaaataaaatttgctaagattctggaaaaaaaaaattaatagaacataaagctgccaccaagcccatcttaaaactttaattttatggaactcagcctaccagtctgccttgttttctgtattcttcctagatacaacagaacgtatcaaaaaataaatatcagaagctgtctgatttgctttttatcctaagcataatgagcaaacaccagtgaatgtgttaactctttccagaagccctagagaaacatgttcatcaaagttcaaatctctggcaaacatctttgccatgtttctaaaagggtctccagagctgtaataacatcaatttacacgttgcaagagagaatgacacactattaagagattcaagaatcctcagtaattcaagatggaaacaggataaactaccgacatacagactttaagaaaatgcattttggagtaattttactgttgcttgagaatgtctagggttgccatcgaatttcatcagatacaaggcagtaattccagagtgcatagtagcattctcaggttttgtgtgttttccattagagaatatttacaagtaggtcaatctactctaaatttcttaaatgtttgtaattatacatttttgattaattatttagtaatcagtgattcataattaatcaacaattgttgcataattgattaacaccctttttgagcttcatcacatttaaaggagaaagtaatgtacagttttgatggcaataacctttaaaaaataatttcagacaaaacatttaatcccatatattacggcctcagcctatttcttggaatatataacgaattccgtgaaaactgcaagaaaattaggtttcttccatcttcagaatgattttgtgtgtgtgtgtgtgtgtgtgcgtgtgcgtgtgcgcatgtgcgcgtgtgtgtatgtgtgtggtgggggatggagattcgctcttaatggccaggctggagcgcaatggcacaaactcagttcactgcaacctctgcctcacaggttcaagcaaatctcctgcctcagtctcccgagtagctgggattataagcatgcaccgccaagcctggctaatttttgttatttttagtagaaacacggtttcaccatgttggccaaggtgatctcgaactcctaaagtcaagtgatccacccacctcggcctcccaaagcgctgggattacaggtatgaggtaataataatagattaattatagcccagaataatgatttattcaatgctttaattaggcaaataataaagctatattttaattagtattgatcaagggtcttcatgtgctgtatactagtaggagacttggtgtatatgggtgaacacaacagcaaatcccagctcatgcaggtgtaccctgtgacataggtttccagtatttttgtcctaacattgagatcattgataaggaaatgttctaaaatttcaaaatctatattaattttagcttactgtaataaggtaccccaaaattataatactgcggactcttaatcatttgttagatactattagctcatatttcactgataaaaactatataatcacaaaactacgtatttggttgaataaacattttgcattatgactgtttattatagagactgatggatcctcatatttcataaatcattttccgttttttaaatttattaattatatagaattagtttaaatttccttctgaattatgacttgactggaggaaattaggtagtatcccgctgggtgacctaaatttgaaatgacagttctgactcaatcaatgacatctaggtcaatatcaggaagagttggaacgtgtaataatgaatgtctccagatcaatagatttgaacatgttagaacaaagttttgtggtttcatcaaatgattatttgatgaaaccacaattaacaatttatttgaattggcttcaaaccaatctgcatttgtgtccttccctgctcagccttctgagttaggcaaaaggtatgacatcacagtcccactgtggacagagccagcttgtggacacgtagccatgtggggctactgtactgcaatatattaagaaaggaaccgggcttattggctcaagcctataatcccagcactttgggaggctgaggtgggagcatcacatgaggtcaggagatcgagaccagcctgaccaacacagtgaaaccccatctctactgaaaatacaaaaattagccaggcatggtgacacatgcctgtaatcccagctatttgggaggctgaggcaggagaagcgcttgaacccaggagatgaaggttgcagtgaactgaggctgcaccattgcattccagcctgggcaacaagaccaaagctgtctcaaaaaaaaaaaaaaaaaaaaaaaagaagagaaaggaaacctttaaatctttttaaaaggagtttatataataaacacattttacagatattagtaatttatcttataaattattcaagtaatgaatgcctaaatgttggctcccaagaagggctgtggttgttttaaagagtgggactgctttgtgtgaattggttatgatctcatctaggctttctaggaagtagattttaaaccagatctggaaagtggattaatatttgaaaacggaaaaatgagaaaggcattccagaaatgaaaagtacaaaaatgtcacgctattaaggaaagcaggtgcagaggcttaccaggtgcacagataaacacagcaggactgggtttagggagcagaactgggcagaatgtgaggaaggctgatcacagagcatcagacttcaagtttgtctgaggctttgcatgctttggctcaggttggtcactaaatcacacttgttatttgctttttttttgggacagagtctcgctctgttgcccagtttggagtgcagtagtgcaatcttggctcactgcaaactctgcctcctgggttcaagggattctcctgcctcagcctgccaagtagctgggattacaggcaagcatcaccacacctgggtaatttttgaatctttagtacaaagcgggagatggggggctgggggcactgtggggtggtggagtgagggcggttcaccatgttggccaggctcgtcccaaactcctgacctcaagtgatccaccctcctcaggctcccaaaatgttgggattacaggtgtgagccaccatgcgcagccaaatcacggtttctttctcattttcattcaacacagattttaatcaagagccttctgagtgtcaagcacagtcgaggaaccaggcgaaccatgtgaacacctgttcccgaccgtatggctctacaattcccactggtgaaagctcatcagaaagcaggacttaaacttctacaaagaagtgatttccagatgcaaaaatcaatcaactaggaggctgttgcaggactcatctaggactgaggatggggatgaaggaacaggaaaagatgggagagatgtcacagagccagaactgagagacttggcaattaatggtatacaggaagcaagtcatatgggggtctcagaaacagtcacatgccctctgaggtttggagcataacaatcactcccatctactgccagaaagggaattgcattgaaggacagctaccatttaacagtaaagaaaactgcaccaaacacagataagagcagagggctcagaggctcctggcagggaaatgcgtgttaagatttatagacatatatgaagaactagaccatgtatatacaactttattatgtgtatatacatgcctccatgtatctgtatataaatacatatcataatatttacataaatacacacacatgtatacacactatactcatgtataaatattactgtgctcctatatgtatatgattttaacctagatttgcagttagtgaaaaaatatgaagattttcccactaatatgtgtgccaggcctgcccaatcaagctatacattaaggtggctattattttcttcaagctcacatttttaatatgctaagataaaacatctataacaaattaaaaaaatgaggcctgcttggcaacctacgtcaagtctctggcacagcacagcaagtgttttcatagaagtaggagcaagacgcaccttctctagggaggaggcccaaagggcacgtccaatgatccagttcttattccagccacaggcaaaaggccaagacactactgcatggtttccttttcaaagtaaaattataatttcccacattttgactttgctcatgcaatcaaaatacaatttttgaatcaaaggaaacaatttaataacatgcataaaatcaatggtattacagggcagatgtatcaaaagataatgctatcacaatcaatactttaaattgcataattttgtttgtagtcgaattaatataatgcagctatcacgctgagtaggtactctcaatgtgattagaaatacaccatcatgagtgatatataagtgcagggagcttgtaactacaggatcatttggtgaaaattgaaaatagttaatgatatgatagagtttcagcaaagaacattagaacaatcagcaacaaatattatctgctcaaacattatattttaatctgtctaccctagcattaggtacagttaaaaagttaaatttcacattgaggtattatgcatcattataataaggttcagtcagcgtcacagtgaccagcactttttatatatgaattgcaaggtaaccaactcaggaggatgcattgaactgaacacatgtaatacagaactaaaagtcgggaagcctactcgtaaaattgcataatttatgtgacaaatgagatttatatattctcaatatatcatatcaccatgagttctcctgagcaaatgttttaaaatgtatagcaatagaaaaatcattctttgtaacgattttctcgtaggtcaccccgatttagtctagaaaagctcgatgaaattgaccaaagctagattacaaaagtataaatttgagcattgcctgccacagtttaatgttccttcaataagtgccatggaaagctccccttgaacaatataacatcgttttcttttcttaacattctgattacaagagagctcagtaaatccaaacttaaattcaacctcagcaacaattttgatttagtttagcatacattaaatacatacgtattaagaataatattatataggcatgaatccagagacacacacacatgtgcacatatatttccctgataaatcatgtgtcaggccacttgtcacacccttgagggaaagtgccagtaaaaggaaataatatctttagagaaagggcaaaggtatgaataaattaataaacatttagatgaaaaaacaatcatcatgtagcacagaaagtgcaaatgcaaacataactcatagtctgattataatagctacacatcgcttggtactttgtaaaacaaaagtattttcatttcattagagactcaccatggaattatgcattatcatttttcccacttcacagataagaaaagttaaactgtttactaaagaaagttcagtttaagtggtgagaacaaggtttggaaatgggtttctgattccaagacctgtaatttatattaaaactgtgacttgatttcttcatttgcaaaatgaaaaaaaatattagctatgtttcatggctggtgaggaataaatggcttggaagacacagaatacctggaagagcagctcagcaacaacagcacttgcatgtcacttgctgctattctatcgaaaagcaacagcagcaggcagctcatgcgtccttctgctctactggtgtccttccactctcaaggaacacacattcaatttttttgacagaagaaataataataacaattattacaatattaactagtatttggcattttacaattaacaaaaacaaaacctcatcattaaaaacttgttcatatgatttaccaattgtattagacaacatagctcatattcacatagggaatatgtgtccatttacttgacatggaaataggcctctcaaatttgtttcattttatgtcattctgcaagcttcatagagcaaataaaatttcccaactgacttatagaaatattattgccaaattgacatccaacataatacatatatgctatataggaccctatattaattctgattttattttcccttgtgttagaatctcaaattttgatgactgtctcataagtaaaatgtgtgtatcttgttaagcattttcaaattttctccttttaagattggaatatcaaatactccatcaacaaatatcatctgttgtcacccctgtctcagtcttttgtaaattctgtcccagtgtttctacagagttcttacagataaaaccattgaacggaaaatgctcatgtagagagggacctggctgcttttccatgaaacaggagtcaatgctaagggtggggctgtttgggtgtggaggttccattcctccaaccagaagagcaaacgagtgtagggaacccttctctaagggaagaactatctgccctgtggactttgggggtggggagaaccatttatgttatcataagtaatttttgaaatatctacttatcaatcaactaattggttttattgtaattggtaaacctatgtaattgttctattcatcaacatgtaggtctccaattccatgcttctcttcctgaaccacagcagtctatccacctgccttgtacctctggtccaagaaagccacctaaggcaaatctgagctgggacagaggctagaattcttgcaccacctctctgtgaagggagagctactcaacaagctgcatttaggcagcatcctctcttggcctggacagagaatgatatgcattattgaattgtagcggtgacccgacttcacaaaaaataaacactacagactgccaggaacacagggctgggcacagttagtgcgccatagaagcctgagtattcagaagcattataaaaaggtaagaatgactcatatgcacttctatgatttttaagcattttaatagagcttgcttggcaattaaaatatacacgagagcaagattaaatagtagccatttctgcactggttttcctgtcaatgttaacaaaaagcctaccaaagagccataaggaaatggccaacctcctctcagaaagacagaagaataataagggaatgatccaagtgaagaaaaaaagtgagcaaagaaatgcgtgaaaacaaacgggatagctttctgaaatcactgaagtaattttgagttgaaaaattcagaatgattcaagcctgtgctttgccatcattcaaatggctgtatcatttccttaacaaggctgcatagctcatggactaataaggatctaactttgcattcaggcataaagacatttattcctgtttttcccaccttattaatatgaaacaagacaataagatgaagacagtaactgtaatacttgttgcaagctaaatactaatgcaagaataattgttgttactacttttatatggaggtgatttgagatttttctcttaacttgcagatgtgtatatcttcatgttgcttccatctttcctcaagctttactttcgtagtgctcaaaaatggtaagagacacaatctgcacgtagtcattagaatgtctcagatcgcacggcttagattgctccacaccaagaagaacaatgtggaggggaaagagatcttccttaagtgtaaaaagataccagattgatacttaagatctcggttgtatcaggcaagacgccgaaacttctctgagtcacagatcctctcttctctgtaatcacgtcactgtgacattcaggtcacgtcatggaaggaaaaacattcttacaattataaaggattattacgcagactccagttcaaattgaggcaaatatgaataggctgggaacatgtgccagtataatccaatccatttaagaatccgttagtcagagaaactttatccaaatagttaaatagctccaaagaggtgcgtttatccccataaagcaaacctagatttttcttcttcagtgttttgatagaaaattaaggtaaaaatctcatactacgcagtaagacagtacagggaacgcacttttctcatatttcatgcacattcttcatgaattatgaaatatcttacagtacaacacaaagaaaacttaaagcatcattgaaatcccctagtaatcagggctcttcctacagagtctcatgcagcccttcatattcagaaaaatagggaagtttacttcacctaatgggaattttgaaaggaaatgatgactctgattcctttgaagaaagagccctattcattttggttgaattccaagcaaaatggatgttcttgtgttataagtgatgttacctttcctaacactatattgatgttacaactctctagcaattgggtacgtgtaactaaataaaagccaacaaactcagatcagaaaagctgagcctgtccccactgcctccacacgcttctgctctagcccagctgtaaaatgtgtgtaatcacatttgcttgcctgcttcaggtatttttaaataatctaatcgaataaagcttctcagagaatactacgtaaaataaagttcctctgtaatgcaatgacttctgatgtcatcactactatgggaattattacattccctctttcccttttctattctcttcctttcttttcgggttcagtaaaaaaattaccagaacattcacatgcttcctatcttccctttttgaaagttaaatgttataagcctctgaatttacttctgtgactgtgcattccagcaaagtaaaataaaattgtgtgtgattcgtgggggtttgcaacttactttcaccgtaccacttgctaactagaggatccgattatgggtcttgctgtcttaggacaccagataccactgaagccttgcccactgcaggttactgaaatctaggtttatgtttagagaggacaaaaatgtgttcattgctttatttgacctcaactggcctagtttgatgatttttttaaaaagataatctatatgcctttaagaggattccaaaaaatgtaaactgtcagtttacgtggattgtaacccgatggagatgtttctcatttacctgggccacaggataactaggcagttatcccacctgtgacttaaactatgtgcaggaaaaatttttacatttttatatttttagcaatttttagcaatttttacatttttagcaattcatagaaaacaaaaaaagatacttgagatactttgttcacagtatttatttaaaatataattagccatatacaatgttgtctctcctatatgtaagctttcataagaatgattcactatttttatatataatactgtttttaacctctgggtatggcaatcaaatctttttagaaaatatttcttggtttgatgaaaccatatgtattttgtcccttctgtaattttctccgtcagattgtctttttcataatatgttatgttaatgtgagaagtgcactgtgtactttctgtgactaatattttgttttgataatttattcggactttgcctctgatgatcccatctagcaaccatttgggaaatccagtaattatttgtatttcacaatttgcagttctcattccatcactgtgtctgtgaaatgcatttttgccactctgtccactaaatttattttaagtgatgtcttgatacagcatgaatatactggtgtcaaactgaagctactggatgctttatgcagcaatcgtcacaactgctggttcctgtcagatctgtttaagcctaggttcttattaggtttaatccaaatgtctaaactctttaattgcctaattcttatgcttgtgttttccaatgttgaaactcttggaattaaaaacaattaattattttttccagattttagttctgtgatgacttagtttttaaaatgtattacaattacaattacactctacaagtatgactttgaaaaaaaatcaaagtagttcattaacttttcttacttttcagctacataaccttagtttcctcactcactggtaaaatggggtacttagggcaaccgaggattccatagaataatgcatataaactcacttgcaatgtacctcatctatactgaaggctcacttagtccaagccctcgtagtatatgagcccagtacacacagcaaagatgggcatttgcccactcaaacatacatcgaccccctactacacatagcctttagaaagaatagcaataatcacaacactgacatataaacaagtaattctctatggtgagaattaatataatgcaatacagatactacagaagtgaaatgagttgaaaaacttagccagtgtggtggtggtggcagtgtgtgcacaagtgtctcatggagtggtgagtaggggagaaaaagaaagctcacagaggttgaagataaatgaggcttgagagaataaaaggaaggcttaatattgaactttgagagagaaatactcttaacaagagaagaaagaggaaagagcattctaaccagagaatatagcacaaatctaagtgcacacatacacacccacgcatggacacacacatatacaatcatggacacacacatacatgcacacacaaacatccatgcacccacacatgcacacatacttgcacatacacaaataaatatccacacacacacacacacacacacacacactctccctctcacacgtacatgtaaggaaatggggaaaaacaattgatgcctatatatatttttggacaaagtagtttaattcattctctacctataacatgtaatgttatagattagccaagaaagagggctagagatctcaacaagaaaatacatgaaatacacaagtttttcttgggtacgtatcaattgaaataatactttgtgttatttggttgggaggtagatagtggatgaaagtctgaatgatatgcagagttttaatttaatgtgaaaagtgattaagtccctgagacctctaagctaacatgtggttccgggtagaaaaattgtataattaaagaagactatttttcttgtttaaagaaatagaatggtttttaaacagagtagtcccaattaaaatattttgggaatacaagaaagttctattaataattacaccacggaaacagtctcaaacaagacagtctttcaatttcaaaggaattagttgatgaggtctgtgtatgtgtgtgcgaacacacccaacagaaggaatctcataacgaaagtgacaatttttgcgtacacatttctatccactgaaataactgctgacatcatggaattacttggaataacactgctggaacttgtcactcaaagacaaaagctaacaagagtaataattagtattttaatgtactcggaggaaatgaccaggtatatagcctatatttaagaaacaatctgtatctccaagtgaaatgtcattgtaatagaacgtggccacagggtaatgggctgttactgctacacaaatgctaacgtaaagccaagacatttctcgggaatcaaagtagaagcaatcaaagaatctctttggaaagtgagcgaacctgaatgcactgccatgtttatgacacttaggtttttatcctttttgaagtcaagcttctctgcagtttattctctcccattttaaatactgcatacatttataacttgatgaacaacacaaatcaaggtaattttagatttcaacattttctacctgaagaagtgggataaatgtgacttatctgacatttttgaagagatgtaatcaatattcaaaatactgcacgtttaatatacatacttggaggcatttgaaatatgcatacacccatgacacaatcaccccactcaaggatataaacaactattagctgtcagtgttttatcctgcacagatattttcttgtgtgcggtaagaacactgaccttgagatttattcgcttcaccagttattcagcatataatgcagtgatggtgactctaggcacagtgtagaccagcagttttctagaacttactcagtttgcatgattgaaactttatacctcttgaaagatcgcccgatttttccttcccctggcccctggtaaacacaattctactctctgcttatatgtgtgtggctgtcttagatacttcatacaagtgggatcaaaaagcacagaaaagaaaagaaaaagagacatgtgagactccctcaaactaaaaagcttctgcacagcaaagaaaacaatcaatccagtgaaaaggcaacctacagaatgggagaaaagatttgcaaaccatttatctggtaaggggttaatatctgagatatagagatatacatgaagcttctacaaatcaaatgcaaaaaaaaaagaaaaaaaaaagaaatcccacaatccaattaagaaatgggcaaaagacacttctctgaagagatacaattgtccaataagcacatgaaaaggtgctgaacatcactgcgaaccaagaaaatgcagatcaaaaaacaggcagctatcaccttacatctttgaggatgactaatttttttttaaaaaaagaacaagtgttggggaggatgtggagaaattagaaccctttttcactgtccattgaacatgaaacagcacagccattgtggaaaacaatatggagtttcctcaaaaaattaaaaattgaattaccacatgattcagaaatgtcagttctcggtatatatccaacagaattcaaatcaggatcttgtagagacatgagtaccccagtgttcattgttgccttattcacaattgtcaagacatgaaagcaacctaaatatccattgacagatgaacatataaagaaaatgtgacatatacacacatacgtatatgtatgtgtgtatatatgtgtgtgtgtgtatatatacatataatacatatataattacagctttttccactttttaaaagacgcaatcctgcatatgcaacagcatggatgagcctggagggcattgcgctaactgaaataagctagtcacagaagcagggatatttttagtttctttgattttgctttatgttgtttttatttatttatacaaattcatggggtacatgaaaattttgttacgtgtctataatgcgtagtgaccaagttagcgtagttgggatgtccaccttaaacaactgatggaagagcaaaaaggagataacttgggagaaattgctgcaggcacttgcacctcactctcatgtgtagctttccttcccactcattctaagctcctttccctgcgctctgcctttcgtgaccctcatgccccataacccaatggagagacagttctgttttaaacataggagctccctctgctatatggaagtacaggcttaatgtacttttaccaaatcttacgactctataacatttatgttattagtgccagctgacggataagaaaaactagatttagagtgattatttaacttgcctcaaaatctgagcacttatctagtgccagcttactactcacccttgagtgtaagtttgtgctcactacacgttgaatacgacggtaagaaatcaaattgcttgcctatcttccatggaccacatttatgtttgtatccatggatggctaacagactaagaacagggaaaaaaattaagtccatgttctggcaatgcccttgtcctcaggtgtgaagcagaatcaatcagctagaataattaaaacaaagaaaacaggtatactagcaaagttttcgttgccatgcaatataactgaaaacctcagaatgtatctgcttttattatttttcacaggtatttttgtaatccaaatgaatttaaggactaatatttacttcattactcatgtttcaagcagaaagaccagaatggttttcattttatcttaaccctaaggctagaagagcacactaagacacacaaagcccagcggctgctcgagttaccttcctcgacttcaaagctgtctggatgaagagaaaagctcgacagaaactctcttctttgcagaaacctcttcagcaagtcaaaacaaagtgcacttaagatgaactgaatatttttcaaaatattctaaaattttccaccaagtttcttgggaacactttttcaaacaaggctttgtttatcaatgaaaatacagcctgcattttctttgaggagcttgtgtctcagaaagattgaataggtaagtctttaggaattcccagcttctcgaaatgcttactctgatttagtgaaaaacatccattgagtaggttttaattatctgtagatctaaaaagaatgtgttttactccactgttattttcccccaaaggatttcattaaagattgaaattcagctcctgcttaaacccctggaaaatttttactgtaatctacaggtacagcctgtttaaattcttagtttacttgccctttaccattttaatctttctcgtcctcaagcaactgcttgaaatacaatgaaaaatgtcaaatccaatattcattcatgagtttcaaaagtatgctgactaaaacttagaattttaaccatcacataataaactttataatgcaaaatgcatgttatatatttaagccagctacaatcaaaagaagcgtagtgggatttttttttacatgagtccaatattcttcagtcttttttgacaaaggtatacaaagttgattttccatcactacaacttatcccacgaggaaattcacttccatcccacaaatacagagctcatttaagtgttttcaaagcagcactattgtcacttaatattctacatgctaagccaatattatatgaaaagatatgttccatgcacttagtacttttgttaccttcaatgaaaattatgtcaacaaatgtgctgacttttcttatagccacaagaaaataaggtagcataagcccaattgttgacctgaatatggaagaccacaatgactttgctgtagttatttgatgacataaccacgcaaagcaggggagttgacagataatcttctctcagccaaattcagggagcttctgctgttttctgagtgtcttggggtaagatccgaaagcacctattggtcctttattgcctgagccatcctgtgccttcctgtgctctttcacaaactccagactgttgtgcctaccaccttttcatcaaaacctctcatctggaatccctttctttaaaactgagaacgttactcggcatggggttggcaatatacattgaccagagcccaggtgtgtaaaagtcaacctggcatgacttaaaatcctaacgctactacttttatcatttggaggtacattacctaggctcctcatgcctcagtttctttacccttaaaatcagatgagcccagaagtactgttgtgaagaactgcagattgtagctcaatactgcccacagaaccttcatcagaataatcatgatatgcgttccacatcctcgtcccagtacttaatgtgttcataaaggttaattaaccatccccaaaccatagagctagtaattcctgtaatagtaacctgacacatgattatttatcaaaactgcactaattattattattagagatacattatgatattgaaaagtaatgataacttaataggttacctttctccactaacattttgcatttaacaaagaggtggctaatggttaaaatatctgtttcagtccttttggtttatgattgatcctgcctgttgcaattccacagccaatgtaatttctcctttcaatcttctaataaagactgctcaagttgtttagatgagaattttaaaacattaaccattttaatattttttcagttagagtttgacaatatttagtcataagctttatcccatcaaaccattatattaatctatgttttcatttaacctacattacgtgtctatactgggcaacactctgctaaaagctaaaaacgtagagatacaaagatgacttagtcataccttttactgctgaacatctcaactcagcagtagaaattaacatttaaggccaggtgcagtggctaatacctgtaatctcagcactttaccaggctgaggcaggaggatctcttgagcccaggagttcaagagcagtctgggcaacatggcaacctcatctttatagaaaatttacacaattagctgggcacagtggtcatgcctgtggtcccaagtactcaggaggctgaggaggggggatcgcttaaatccaggatgtgggagcttcagtgacatctttgcacctctgcactccagcttggatggcagagtgagaccctgtctcaaaaaaaaaaaaaaaaaaagaaactcacatttatgtagctgtttcacacccacctagttaatggtctaaagaacagcaagaagcagtcagtgatcgctttaccttggggacaaggggctggtcagagtggtacaaagtttactttgaatgagtccttataggtaatgccaccgttgccctgtttagaggccttctgatgtagaaagaaaacacacacaaaaattttgcttacaaacatatcggacagcttgtctttccgtgctctcgtgatgaactgcctgtccttctctaaggcactaatcacaaggacttatacctgtgcacgtcctgcctaggccagggatacccaggtactgaagagctacattcttggaaactcagttctgcaaaggccctgaatcactcctgagaaatctgacagtacaagaagagtcttgtttacagcaatgggattgtgaaacagacaaagtgcttctaattttcagcctcacctcaaccctatgccacaacacccaaatgaattcaagcttggtaaagaaaggaaccatgaggtttctatttcctttctttttcctacatttctcactgccagcatctaccaagatttgacacattagagataattgatggctgtgaaaaaataacacttatctgtaaaataattgacaataactgaacttgtatgtttggaggaacacttaccgtttcagataatgacttaggatctgtctttttgctagattgtcatcatagaagaatcaagaagctactgcctgacaatggattaccaggagattgcagtttgtgtgtcaagaggagacatcataagccattacaaattagatagatgacaaacacatagatacatagaacaaactatgacttgatcgtggtagttttttattgctaagaggtcacagaaaaatccacttaatgcatgccaactaatgccaatggcaacactgtattgcaaccctgtgtcattgtatcttcgcttaattggaaccattggactttaagaaatataagcataggtcattccagagtcaagtgcagcctactgtgaggttaatgtggaatgagcagggaaagaaagagaaatcagctaagtgaagaaattctgggaaaaaagaaaatcaagatgattcctctagaatagagtctaatgaactttcagtgaacttccttatgttacccagaaattatctgctgcctgaagaaaaaggtagctaatcaacgaggcatttagaggcccttcattttaagggctgcacaaagcacttggtgaataacaggatgatctaccctttacttcaactccaaccatgcgaactcaaagtgggagggatgttttttccattttacctatgccttaggaaaaaagaaactgtaaaacttcgttaaatcatccgttattcaatggacaaagaatctagaatctgaaaaatgcaactattggcagatgtcctttcattttccacacctgacaaaaagagggagaattacaagagcatattgtaggtttgactgggaaattagtgctccactgggagtctttactttggatcacatcttcttcctagtgcttcagcaattactgcaataccttataattaacatccttattcttatgaataaaacaatgacaaaggacaaaactgccgtcatttattgaataactacaaatatccatatgcattatggagtacattctatgtgccaagcattttacactatcatcttagagttttgtcaagatgctgctcattgcatggtacatatttttttttaatatcagaagataatgtgtctccaagggtttaaggaactcttacaaaatgtcatgccaaggtttgttgactccacagccacctggtgacactctttctttcgctttggaaaggtcatggaatgatgatactctgatttttgttcatacttcaatgaaatggtcaataaatatttactagacattcacaaacacatgcctgtacctggccttggggttctagtccaattcctacaactttagggagatgactgcagcaggtccccttcagggaccagcatctcccaccccctcccctgacactcaaagacaaagcacagtgtgtgccacatccagaaggtgcaaggatgaggatgaagaggaagcagctgacacaagcagacacactcccctgaaagctgggaccttcgagatttaaaatttttgtctgggagaaaaagtgaggggaactccaaattcccactgcacacatagtcactttcaaaaggagcttcctccaagcaatgccacatgttaccttacaatcaaaccagaaccaaccaaagcttctatctacccttctcttcgggaaccttttgtgtactgttcactgaactggcatgtatctctgttttcctggtattttaattacactcacgtacatcagcaaacatgcatggaacgccctgagtgtgggagggtttgggaggtgagaggctgggatttggatgaggacattagccagtaatggaagtttgtgattctagttcttcctgagatgttcagtccttagcgcacatgaggagatggacagattcttacggagatgcaatgcctgagtggtatgctacagtggcaatgaacttgacacatgactgaaagatacagtggacattgacatctactaagagcatcaggaagactttggagaagaggcgctgtggccagggaaaaaattacaaattgttcatgtaaataagtaaggggacttctctaggcagaaggaactgtgtgagctaaaacatggaggcatgaggtatgcaaggttttacagaaatgattggttgtctgcttgtggttaaaattattactagctgacacttagggattatagtaagtgtcaaatctatctgctaaatgctttaaatatatattctcatatttctcacaaagaaaactctcaggtaaatgtaacaaagatttccatttaattgttaagaaattaaagtggagagagattactgattggatcaactcttagaaccattaaaaagtggacccagagagccgagacattcatcctcagggtcagtcatctcataccctgtgataaaagcaggtgcatgtgtgtgagggcgtatgagaactgctagataacagaaagctccgaactagctcaagcactctaagtttagtacccttgattctaaaagctcttgtctgatttcatcaaggaaattcctggcctgccctgggcaccatttctgatttaaaataaatggaccgaccttcatcacttcaatagcttacattagaacatcttatgcggaaagtatataccacttgccaattctaacttggatttaaatctgtatttgagttttcatttattcgtcattctgagagtaaaattgatatccactgtattagtccattctcacactgctataaaaaaaactatgtgagactgggtaatttataaagaaaagtggattaactgactcacaattccacaggctgttcaggagcatggctgggaggcttcaggaaacttacaaccatggcagaagggcgaatgggaagcaagcatgtcttcatgtggcagcagaagacaatggtgaaggaggaagtgctacacactttcagacaaccagctctcaagagaactcactgtcatgagaacagcaagaggaaaatctgcccccatgatccaatcacctctcactaggaccctacctcagcattggggattacaattcaacatgaaatttgggtggggacacagagccaaaccctatcacccactaacagttgctgttaagtagataagtcattataataaactgtgatattccaaatggagcacacgatttttgaaagcaaggactttctccgctgatactgtatctctgcaacagagtagacaacactacgtagagtgttgcctgcacagcaagagctggatcaatatctagtggaaggagggtgactcttcaaacctatttaaagaaactcctgatttacattgacttctattcgttatcttaggatatgatcccatggaaggatagatcagctgactaaaagggagacttccaatcaattgcaagttggctacgttggctagctctgtactctagtgaaggttgtaaataacaaaccgtacatgtcacttggattggtgttcaccacccacctccttgattccacagcggcccctgactagtcttcactatcttagcaccttgaagagtctctcacaggaccccatttttataaaaatagacccgggatgcaatatcgtacgtggccagtaggtgccaccattagcaatgtaattttactattggactcctagagatattcaaatgaattccttttgtttcttgttacataattgaaagtttttaaacacctaattcatacagataaaacaaggatgtgttatgtcaggtttaaatctgtaattttagaagacaatacatatttgaacgtggtaaggagagggaagaaaaatatgtttagaaggtaggacatcaagtatctaccgaaaatcatttatgtgctacacgttacatactgggaacagaaaaacaggtaagatttacttgatggcaagaacgcatcatctgtaggaagatatacgttaggagagatataagcaatatagctctaagtcctaacaatattatgaaaaaaaagcaaagaggattgagtgggcacatgcccatgtattcacgcaacttttaggcaggcagtgaagttcgagctgagttgtaagggatcaacacatgaagataagggtgagctttctgaaaacaaccaatagaagggaagaacgaagtaatacgagttcaaaaagaatgagaacaacgtggtccaggataaagaatggcagaggaagtagctagctagtgaaaaagaagaatgaattaaaaggaaaaaaaaaggccaggtgcggtggctcactcctgtaatcccagcactttgggaggccgaggcgggcggatcacgacatcaggagatcgagaccatcctggctaacacggtgaaaccccgtctctactaaaaacacaaaaaaattagccgggcgtggtggtgggcgcctgtaatcccagctacttgggaggctgaggcaggagaaaggcggaaacccgggaggcggagcttgcagtgatctgagatggcgccactgcactccagcctgggcgacagggccagactccatctcaaaaaaaaaaaaaaaaaaaaaaaagaaagaaagaaagaaagaaagaaagaaagaaaaaaaaatcacagtattgggggaacaaatgatgacatttctcacataacaaacaaaagcgtttcttcactgccctatagatattagaaacctgggaatcatttattattaaggcggcaactctagacccagtgagcaagatggacccgagaaggttggaaatgaagcgaaggacaatcaagaggtatttatttattagcgtcagagaggagataaatgattgaattgcaacagtggcagtggggatactaaggagaggttacaatacaaacatcgtcggagattacgtttgaaaagagtggagacaggttgaccatgagggtcaatgcaaagaggtaatattccagaaagattctgaggttagtaatttgggaagctgagcatatgatttcaccattagcaaacattaagagacaagaggtagaactagttattttggaactaaagggagagacagtggattcttatgttgaatttgagatgcctgtgaaacaatgaggtacgcaaatccagtggacagtcagcaacctgagggtggttaagttagcacacagagattttggaattatcctaacacaaattttatctacattttgcatatgcataacctgaattgctcaggtgatgaaatgaaagacatcggtgagtttgcatgtaacatttttcttttatttgccacaatgattgtggtcagtatattttagttcaacatttacccaatctctctcaggtggtagacaccatgctaggtactgcagctgcaaaagtgagtaattctcaacagtgttatatctcatcaagtatccagacatggaattacttgtacatcaagccaactactatggtcactaagtgttggttgatttaaatgctgcctctttttctctttttggaaatgtaagtacagattataagtacaaaggagggaaatttaatttatattttgagaattaattaggtaccttctaaatgtaaaatatcctaccagattctaactaggatgtgaaaaataaatagagatggtttctgccttcaaacgagttcacagtttagaatattggacatacacaagtaatgcaagaaaagatcaactgtcagagcttcagctttccaatttgaaatataggttttataaggctactttaaaactggggttatttaaatcgttaattgtgaattgattcaggcattcatctaccttgaggtattagataggttaattaactaccatgactcatttttcaaattataacgtgaagactaattttcactaccttcttcccctaagatgttaattaacacactttagcagtgcaccatttccatgtcttatgaagacttctatgtggagccatgccacatcttgctgactgacactgacgcctcagctgggattgttatcaccagccagggggaagagatttgtccaaattctccttaagtgctgttccataggactggcgctcttgaatacggcagacagctaacatgaatcatgcatatgctaattgtaataaataatgaaaatatttagacacagagaggtttgaacttgaactttatgaataagttttgattagtatgcagtacaagctgtatactctgcttttgttcttactcttaaaaggcagtcagtacttaatgatgctttgaaattttagttttttattcatctcgtcgcttccacctttctatcatggagcaaagaagtcacaaggtctaaacccccagatatcaaagtacatgtctccacaggagtcttgactcctgtgtggacacactgatgtaatcgggccctgtgttagtttcagccaagaaaaaaaaaagtagacgctgtctccaaagaaatgagcccaaagcttagagccacctctcactctgtctgaggctatggttgctgctgtgtagagttctaatgggaaacctccatggctgttgaaaggaaactctgtagaacagatggcctttttttgttgttaagagaccacccagaagacagggctctggccttgatgttgttgttgttgttaagagaccacccataagacagggctctgggacagaaagaagtggtaattaatgagggcttcactaagtaatctgatttctaatagatccaaataatgttatgtctaaattgaaaagacactaacacatgcgggtgaggatggggagaaaaggaaaccattacatactattgggaagaatgtaaagctatcatatcatctagttgggcatataccccccaaaaaaggaaatctacacatcaagagataatctgcacttctaggtttgctgctgcactgtttacaatagcagagatttggaagcaacctaagtgtccatcaacagatgataaagaaaatgtggtacatagacaccatggagtactattcaaccataaaaagaatgagattctatcatttgcaacaacatggatgcaactggagatcattgtgttaactaaaataagccaggcacagaaaggcaaacacaaaagtatagctttttgcagctttggttcttatctgtggaatctaaaaatcaaaacaattaagctcatgaacatagagaatacaaggatggttaccagaggctgggaaggacagtagggagttgctggggaggtagggatagttaacaggtacaaaaaaaagttagaataaataaaatctactatttgatatcacaatacggtgactatagtcagtaataaccgtacatttaaaaataacaaagagtataactacattgtttgtaactcaaaggataaatgccggctgggatggatatatcgttccccatgatgcacttatttgatatagcatgcctatatcaaaacatttcatgtaccccataaatatatacacctaacgtgaaccccaaaattaaaaaaaaataaaaataaactaaaagacagatatagacacaatctagcaatgctcactgaggcattgcctgtgaagccagcagggggcagcagctccattctctctgttctatgggcccaggagctaactgcaggcaaggcagtgtgaatgggtgaccaggaagggacatagtggatttgccggtaataaaaattagtgagaataaagaaaaacagtaaaacttttttttaaagcaagggggaaatatagctttctgctacttgtggaagttagcttgtgtgcagtgttctccccgctcttcaatcctttgagatctccttagggtttcgttctgggttttattcacttattgactgagcaagtagtgtcaaagtgtcaggagacgtcagtcactgtgctaacgtaagcgttcatggaaataaaattaacagggtagctttgcctcaaagactatgcaatcaattattgaagatagaaaaataaatagaagattgcaacctgatatttgttctatggtaattaagcatagctcaaaccagagggaagggaaacaagaaactgccctgatgaagatgcttcaaacaaatgtgattctgtctcataactttcccttgatggggcaaagcatttactccgcttttacctgcttacacctgggtgggggtgcatgttgaggatatattcataaacaatcagtttgtgctttggcagatggaaacatgctattgcaaaacaatagctctattgcagacgcggaggtgggatgagaagcatttataagagacctttatttgcagaggacacttgcccaagcctcccttgtttcatgccatcggctcaaatgaagactaacaaggaagcagacctcccacccagagtttggtcggaaccgacagacactggctcccaaaccaagtgcttccatgtgaatgtgacacttcttgtttctcttgctctatctccagtagcaatcttttgttctactgcccagaacttaagctctaaaggttacataaacttattttatgaaagacaaatttgacaaattcagcaattcataatttttttaaacaattacttctacctattttgcctccttaacattcagacttgtggttttgccagtataactttttggaattggttttttgcctgtctgctttgtatttctgacctggtattttactcctctgagtcagtttcccacctcaaactccacgacttcttcaaaagctgtgtgtcgtaactaaaaccatccttctttcccttcatcaggttccaagaaggaagctctgtcatgagtcactctgaatatgcaaacttccttttaataaaaccacctaacttcagtctcccaattatctagtcattcattcattcatctatttgtttatagcagacagaagggacaagaaataagatagcatatgcaatgaatgcatacaaccaagcaaatatatttcataattatgtcaaagtatcacatcacagttagctcaacactttacacattctactttgtatttctagttctgaaaaaaagttgctagacatttagaatgacatttgcactgaaaaatcctaactcagctaacaactgtgattttttctggggctctgggagcaatttctttttccacaagaatggaccactaaaatgaacaacgatcggcccaagagatgaaataacatagttattttctgtttaatacttcacttaagaagaacttgttcctcacacatggttgggcatgaaactaagacatcagatttcagaattctcacttctcatgaactcaaagataagtacaattttggtaataactatacaaagtttaatagcctcgaattttaaaaaccttccacagaaaagcataaacaacagatttagaccttttgaattaaatatcgttaaaaatcatcttagtaaagttgatgtttgcatgctagaatgtatatctttcaattcttagtactagctattctgaggaacaactaacctcctgcgcgtctcctcaatacaactctacaacacagacccggagaccaaaagtcttcagtgtttgcaagtgtaaaataggaatgtggaacttacaggtgctttttgtcctgcatgcacaaaagcctggtttggggttcacagctatggctttcctcggtggaccgcatccataggcttgggaagagcctacctgtccactcacttagactccacggaggcacttgccagctgtggactctttaaggctgttatgcacatcacctgcacctgcgtcgtggcccctccactcatccctgatcatggtctatgagtctttcctctgccaccatcacatcgccagctgatagccctttcaggtaaagtattcctgctttaagatgttttgctactgttactcttccaccttctattcagcacagctgttaactgttatctgtaatgcaatgatgataactgtatgaaactagccgattacttgctactaatgttgaacatatgtcgaaaacattttaaccacttatatgttgaagactatagtcagttctgaaaacatacgatataacacgttaggtcttttgttttattcgatgaagtaaattaagttatggtggtgagacttgctgaaggagcagctttcaaaataaacttcccagagaaagaaaatatgaagaaataaaacaaatgtaagaaaatatagcttaacacagcagaattacattaccgaatgagcattgctatactttctgagtgacgtgtcccaaaaaaggtgcctgttattactcagtgcctgcaagagacaacttttttatcttctgaagaccactggcttttcagtttctctttgcccactaatagacaaaactattaaaatgtccatgtcgttatgcacagggcttttataccaggtaggattaagtatagaatcatgagtaatcattaccactattaataaaaatacattcttgttattaagtgcctaatatttgcgtgtctcaatcaacaccactactgtaaagtgaatacaaatatccctaatctatacttttaaaaaacaagtgcactgggctagtccgataaggagcatgtcctcttaactgagcgtttgccgtcagccccctggctccaccctgtcagcaccaacgttcttcctgtattctttcctgccttgagaagagcacctgctctaaaggatctttgtcgactgcagaaacaattggtattacaatctttattactgaatgcatatataaataatggtcagagcttctcctctccttgcaaaagcaaatattatacattatgttgatatatctagataaaagggaaacaagtgcaatggcatgtttcacttcaccaatgcagcctttggttattgattagccttaagatttttaaacatattgaaaacaatcatagacttatgctggttttggaactactttattctacagtttggaaccactgagcttcttgaaggcagggaccacaccttttctgccctttttattctaaaaatataacaaatccctaccacatgttatgtgttcagtgttaaacgaataaactagcaaaggaaataccactggacaagtcactaagttttcttaagtaaaataaaaagtaatgtgtcatacataaaacaaaggtcaaatacaaaccatgaaaccattacgctgaaatataaataggagatttaagaaaataatcatatagaagttcagaacaggtcaggcgcggtggctcacgcctgtaatcccagccgtttgggaggctgaggcaggcggatcatctgaggtcaggagttggagacaagcctgaccaacatggtgaaaccctgtctctactaaaaatacaaaaattagctgggcgtggtggcacatgcctgtaatcctagctactcgggaggctgaggcaggagaatcgcttgaacctgggaggtggaggttacagtgagccgagatcgcaccgttgcactctagccggggcaacaagagcaaaactccgtctcaaaaaaaaaaaaaaaaaaaaaaaaaaagttcagaacaatggatataactgtcctgaatgcatttttgtcctgcctctaattgatagggaaaccctagaaaaaagcaatttttcaagggagctgagagagatgcttttcaatcaacatgtaaatttcctggacgtcacctatgtgtaccattctgtatgagagatgtaaaaaggtgcaaggcaccagccaaaccgccttagaacttgcagtattattgaaaacataagccagacacacatgaaaagaattgtagctgtaaacaggtgaattgagtgtgggaattaagggaaccagggaagtcaaagcttattttcatataaatatgaatcttccagatgcattgaattttggccttccattggaaaaattatttaccagaattctacaatggacttttaatatctgactttggcttaaattaaaacttcttcttaatttttattccccttttgcaatctttaaaacttcaaatgcaagcccaattatagttattatgctctaaactgcattttggtaatctttcatgagttgtcagatgcaatggatagtttcaggaaatgacttactaaaaaatgtagcaagtgttcacttacagcgagcactaagggtcacaacgtaggagccatattgagcatagggcacatgtatccctgctgcagggaacccgggtgcctatgtgcaaaaccacactcagtagtgttcttctctgttggacagtagcctctagaactcaggaattttaataaaaacaattattatgagctagatgctactagaacaaaagagtttttgaatgttatttattatgctagcattgaaaagcagaaattaatagtcacattacacattaatggtaacaatttcaaaacagtgagtcactttctcaaagtagcgtagctgttaaatcttttttcaacgcttaaaggcttatcaatagaacaatggaaacgtagaattggaataaatcttaaaggttatataatcctggatgaccagtgtatgtgaaaatcagcagattctcatttcctttgtgttcagagcttgttgaatagtcatctaacatgctactccaggactctaacatcaactgagtgaagtcaaaataagagatgctaatttactctcttaaagctaaatataaccagactcatttgttaggatgtgcgaattgagagtcgaggaaatgaacaaacatgcccaagggtacactaccagtcttcttcctgggcaggaacattccaaaccactacattgattatagatggaacagggcgctttcctgcatcttgtgattctaggggaatacgatgtctccctaaccaaaaacatcccatctatggcccagtacttgtaccagtatttctaccaccagagattcactcctgaggctcaaaacttagtatcttattaaaatatataccttagggatgattacgaccttaagaacccttcattgttttcatgactttccttacagtacatttggagagattacaacaacaacaacaacaacaaaaccgagagagaaattgtgtgtataaaggaaagtagcaaagactaatcgatctaactcccctatttctgcacctccaagtcttcaccatcataaaggcccaatctaaaggtactgtccaattccaggagacatttccattgtccaagccaggagttctgttttctatggacctagggaactctgcctgaatcttattaaatgaatttcactgtaattattttggtatgtgttttatctactcttccagaatatattattctgttttacacaatgcctatcacagtgcagtgaggttgtacataagaggtctctggaacgtatccgttgaatgaacaaactgatacaacgtaaaatagaatcagtggaagcacaggagagctgaaccctgaatttggagtcaaccgcaatttaacaaagccttacctaacacacccagtgagctcttttctgggtgcacaggagttagttcagaagctaagatagagaaagctgtaacggaaagtgtgtttctcatgaatcagcaggaaaaatgagattgtgagacatttgagaaggatgctctcagcctgtagactacggtcactgcatgcatgttaaatgcctcagctttctatctttaggggaaaaataatgcatgaagtgtttgtctaagagctgacactggttttgatttacaaatcatattttttcaaccaaatatgagtcaagttctactacacgtagcactggaaaaaaaagtgttagttgtaggcacctggtaatttcaagtagtaaggttacattttccagctaaaactagcatttggggactcggtgtttttgtttacctaaatgtcctccagcatcagtagatagtgccgttattgatacattttgttttttttgcagaaaagatcactgggaaaaactcatgcccttcccataggaaattaacagatctgaatatggatgctacagctttcacccactccttttattttcgatttttctttactcagcataatgccatctttttgctcataacagcctcaatcagcactcttggccgcgtcaaggtcaggactgcctgctgcgactggctcgagattcaataaccagccatgaggggtgcacaacattaaatggacacagattgctttttctgtaactccatttaataagcgtcttttctaaacaatccatgcaaaaaatataattttttaggatcaaaaagaaatagaatttactcattattatcttagactctaaacaactaattgtagtgataattatgattatttcaaaaccatctcagtgataagcttaattaattctccaggcaaattcactaactgacaaaagttttctcattcacgggacaatccaaaccagccttaaaaatttaaaaagctaagagatatgccagtactacatctgcttaacagtacccccacagtatacaagagtatggttttacttaacttcgtgtttcccaaatagacaccagtcaatttggcagctcatgaagcttaataatcagacctatagcattttaaaaatcattttcacataatacttagcattttacatgcatatttacaaattaagttctactaaataatgtaaaaactatctatctaattttctttattacatatctgtgtttttattctcccctaagcagttttattagtatataaaaattatcactaacaataatcacctcttatgagaagtagagtataacacattattacacaaatatttttaactacatattttggttattgtactgttcagtattatatttgataaagacacaagaaagccatcaacatttttcgatttagaaaacgaacactgttaatgtgctggttgttttcttgatgtagacactagctagccaggggatacatatccacaccaacacacaccatacatgggatgatcctgtttacaagtgatatccattgctctcattgagaacttgaatcaaccaataatcaaccaaaaatcttcaagtgcaatcagcaaaacatctgaacgacaattcaccaattttgaagtcacgttctcctcaactacgtattttggccactgttgaactttggcctacgtggtttcttagaatttctatagtcaaccaatatttattgggttcctaccatgtgccaggctctcttttaggagctttgcattcagtgttgaagaagcacagacgggaaagaaagatgtgtaatattttgacaaggtctaggagacaatggtgtgctgtttgccgaaagcacagagagggagcactggccggtgctcagggagctgctcaagaatcacgtgagtagtatcacaagggcggattttactaaagacaattgatattcacatcagaaatttacatacgatttgtagctgaatttttcccactacctaatgaggattttgtcagtcaccgtggctaactaaaatgacaaggttacgctagcctatgaactttgcctattttgcatacacttacaaaagaatagagaatcggctataaatttgctgagtcagaacattatactggccatccactttctcacttctttgtttttccagaatgagcacttttgccaatcccggtttgttgtgctacgtcccaaatcaaacagttgcaggagttagaacttccacgtggccattgagtacctcatctctttctcctgtcctgcatactattgtgtatgaaaactagcacatgcaccaaagtaccaacacatgtccaggatcttttttttctttttgacctgtacaaaaaatatagctcttactttcaaatttggaaatgtgtgaagtaagatctttaacttgttatttccatgtataccttactatctaacagcctgtaaggagatgtgtgcatatgggtttatagatgggtttccttgcttggagggctgacatggtggttttcctaaagccatcactaactcagccagtgccccagccaggcttgtccttgaggttttggcagcacggctctctgtcttggttgactgagcctgtgaccagcctcctgacagcaactcccacaaccgacattgctgttttggtccagccacaggctcctgtaagattctgctttaaactcatggtacttttctaccccctgtaggaggctcagccttggtgactactccagcaattcctagaaattgtaatagctaaggatgacaacatggacttgtagactaacactttaaatttctcctttcttgaacttggtcccattttagattaaaatcttgttctgattcttaatcttgcttcccaggtcaagggtatcttatcttttaactaagttagaaagtaaattagacagcaaatgtgtttgcaaaactatatctggcatatatatgcgtatatttatatatcaactatatctgtaaatattcttgaaatagaataatagtgaaacttactggaaactaaaaaccatgtgcttctaaaacaggctattcattgggagaaaaagattatgtagtgatttttttttcaagatcccttacatcatttcgttaatgatttgtcagtagaagaaacaacttgtgtttttaaaaagcattcttgttctgataattggcgaactttgtcaaaatagggcaccacgctctgctcgtgtatcaagctttgatgtgaaaagagaacttacagatacttctttgtttctgaatgccactctctcgtaagtcactctctttttgcatgcaaatctaaggtctctcactatatgaaattaattaatgcttaaagtaataatgcgtttgatgatgcattatatctttagcactttagaatctcaaagaagattttaagagaattggcataaataatttcagacaacagatcttgcacatttgaatcctaaacaatgacactaacatcacattttcagataccaaataaaaataaatctttttcaataaattttaaaatttcaaacacttttggatttacagaaaaattgtgtagattgtacagagaatttccatacacctaatacccgactaccccactattaacatgttaaattagtgtcatacacttgtcatggttagtgggccgatactggaatattttattaaagagtccatactctattcagattcttttcagttttgcctaatatcgtttatctcttccaggaccccaccgaggaccctgtataacatttagacatggtttctccttaagctcttcaatgactatgatagtttcctgacttttcttgttcttcacgcctaccttgacagttttcaggaccgttggtcaggtcttctatagaattcctctctatcgggatttttttttttttttttgacggcttgagatataagttctatacaatatacctatttaaagtataaatttcagtgtttcattatattcccagatatatgcaaccatcaccatagtcaattttaaatattttcatcactgcaaaatgaaaccctgtaccctttagcaagcaccaccccccatcccttcaaggcaaacacacaccaccctctccttccagggcccgaacaacaactcgtcttcttttgtctctgtagatttccctgttggggacatttcctatgaatggagtcatagacatgctgtatggttttgcaactgtgttattttttttggatattgtcaaggttcatccatgctgcagcatgtattagtacttcattcttggtctggctgaataatatttcattgtatggaaatggcacagtttgtctatcctttcatctagtgatagactattggggtgtttccactttttcctagtttgaataatgttgacataaacattgttgtaccagtttttgtgtgaatacagtcatgtgctggataaccaccttttggtcaaggatgggccacctatacaatggtggtcacgtaagattatagtggagctgaaaaattcctatgagctagtaatggcctatggtcttccaacattgtaacgcagtgcattactcatgggtttgttgtgatgttggtgcaaacaaatctatcgtgctgccagtcattaaaagtctagcacataaaatgatgtatagtacataatgcttttttttttttttgagacggagtctcactctgtcacccaggcctgcggtgctgtggcaccgtgtcggctcactacaacctccgtcttcttggttcaagcaattatcctggctctgcctctcgagtagctgggattacaggcacccaccaccacacccagctaatttttgtatatttttatagtagggactgggtttcaccatgctggccaggctagtctcagactgctgacctcaggtgattcggccgtctcagccttccaaagtgctgggattacaggcgtgagccaacgcgcccaacccagtacataatacttaataataataaacaactatgtttctggtttatagttttactatattgtactttttattgttgctttagaaggtacttgttctacttataaaagtattaactgtaaaacagcctcaggcaggtccttcaggaagtattggagaataaagcgttgtcatcctaggagatgacagctctacacctgttatagtccctgaagaccttctagtgggacaaaatttggtggtagaagacagtgatatgtatgattctgaccttgtgtaagtctaggctaatgtgcgtttgtgtcttagcttttaacaaaaacgttttcaaaaagtaaaataaaacaaaatttcaagctagaaaaaagcttgtagaataaagctataaagaaagaaaatattattgtacacctgtgcatgtgtttcatattttaatgtgttattacaaaagagtcacatgtttaaaaaattaaaagtttataaagaaaaaagtaataaggtgaagttaatttaataaactgaagttaatttttttctttattcaatagaataaagaaaaaaatactttttgtaagtttgctataccctcagtgtacaacggttgtaaagtccacaatagtgaacagtaatctcctagatctcacgttcaattataactcactcaccgactcctacagagctacttccaggttgcaaactccatttatgacaagtactctatacaggtgtagcatttttcatcttttataccataattttagtgaccttttctatttttaaaaatgctctaatacacaaatacttgatattgtattatagttgtccatattatttagtgcagtaacatgctgtacagatttgaagcttaggggcaacaggctataccatacatcctaggtctctaggaagctaaaccatcttggttttagtaagtgcactcaatgatgttcatacattgatgaaattgcctaacaaagcatttctcagaatatttcctcattgttatgtaacatgtaactgtatatgttttcattgctcatgggtatattagaaatggcatttctcgattatattatgatgctatgtttaaacatttcaggaattaccagactctttgctaatgtggctgaacttttttccattcccaccagcagcagacatgcgggttctaatttctccacatctgtgttacgtacgtactatacttggctttttttattcttgccatcctggtgggtgtgaagtaggatctcatggtggttttggattgcattcccctgatgcctaataacgtcaaaaatctctttatgtgaatattggtatttgtaaaatgtatatgaagatcattaacctattttttaactgggttatctgtcattttattactgagctccaagagtactttctatgttctagatgcaaatcctttatcagatacacaatccccaaacattttctcccattctacggcttgtgtttttactgtcttaatggtctctttgaagaataaatgtttttattttgatgaaatccaatttatctttttttttttttttttttttttgctcttgcctttagtaaaaaacatctttactcttttttcattgattgctcaggaagcttcctctcccttcagtcacatgacaattgcaaacattggttattttccaaaatcttccatttccctcctttgcaccactcctcccccagcactctctcccaggacttcagcgaagtagaaatccttcatcctctcttcctcatcacttagtctctttcttttctctctatgactcttccatcagaacaaagtccttgctccttacccccttagctttgtctctctctctctctggatgaagtgcagagtgtcgtgaagcagttgtgtgcactcattgttccagtacctcaattttctttcaaccccaaacctagtggcttgcctattattttacccaaactgccctcaaaaattcaaccagtggcatccttttgctgaattcaataaagtatgtttagtcctcatgtcacatgaacctttatgcattgaagattgtttcccttgcccccccactttttgtggttatttttttatccttgttaatttcctttttttaatatatacactttgagttttagggtacatgtgcacaaagtgcaggttagttacatatgtatacatgtgccatgttggtgtgctgcacccattaacacatcatttagcatgaggtatatctcctaatgttatccctcccccctccccacaccccacaacagtccccggagtgtgatattccccttcctgtgtccatgtgttattattcaattcccacctatgagtgaaaatatgcagtgtttggatttttgtccttggcaatagtttgctgagaatgatggtttccagcttcatccatgtccctacaaaggacatgaactcatcattttttatgactgcatagtattctatggtgtatacatgccaacttttctcgccccctttttaagctccttctttcactggctttcatgatcccaccaattcctgcttttccttttttgtttttttcctggctgcatcttcttcgtcaatttcttaaattcttcccttgtcaacctctattttttttcttttttgatatttgagtatttcatccatggcgcttctcactcccctatacattctccagggttgaggtagtctacccccataggttcagaacctatgacctgtatcttcagttggcattcaatagcctatccaactccatgtgggagtttcataataatctatgggattacctgacttctcaatgtctcctgctctccctctcctcactaagagtcccattgtgtggcatcggcaatcacccatatgactaacaagaaccttaagacttcttcttcttcaaagacaggtctattgagatgaacgtacttttaagtcaccctcccctttaacttgtgtgattaaatgtttcccaagataattacagagtgaagccaccatcactaaaattagatttcagaatatttctcacaccccatagagaaaatttatactcatttgctatcactcttcattctccctctgccttgtacacaggctgagtaaaccactagtctaagttttttccctatagatttaatctctctctggacgcttgatctgtcactaaggtctaacctgtaatacctcctcagcagggcttaatgtgtatacttccttacatcagattccctctctctttatatcttttacttgtgaaactgctattttctcccaactgggaacaccatatatgtttgtttactctaatctatttttgccagcattgttctataacagtaaacatacttatatggtttggatatttgttgcctccaaatctcaggttgaaatgtaatccctagttttggaggtggggccttgtgggaggtgctggggttgtgggagctgatccctcatagatggcttcctgctatccttgcaacagtgagagagttcttgcaacatctggttgtttaaaagtatgtggctcctctcctctctctctcgttctcactcttgctatgtgatgcactgtctgcccctttcacttccaacatgattgaatgcttgatgaggcctcaccagttgaggcctcatctacaggtcagccaattaaacctctttcatttataagttacctagccttgggtatttctacatggaaattcaaaaacagcctaatacagaaaaatggtaccaggagtgggatgttgctataaagatacttgaaaatatggaagtggctttggaactaggtaatgggtagagattggaagagtttggaggactcaaaagacgacaggaagatgagggaaagtttggagatccttagaaactggttaagtggttataaccaaaatgctgatagaaatgtggacagtgatgggcaggctgatgaggtcttagatgaaaatgaggaacttactgggaactggagtgaaggtcacctatgttaggccctagcaaagaacttggttgcattgttttcaggccctaggaatctgtggaaggttgagcttaagaatgatgagagggtacatggcagaaggaatttctaagcagcaatgcattcatgatgtggcctggctgcttataacagtctacactcagatgcaggcacattaaatgacttaaagttggtacttatatttaaaagggaagcagagcataaacatttggaaaatttgcagcctacccatgtggtagaaaagaaaagcatgtttttagtggaagaatccaagtgggctatggagcaaacactttctagagagatttgcatgactaaaagggacccaggtgctgctagccaagacaatgggataaagccctggaatgcatttcagagatctatgaggcagcccttcccatgacaggcccagaggtctacaaagaaagaacaattttatgggtgagactcagggctctgaagccaggaatgcaaggtggctgttccctgcatccccactgctccagctctatccatggctcaaagtgccacaggtacagctcatattgctgcttcagagggtgcaatccataagcttggcagcttcaacacagtgtgatattaagcctgctagtgcacagaatgcaagaataaaggaggcttggcagcttccacatagatttcagaagatgtatcagaaagcctgagtgctcaggcagaaggctgccacaaaggtagagtcccacacagatatttgaatagggcagtgccaaagggaaatgtggcattggaaccccatggaatgtccccactggaacactacccagtggagctgtgggaagaagaccactgccttccaaactgaggaatggtagatctaacagcatcatgcaatctcgtcatggaaaagtcataggcactcaactccagcacatgaaagcagccacactgcaccccacaaagccacagtggacctgaccaaagccttgggagcccactccttgcagtagtgtgacctggatgcaggacatacagtcaaaggagataattttggggatttaagatttaatgacagctctgctgggtttcagaattatgtggggcttattacccctttcttttggccattttttttcctttggtatgagaatatttacctaattcctggaacacaattgtatcttggaagtatgcaacttggtttttattttacagtctcacagggggaacgaactcatctccagaagagacattggacatgagacatagaacttttgagttaatgcagaagtgagttaagattttgggggctattggcaggagatgattctattttgcaatgtgagaagggcatgagatttggggatgcaggagtggaaagatatgatttgggtatttgctctctataagtcttatgttgaaatataatccccagtgttggagacagggcttggtaggaggtgttgggttgccgaggcagatccctcataaatggcttcctgctgtcctcatagtagtgattgaattctcaaaggatttggttgtttagaagcgtgtgccactccggatcgagccaagatggccgaataggaacagctccggtctacagctcccactgtgagcgacgcagaagacgggtgatttctgtatttccatctgaggtaccgggttcatctcactagggagtgccagacagtgggtgcaggtcagtgggtgcgcgcaccgtgcgtgagctgaagcagggcgaggcattgcctcacttgggaagcggaaggggtcagggagttccctttctgagtcaaagaaaggggtgacggacagcacctggaaaatcgggtcactcccacccgaatactgcccttttccgacgggcttaaaaaacggtgcaccacgagattctatcccacacctggctcggagggtcctacacccacagagtctcgctgattgctagcacagcagtctgagatcaaactgcaaggcagcagcgaggctgggggaggggcgcccgccattgcccaggcttgcttaggtaaacaaagcagccaggaagctcgaactgggtggagcccagcacagctcaaggaggtctgcctgcctctgtaggctccacctctgggggcagggcacagacaaacaaaaagacatcagtaacctctgcagacttaaatgtccctgtctgacaggtttgaagagagcagtggttctcccagcaagcagctggagatctgagaacgggcagactgcctcctcaagtgggtccctgacccctgacccccgagcagcctaactgggaggcaccccccagcaggggcacactgacacctcacacggcagggtactccaacagacctgcagctgacggtcctctttgttagaagaaaaactaacaaacagaaaggatatccacatcaaaaacccatctgtacataaccatcatcaaagaccaaaagtagataaaaccacaaagatggggaaaaaacagaacagaaaaactggaaactccaaaaagcagagcgcctctcctcctccaaaggaacgcagttcctcaccagcaacggaacaaagctggatggagaatgactttgacgagctgagagaagaaggcttcagacgatcaaattactctcagctacgggaggacattcaaacgaaaggcaaagaagttgaaaactttgaaaaaaatttagaagaatgtataactagaataaccaataccaagaactgcttaaaggagctgatggagctgaaaaccaaggcgcgagaactacgtgaagaatgcagaagcctctggagccaatgcaatcaactggaagatagggtatcagcgatggaagatgaaatgaatgaaatgaagcgagaagggaagtctagagaaaaaagaataaaaagaaatgagcaaagcctccaagaaataagggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaaggaagcccatcagagtaacagcggatctctcgacagaaaccctgcaagccagaagagagtgggggccaatattcaacattcttaaagacaagaattttcaacccagaatttcatatccagccaaactaagcttcataagtgaaggagaaataaaatcctttgcagacaagcaaatgctgagagatttttgtcaccaccaggcctgccttacaagagctcctgaaggaagcactaaacatggaaatgaacaaacggtaccagctgctgcaaaatcatgccaaaatgtaaagaccatcgagactaggaagaaactgcatcaactaacgagcaaaataaccagctaacatcataatgacaggatcaaattcacacataacaatattaactttaaatgtcaatggactaaatgctccaattaaaagacacagactggcaaattggataaatagtcaacacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatgctaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattacacagatcaacgagacagaaagtcaacaaggatacccaggaattgaactcagctctgaaccaagtggacctaatagaaatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaattcaggattaagaatctcactcacaaccgctcaactacatggaaactgaacaacctgctcatgaatgactactgggtacataacgaaatgaaggcagaaataaagatgttctttgaaaccaacgagaacaaagacacaacataccagaatctctgggacgcattcaaagcagtgtgtagaggaaaatttatagcactaaatgcccacaagagaaagcaggaaagatccaaaattgacaccctaacatcacaattaaaagaattagaaaagcaagagcaaacacattcaaaagctagcagaaggcaagaaataactaaaatcagaacagaactgaaggaaatagagatacaaaaaacccttcaaaaaattaatgaatccaggagctcgttttttgaaaggatcaacaaaattgatagaccgctagcaagactaatgaaaaaaagagagaagaatcaaatagacgcagtaataaatgataaaggggatatcaccaccgatcccacagaaatacaaactaccaacagggaatactacaaacacctctacgcaaataaactagaaaatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccgaattccaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatctttgatgaacattgacgcaaaaatcctcagtaacatactggcaaaacgaatgcagcagcacatcaaaaagcttatccaccatgatcaagtgggctgcatccctgggatgcaaggctggttcaatatacgcaaatcaataaatgtaatccagcatataaacagagccaaagacaaaaaccacatgattatctcaatagatgcagaaaaagcctttgacaaaattcaacaaaccttcatgctaaaaactctcaataaattaggtattgatgggacgtatttcaaaataataaaagctatctatgacaaacccacagccaatatcatactgaatgggcaaaaactggaagcattccctttgaaaacgggcacaagacagggatgccctctctcaccactcctattcaacgtagtgttggaagttctggccagggcaattaggcaggaaaaggaaataaagggtattcaattaggaaaagaggaagtcaaattgtccctgtttgcagacgacatgattgtatatccagaaaaccccaatgtctcagcccaaaatctccttaagctgataaacaacttcggcaaagtctcaggatgcaaaatcaatgttcaaaaatcacaagcattcttatacaccaacaacagacaaacagagagccaaatcacgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaagaatcaatatcgtgaaaatggccatactgcccaaggtaatttacagattcaatgccatccccatcaagctaccaatgactttcttcacagaattggaaaaaactactttaaaggtcatatggaaccaaaaaagagcccgcatcgccaaggcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgtcacatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaataacctagaagaaaacctaggcattaccattcaggacataggcatgggcaaggacttcatgtctaaaacacaaaaagcaatagcaacaaaagaaaaaattgacaaatgggatctaattaagagcttctgcacagcaaaagaaactaccatcagagtgaacaggcaacctacacaatgggagaaaattctcgcaacctactcatctgaccaagggcaatatccagaatctacaatgaactcaaacaaatttacaagaaaaaaacaaacaaccccatcaaaaagtgggcgaaggacatgaacagacacttctcaaaagaagacgtttatacagccaaaaaacacatgaaaaaatgctcatcatccctggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatgtagaactggaaataccatttgacccagccatcccattactgggtatatacccaaaggattataaatcatgctgctataaagacacatgcacacatatgtttattgccgcgttattcacgatagcaaagacttggaaccaacccaaatgtccaacaatgatagactggattaagaaaatgtggcacgtatacaccatggaatactatgcagccataaaaaaatgatgagttcacgtcctttgtagggacatggatgaaattggaaatcatcattctcagtaaactatcgcaagaacaaaaaaccaaacaccgcatattctcactcataggtgggaactgaacaaggagatcacatggacacaggaaggggaatatcacactcaggggactgttgtggggtggggggaggggggagggatagcattaggagatatacctaatgctagatgacatgttagtgggtgcagcgtaccagcatggcacatgtatacatatgtaactaacctgcacaatgggcacatgtacccaaaaacttaaagtatataaaaaaaaaaaaagtgtgtgccactccacccttgctctcttggccctgctctcgccatgtaatttgctggctccctcatcatcttttaccatgagtaaaagctctctgaggcctcgctggaacttgagcagatgctcgtgccatgctttctgtacagcctgcagaatcatgagccaattaaaactctcttctttataaattacccagtctctgacatatttctttatggcaatgctaatacagcctaacacacctactcacaatgtttgaaatgttcctcattcactctggaataaagacaaatacatttatgtaacatacagtgctcttcgtatgggcatacgttcctggtaatttatcactacatccctgataataccaaattgcaacttcctgtaatcatttgcagtgtccccaacacagcataattatttctgcgtaaaaacgttcacatccctgcttctcctgctagagaaaccttcctctgactctacatagtgaatctctgttcatccctcaaacttcagctctgatatcctcagtttcaagaatgtaaacctgtgctgccaaaaattcacgttctcactactattgtaatacatattctaggtgcttatttatctatgtctccttttcctctaaaagctccttttgttctaaagctccagaatcttatcttatttttaggggccagaaatgtttcttgaatttagtacgtatttagtgaatgttcgttgaacaaatacataaatggaagttgataatagattctgacatttatctcagagacctgctctaatctatttcattacttctgtagacagtaatatatctctgcggctatacattcagaaagtcacagcaacaaaggtacagtatgcacataatcgtgaacttacatccatatcaaacaaaaatgtgaagcttgacatttcaggctttatgggttcaatagttccttctgaaggcagcttgactctattactacgctgtaaacatccagaaacatgtgaagaaagcgaccagagttcttggaagtgctcgtagacaactaagcaatcctttatgtatgtttgtatgatgtgtctgcgatttagtgtcaagtgaggggtatggagaaaatgacataggtggatgttacgaagaaaaatgcaaacactatttaggattgtcaactgaagttctttgaacagaggctgtggataattaaaatttgtctaaaatatatatgcatttaaaactttgtggtattttctaccacataacaacacagtgatctcaaaaaataggttaatttgctttaaatatggcatacgttaaagaatgtacaaaggatgtacattttgaacaaaatgtctaagatataaagctctaaataactttttgctcaaaatttattaaagaattatgtattgatttcataatatgtgtgagaaacaatggttagttctcaagaagcagaggaagagagacagagggagaacctgaagaactttccacttattatacttacatttcaaaacggggatgcaacaaatataaataaatatatagaatattatgcattaactagtattgaacatgaaaataaagtaggattttggagttactgaacaggagggattgcgttttaatacaggatgctcagggaaatgctactgggaatggcgtcttctgatccaagaaggaaggaaggagtgagtcagctctaagggtctggggacaaggaggcatcagggagtgaacgggagctgaggtgggagtggtttattgttccttgaacctcaacgaggcctggggggcttgaatacagaaagtgaggtagagaggagtgaacgagatgagctcacagaggtactgggagcctgtaagtgagagtatcaatgtccatcatcagaaccttatgaatgagatggaaaattattagagggctttgcacagatggagaattaacttgatttggctagcagtagttctttcaaagaatcactgtagctgtgaagtagatgatgaactctgtgttgggtagaggcatgtgtgactacattaaaagtaaaaagaatggttaaaagtctgcagtgataagcagtgaaatatcatcgtggtttggacgaagaagagtagtggaggtggtaagaagagactagatcgtggatatattttgatgttagaaccattaaaataagataaaaaattggaatacggttttagagaaaaacagaaaccaaggaggacaccaagtttcttgaattaacacctgcaagtgccatttactgagataagcaaggccatgggaggaactgttcaaggacgtctgggccggaaataaaaacacagtagcgacaacttggaaaaggttcttggaatcatgaaatccggtgacagcctaaagggatttggggtagctagaaagttgaagacctcccaagtgtgactccaagtcttaagatgttcagaagtcaggaacatgaggaaggactggtagagccgtgggagacacagcaccaagagaggctggagggaaactaagagagataatggccacaaagccaagtcagggtgcccaagagggaaccagcaaatacccccgtagatcaaggggaacacactctgacagcgacccttgggcttgacaatgtgaggtccctggtgattctggtgaacactgttatagtagccggaaagctcagtggctaggatcatgaaaaatgaaataataaattactgagtttacattaataattagaaatatgaattgacaaggtgcttcatttctcttcacctcagtttttactattcatctccaaaatgaggaaaaataatcatgtgttttgagaattatctgagaatacatatacaaatttttagaacggcgcatggtatataaaaagctctcaataaatggcagttattgtcatattatcataaaatcatagaagtccttggccaacattattatgaatgcaagccttaagtaaagagaatgcctttggccctccccatgagactcaatagaccagagcatgaatccagattctagaacattcatttttaaattttatacatattctagtaacatttagttcagtgttgaatattttaatgaaaagggtaactcattcctattggtatcccatattctcattcctgcatttttttagcaacaattttgcacaatctcttcatattctcacaaaaacaacactcccacctctccatatccacccaggggacacagcaagaatgtctaatttgaatctaaatgtgtgcatatcttagatttaattaatcaacaataaaagacttatcctttgaaaaatgtatacaatgtaacttgtgcttttgataaatgtgttgatttgtatattttctttacttggagtacatttgaatagaacatgaaaatcctttaggaaaaagaaatgaaattttttatactttttcttgattttattctgccttcacaaaattgtataaattaaattaaaagcaaaaaggaagtgaaatgttatttttcttcataaataaatcctaaaataaatgtcaagacatgattgaaaaatgattcatattttattcagtacatgtctatatatggcaatatgctttacattaatagcatgtttatttcatggaccactttttgccatgttacaagtaaaaaagtgtaattatataactcagtctataaaattatagttgaaaactttgtctgggtattttttattaaattgatcacttctgtggattttcccgacacctcaaataataatgaagtacaaccaaaacagactgaatttcaagttgctagtaaagtgtccaaaataacatacttagcattttgagaaatacatacctacacacacaaagacacacacacacaaatttagaactaaaaaaggatgatgccaaattgacgacatataattagaatgaaaacaaaaaacaagtaattacgtaaaaatgtatttgtctttcaatggtttaaaaaatatcacttccttactttactatatccacaaatttgcctttaattatctacttcaatagacaaaaatcattgctcagaaaccctataacattgtttgatttctatttagtttttgcatatgtgatttttttatgggcagagtgatcatcataattatgttttgccagagttcataatgatctttattttatatcattattatagttactagctttattaattttaaaattgtattcaatgaatacacacaagcagatattaatagttctactaacctggtttaaataaaggtctctgcagaaactacctttgaattttaaaaaattcgaagtatattttccatatgagtcataacaatttgattattttcatacgttagctaaagcagataatttttgtattctctgtaatcttttcattgtatataacatttaaagtaattggcctaatatcactgaaatattggattctactacacacacacacacacacacaaacacacacacacacacttgatataactgttctacaacactggtattctgaaagacatatttaaatattataatattattatataatttgaaaatttagtctgattttttaaattttaaaattttatttttgtgtttgctttattttttaaatttttatttcaataggttttggggtacacgtggttttctgttacctggatgaattatgtaatagtgataaaattcaaagttttataacattttacacaactaatcttattcttgttttactttaatgacatgttctaatatcattctcatgcataatgataagtcctttatttaaaaaattaaatacttgtaccaacataaaacttctatgttattcatcctaagaaaatactacatactgcttctgttttgaataaagagaaaatctcattaagaatctcgtaacttactgcaagacgaaatcagcaactgacttgtcattttctttctgcctataactgatgactttgagtaatatatacacagcttcaataggttgtcattttctttctgcctataactgatgactttgagtaatatatacacagcttcagtaggtttcctcgtactttaaacatgatgcaacaatatattagaaaatcacttggagaagaatgtcgctcatcaccccaacatggaatgcaatgattccaatttccactgttgcatacgccttttcagtttccatttttacgaagatctaagtacaatgcacttcaattttgcatttttatttttataatcattgggaggggtacttccatcaatcagatttgttctaatgcaaaatgtatctaaatttacttaatataagagagaaaagctcaaccctagccccaaacaaaacctcaatctatgcattgcccagttttttaaaaggtcctcctttaaaaattaatcttctttcttatgcattttgggacctattttttccatttaattttaaccaaatttaatcataggtttgaaagaaaaatcactgaggagctttcatcttcctgtgtagataacttgaaaattttttaaaaatatatttacacaggaagtccttgagatgtaacttaatagcaacatctaaatttaaaaggctggtattatgtcatattaagtctctcagtttttgacaccttaatggttctgtgcctatgtgaaccatcaataacagtaatccaactgcactactaattcaaagtgactagaattatgtcatcctatgctgcaaagtttatgacatctgtttaagaggtggatgaccaccatttcatttaaaatgaaaagctttctataaaaacttaatgtaccaggctctcttgaaattcacattaaatctcttcactttcttggttcttagtactcttgcaaatattttattatctagtgatctattgacttctccagagatttctttacaaactgacaaccaaaaataacaactactgtctttgaagagtaacctcctgtggttaacatctctctaattgtttctctaagataatcttgataaaagaagtttgttctattctcttttgtttttttctttaaaaagtgcattttagcatctactttatgctaggtacttttaatccccacaacataagtgttattggcttttttaacaactaaataaatagaaacccagagaagctcagctctttccccaatgacacacaacttataagtagctgagtcataacctcaaatgagattcatatgctggttctaatgctctcttctctttaccagatttacaatgaaataaataaaaaataagatactaatttaacacaaacaataattttcaacctcgatcgttcaaactcattttttaaaattattataaacacaaggtaatggacgaaaagcaaaaatattccaatgatacaggatccttaccttttcatgatttttaaaaattataactttaccattaatataaaacttttacattttgtgacctccttaattataatttatttgccattattttaatggcaaaaaccacaattacttttgcaccaacctatatggaacaatcttaaatactagagacattgtatttcctcagcatattactactcaattctcggcaggctttgattgcgtttttgttttttgctcaaattaagccatacagaaagtaatattttgcttagaatttaagaaaataaagtgacccttgtgatatgaacttcatgaactacacacatattatttatatttacaatttatttaaccactgtgacagcaaaaaactaaaaaatggtgcatcgttccaatcatttgccaagctaagaaagctggagtgtttgggggttgttaaatatgcaaattgataaacactccctactcatcaatgtgcttctggaaaattaattgccccactgtttatatcttgtcattgaagagcattcgattaatttctttcctctttaaatagttggccaacacttaattatttgaaaggtattactaagatgcagaacttaaatacacccctgtaaataaagacattccaataaagtataattatttataggcagcaattatctgaggccaacactcttcctatcccagccaacctcggatataattttttttacctttgagtaagcaaattgcaagggatagtcccagagcagccataatttcgcttttttcatcagcgctgtatttttgtatcaccttgcacttaactttattatgtcgcaatgccagattggaaatagaatgatggtgctgagaaaagttatatgtttagaatcccttgatttgtgtgtgtgtaaattgtcaaacaaaatgccgtattagtattcaatgcagttaggtttttagtagcttaaagataagagtgttttgatccctctaataaatacattcattttactacatgtggcaacatttaacagagtgtaaattctcaatattttatatcattacagtattacacattaaatatgttgccacaagacacggagttgaattttcgagctaagaccctactgtctacgtgtgtgtgtttctacaagtgccttagatatttacacgtttgtacatcctttaaattcagttcacaaaactgctaaatgcggaaatggctcttgaaaaatcactgctttccctggatctctactttgtctcttatttactggaaaaagcaatttaaaacgacctctcaccaaactgctgtagttgccttacctgcaaaattgagaaataatgggttgatgggagaattaaataaatttacatatgcaaactgtttagaaaaatgcctgagcctactctgtatgttattttattagtcgtattattttctttcctttaagacagagtttcacactttcacccaggctggagagcagtggcgcgatctcggctcagtgaaacctccatcccctgggttcgagcgattcgcctgcttcagcctccccagtaaactgagatgacaggtgcacaccactacacccgactaatttttgtacttttagtagagaccggggttttgccacattgatcaggctggtctcaaactcctgacctcaggtgatccgcctgcctcggtctcccaaagtgctaaaatgacagtcgtattattttcatattagtgttagtgggatcattattgttaccgttattattaaaaaaccaatcattttcattcgtctaaattgaggcataatgaacaagtgttcaatcatctacttaattctgaaggtaattgaaaattattacctaagaataaaaacacaactaacagtatggtgtcttggtcgaaagtatttgatgcggtaccagttagaactagatttgacactggtgactgtcaaatattggctgtgtaagcttgtaaaaattgtaaaaaaaaagcttgtaaaaatatcatgtgctgtatcagctcctctacaaaatagaaattgataaccaatttcagatgatttttgagaggattgaatgaagtaatatttgcacgttttctaacagggcaatcactcatatgtgtgtagttataggtatagattatacctatatacacacagagacatacaaatagaatagatgatataaagataatatatatacattttatattttgttatatattactacataccatttccaaacattatcatcagtttccagttgaattttaaaagagaaacaatttctcattgtattatttttaaataaatttataaatgtcatcaaatttgtgacacaaaataaatctatctagtaataaatatggcaataataattttgtacacctgctataatttagaactgtattttcccatagaaaagcatctgtgtggctatgaacgtatatattatcatttaacatagtgctaattccatcctgttttatcatttgatggaaacagtggaggagttgtgtctgtagggaaactggatctctttcctttatgttaatgctctctgtattttaatcactcgaatttcataactttgagttacttgactttcacttaccaaatatttggtaatcactaaattttaatgaaagcatatatctgcaaccagactatataatgcagtcaaaagtttaaactcaaggtagttgatatctaggatagtgtatctatttatatttttttactgcatggctgttatgaaaagcctattttgtgttaaatgttgtagtttagttaatgatcacattctttaaaaagtatgaatttcttcttatattctctgctaatacagatttttaaaaaacattagggcaccattttctctgattattaatcttgaaaataccttcccaattcatgaagtaataaaacgttccatggaatagagcaaaaccaaaagcaaacacattctacttacacatctgtttctttattgtctgcctgatgttaattatggctggtctttaatttatcatatattctctctctcttttttatattctcttttttcaatgaaaagaagttaatgttagatttaagaattttagagtataaaagtggtctcttatattgtcctaatctacaataatcttataattggttaaggtgacatttaagaattgaaaataatgcataacacatgtccgtttttatggacaaccgtaaagtatgtattcctgtgtaccagaaccgcagacttcaagacttttgtgaataaaagtgatattcaatattgcacactcttgatttatttatattcagttaatctaattacatatacttataaaatgtttaaacatcatggaaatttataaagtaaataatgaaaaaataactgttaattccctggtccttcttcatcccacaactcaaaagtaaaaactggaaacatctaggtttccctctataactttttatatatgggtaaaaattggaacagaaagacccacatcacttttgaaaactaggcaacaatcatatttttatgcactgctatttatttcacctaacaagagttcagaaacccttcaacagagctagacctcaattttcttaaaggatgcatagtattccataacttgaatgcactgaaatgtatagagccagtctttcttttgatagacatgtttgggttttcactgtcacatgcaacttggccaaggagtctgcatacattcctcttctcgtgtgtcagtctcagccaggcttctctagaatcagagcaggaggcaagctttcagtgtggatactttattaggaggtaaaatcccagcgcaccacgagtgagggaatggagaaacagagtacagaagtagggagagcaaagggaagatgtcacgggacaaagccagcctttgccttccagacattcatttaactatgtgagcctgctccattcaggctgagcagaaccctggtcctcggaaaatgccaccgaggaagaaagagcgaggagtgcatttgctggctcccctctgcttcagatgaatccaagtttgtcccacagttcctgattgtgtcacctggccctttgggcttcaaccatggagccaggtatcacacactgcagggatggagcctcattcaaatccccagtgctgagaagagtcagggactcaggggatgccacagggtctggtctgggtgtcagagctgtgctcaccctggggagctgggagagtcagcagtgctgggaggtgaggcagttgcaacagctctggcctgggccatgggaggaggcagtagctggggctgggagataggtgcagccgtgatgagaatctagggaaggcaaataagtagcatgggattcatcatgtatgagtatttccataggattttgttctaagaaaggaagtgggtggtccagagctagcatgtggctattgtgacagcccattttcttaggaaattttaaatttccactgcaatgcacttcttgccttctttcacggatttagattttctgatgcttccagctatgcatattgatataaatggcatttccaaagcccaacaggtattttcaacctgaatacatttatctaacaccatgagttccagtacagtggcaattcccgctgagccacataaagaaagatgcgtgtgaatataatcaagttgacccaacgcccgtgtatctgtaaatgaatggtctcaccaagcacccaacatattagtgttttgtttttatgttttgcttttattatttttgataaggcaaagatcaaatggttttcatgaaacagttggaaagccatagcagtaacccagatagcaaacaactcttctttaggaactatatcataaaattaaatattaatgaatctagcaaaaatcccaagtagcagctcaatgcataatttcagagttcatattattgtatgggagcttatttttccctcttttgaaactgtacatttagattgtacacttttgaaaaacctttccagtaacatcagaggacaggcaggttctgtgcttgccagcaggtctccagttggtcattgcttgatggatgacacctgtctttccttgcaattctgtactctgtctctggttttcatttacccactatctctatggtctggaccaagcataggtgacagcagcacggccccagcattttgcagaaacacatcgtgctgatcatttgcaaaatcctcatggctcctgcagacaatattaataaataacttgcaaattccctagtatgtgtcaggctctgttgtcactgctttaaatatattaactcattttatcctcacaacaatgtattgaatatgtagcaaatgaatgcaaactaaggcactctgtgttagcctgtgtgactcaagtaaggcatagaggccttggagttgggacgacaatatttacttcctttttctctgtgtgtgtttttgcaatactgcctgatatggttaggctttgtgtccccacccaaatctcatcttgaattataatccccatcatctccacatgtcaaggaagagaacaggtggaggtaattgaatcatgggagtggtttccctgatgctgctctcatgatagcaggtgagttcctatgaagtctgacggttttataagaggattcctcccatcactcagcactccttcctgccgccttctgaagaaggcacctggttccctttcaccttccaccatcattgtaagtttcctgaggcttccccaaccctgcagaactgtgagtcaattaaaacactttcctttataaattacccagtctcaggcagttctttacagtggtatgaaaacagtctaatacactgcctcagaaattgcgagagtagaattcacaatacaacttgcaaggaacacagagacagaaagagacagagaagagcctgtggattaaaagataattaaaagatatcttgcacatttataattcatagttcactttttgtgatcaaaccttctgtgttactgtttttgccctttatgaaacaagttgaaatttgaacacttgctggatattggctcatactggagtagtactggcgaatactttgtgcgatgtctgaattttttgacatatgttttattttatttccatctctattgaagtatgactggcaaacaaaaattgtatatatttaaggtgtacagtgtgtgatgctttgatatatgcaagcattgtgaaatggttaccacaaatcgtatatatttaaggtgtacaatatgatgttttcgtatatgtatacattgtaacatggttaccaaaatgaaggtatataacatgtcatctgattctataaaatgacatgttggtcctgattcatttcaaaatgataggaggtggcaacaatgagtaatctgtatttaattattggggtttggtggtgggaattttgcagaggtttgaaattcactcagatcaaaatctcttaaaaactatctaaaaaatgccttttaaaattcacattcgtagacccattccaaacagtgagatatgtgtgtttggtttgtatgaacatgacacgcagatcagcgatagaggagagactcccggacactcagcaggaaatcaactaagactctagaatctaactcagagaatattcccttcttgagaaaaaattccagaaattttacttcttaaaactgaccttagtggaactggaaatgcttcaacttgtgtgtagtatcttaacagcatctaagaacatatgatacttcaaagttgctgacaagaaacaattcaacttttttcaaggctagaaatctaattaagcaatcgatcaatgttcattcctccattcaactttccatctatccattcagtaaacacttattgatgatacagtagagaactaatcaaactaaaccaatatttggcttcaaggagctcaaagccttgaaaaatatgtagcacctattttatagaaagtagcactgtgtttgaagctggaatcaacataaaggccatttcttataagttgttttatattttactctatataaaggtgattagatgaatactttttgaagcactacggcttttagacaaggcaattagaaagaagaaaggaaagaaggaagtatggaaggggaaaaaaagcaaggaactatttcaagctataaatatgcaatctcattcggagtaaataaccactatatgtgttgtaatcgcatgattagtctatcatctatctatctgtgtgtcatctacctttaccttaaaactttaacataggcaagcaccgcatcaggccttggtctgtagtattccacacctcagctactgatagataactttatctttttcaaaatagctttatacttgcatcataatgaatgaacaatgaacatgtgtgattaataagatcaagaaagccactgtataattggccgtggttttcatcaaattacgtgggatactgcctaaaatcgcattctaaaatctaaatttctatttatcaattagtttattttaatttgcagtacttattaatacataaatgaaaagaaagggatggtggaggagatctttcaatccgattgtatttttttttttttttttctgagacggagtcttgctctgtcacccaggctggcatgcagtgttccattctcgactcactgcaatctctgcctcccaggttcaagcagttctcctgcctcagcctcctgagcagctgggattacgggtgcctgccacctctcccggctaatttttgtattttttagtaaagatggggtttcactatgttggccaggctggtctcgaactcctgacctcaggtgatctacccaccttggcctcccagagtcctgggatcagttggcatcttatgtagaatagctaacagtgaatttacttatttttgaattatatctgaattcttaacaccttaagttatatagatggatatttcatatagacagaaagaaatagagatagactttttgtgtgtgtatatatatatatttacacacacacttaattctggtttatatatatataatattaaatatagtatagtgtatatatagtatagagtatagtgtatatatagtatatactatattagatatttccacaagctttatttttcatttcatttttatcttttgcttttttctcctttatttccttctttcccttcccttcccttcttttcttccttttctcccttcctcttctctctccctctctgtctttctttctttcttcctttctttttttgtaagaaaatctttcctggtatttggaattcagagtaaatacagaagccctccttccctcatggtaaggtagtatgtgctctgcctacaaatcttgaaagattcgtgtctctttctctgtacagtagtactttaaaagctgagaaggaaaataagcatgagaattatatatgaacaagcgctatacccaagtcctctggtaatatacaagctcactgattctcagttcgaaaatatgatatgaccttgtaataacatgcgacggttattgaatattttggaactgaaaagtgacttgttttcttctatcaagcctttatttctccagaataaattgttaaacaggggagggagttctatcctaaatatgaattaaagctaaaagccattttacatgtttggatgcaaagcgtctcacttgagcaactccatgagatgaagctttggcatttgtctagcgccatctactgtccaactcaagcagaagcatagatcttgtcaccatgattcgaagctggttttgccctctaagcgtagcttgagttgtttgcaataggatatgattggaaaaagaagagaaattacaacaaatctgagaaaagtaatcagttataaacctaagtagagctgagaaaccaagataaatactaacaaatatgtatataggtatgctcaaacaagcaaccttaaattcagaggatagggaactctaagatataatggtttgtatataaaaatgaacacacagagacagacacacacacacacacacaaacactagtataatctgaaataatttatgaaagccatttagtgaatatttaattactcaaaagagtctttaatagcaacaatttaaagaattttcttcattaataagagatgctatttttcacattttcttatgaacacgatttttatttttatagtaaagagtaaaaagttagaattttagtaaggggaaaaaacctatcaattcaattcttcagaaaactagcagatagcctaatgagtataacaaaaaagtacagtaagttcagcttggtttgaacaatggtaaaattaaggaatacaaatgactgcttagtctatttccctgctgggtaataacataaatttacctaaatatgtaggccacttttggagctcagtctttcagtaatctgctactgtggtataatattaccctccatgacaattcatatgctgcaatcattgcttctttaaaggagagtggtattcatgggcaacagaattaacttaaaatctacaggtaacaaacaattgtgaaaaaatgcatacctctctgaaatacagagcaaaccgttaaaggagtacaagtggcctgtttttgtaaagatctttacttcatacatactaagaacaattttaaaaattgtacacttagttattggaattagattgcttttaacaagactatgtgtaaacatttaagcaaatcagcacatttcaatgctttctcaattttcaccgtacaaggatgcttattcataatatagcctttttttgtaaacttagcacatcagttcacaataggttatttaggaaaagcacaatgcaatgtgttgtgttttaagtgccgttaggtgcatatagtctccttctgtgctaatttctaagacaatatcatgacctctttcttgtgtgctgagtgtaccagtttacatctggagtcatttctcagttttttgggggtgttttatttttccttctcagatctaaattagttcaagtaatagaagttaagatcaagaagattttcacaacattgtaggtaagaatgagcaaaaaggcaaagaacacattgattcaaggagattagctttctcctaatccatgcacacaaaaattattacacattatgtaattttatgacaattaaaaatatatacaataagtataatacaaagataaaagagtttctcagaaagaaaaataaaaggcatcctccttatgtggagattaattttaacagttatttctttcaaatacactacttattgaattccatttataaagatttaagtttttctttttatcatgctctttttcatgacacattttacacttgaagatgtgtcttttgacaatggcccctgaatgagtatgcaatgtagctgaataaaacaggagcataaatctaaacagatgtacataagaagatcccaatttgtagccagtattttgactattacaggaaatataagattggctgcatttaaaaattttacattaatcagggttaagataaattatgttattttacatttctgtttatcataaagaactacagaaaaaaggagtaataattccattgtaaagaaatatcaattatgtatttctgtcccttataaacaccagatgttataaagtcatatttgctatttcaaagtagctcctaaaatctcttcccgatcccctaaacttcctcctagttcttcttcatatcaatgcattgcactaagttcagccagttacccatgccatttactcataaccatttctcccatctcactttcctaatttcctaatcctatatttccaagtcctgccaaatatagccaataaacacaaattgaaactatctcccctattccatctggaattatttccatattatctttaaagaggaagacagactatgtgtttgcactttcaaaggatgtattcatgcctgtaaaaagtacagtcctagagatttggtgactcaaatcttttcactaacaggcccgtcttctttgccttcaagtgaaaatatttaaacaacaaattgctctacccagtgtagcatcaaggaacatcattgagaaggaaatttccatcatgtacaatgggaaagggacctacccaaacagagacacactataatccaaacacatatgtatgtgcacacccatgaccctgttcagaaataggacctgtcagcatcccatcaccacataaaacctatttgatctgagcttaagaatctctgtaaaatgatgccattgtctgagtatgtgaccagtaaccctcagcgtgttctgttttggctttcctcagaagtggagtctaagaaaattattttagaatgagcagtttgttttggaggtggttcttaaaatcactcacaagaaaagataaggtgagaaaagaaaagaaagggtcagggaaggaaaggaaaaaagtaaattaatggtgctttcttgaccaacttaacacaacgcgaggcaattagaactcatctttctgcagaactcgggaaaatgtacacataagttgtgtcatttgatggaagcctaaactataccattaaatatagctttcattttgtagaaagtattagtaatatatgattaaaaatgtccttgtgggttttttggaggaaggtaggtagaggtaagacagcatagaatcatgatgatgatgatgatgatgatttttattattattcagaatgattatttcttgtacaacccccaaaagtcaatagaatacaagacacaaaaagagagcataatttctatcaccagttagtagaggtgctggaaattatgctctctcaaaatttcaaaggaaatttcattacttgtgaaatgtgtagggtcttatattctgtattttacccatttttacagttgaaatggcacccagcagtatcttttgtgtagaaaacattcacagtaaatttgtgggttttaagattatagtttgagtttatccctcctctatgaagctgaaaaacagtacagaggagaaatttttaatatgtcaccgagacttgcaggataaggcagaacccagacacacaaaaagctgatgatgctccgagcagagagaacgacaaggtgaagaggacgacaaggtgaagaggacctgccaaggcacagtgagaagcagggagaggggtcatgggagaacaggatgggtgagggcaagggacaggatatttggggtttgagaaaagatttcaagggttaaggtagtaagacttgatattgtagacactaagtaagctttgcaaacaaacaaaaaaagatatcatttacgtattgagcaaacaaaatatggtggcagctttaaaaaatataataaaggaaggagaataggcaggcacagagagacaggccaatggctgcagcgtttcatgaacagggacaaggacatcaactcgaggaaaggttgcggaaatggaataggggagatagtttcaatttgtgtttattggctatatttagcaggacttggaaatataggattaggaagttaggaaagtgagatgggagaaatggttatgaataaatggcatgagtaactggctgaacttagtgcaatgaattgatatgaagaagaattaggaggaagtttaggggatcgggaagatattttaggagctactttgaaatagcaaatatgaatttataacatctgctgtttataagggacagaaatacataattggtatttctttacaagaaaatgaatacgatttctagggagatttttataaaacgaagaagaaaataaggagactgtagttacagaatcaacaacagttaaagagccagaataggaaagtctgagataaactggcccatagaaagcaggagaatcgggagaggtggagcactgcgaaaaaaagtgctattagaaagggattgggactttcataatgttatagaaccggaaatctcaagtgacaggggacagatgaatgcatttaaccatgtatgcatctctcaaaacatcatgttgtgtaagataaaaatatgcaatttttatttggcaaataaaatcgatcaatcaaatcagtcaggatgttcttacaagtctggattttatctcattaacttcccaaccagaattcattttgtcgttgttgttgaggttcattccctttgttgtaaaagcaatattatatctgaatcatccattggctgatttatttctggctttaaaagtatttttggctttaaaagtaatctcctacctttctgctgaacttattagttttggccgttgtaatcttattatttcggtctaagaaactctgccactttctgctggaagatattgtgatatgtttcccagacatgtggctgaatttctctttcaggagagagttaagggaagaacacactgctatcatttttcggagatacgcattcagtgacctgttccccaaaggatggagaaaaaaaatgaagttagctttggggatctcacacaccaccttgattccactgcaaactcataggctgcagctaagatagtcaaatttacttgacgtctgaacacacaaaccacttgtttgcctccaaaagagaaggcatcagagtatcgtaggactccttacagatgtatgatgactcggtgatgtctgagaagagaggaatttcctgtgctgttgtgtagcccatgaattctgtcatacagaaccactccctttaaatgtcaccttttccttcgcctcctcctctgaaatcctctttactacatagacacacttcctgtgttctcaaagcccacattgcctctattggatttgagatttactcagttcgaagcgtcccgatgaagcaatcggaagtggagacagagagacttttctgccgtgcctgttctgcccatcgcataatcataaatatcccacgtgtccatgataagatgagttggaacaatcttttgccttcaatatactcatttctttgtgcattttcttcctgcactcagaaaaagttttcacttttgttgtcattcttgtcatgaaaggtccctgatctaagctatttagtattattcatgctttatagaaagagaatttaagaaatgttacattccttatttactatctttggacttagcaaacacccagaatgggccaggaatccatgttctcactatttctgaaaccagtaatgaggcctttcctttcctttcccacctatccaaatcctcccatttttcagggctcagttcccaactcttttcctagaggactctgccagctactccagcccacattgttcttcccctattaatagtatcactggcaattataatcttgatttaatcatatttcactttgagtttctagatttagcagtttcctttgtgtgctatgtgaaaaataaattatacataggtccattctagtacttctcactgagttatcaatatgtggtctctctgtgacttcattgccagactgtgccctctacaaggatagtgacaatgcatttttttatttgaatacataataactaatatactatggttacacagtaactattttgtgagcaattaaatggatatagttgaacaaatatacctagtatacatatctatctatctatctatctatctatctatctatctatctatctatctatcttgtctccctacatgcaataaacccttgcctatagaattaggctcttccaggtcagaaactcgaagttagttttttttttttttttttatctcatttacgcctcaatatattttacaagctcaaatttattcaataaattcatgtttaattgatttcttaaatttggaaataaaaaactatgcaaagttttaaatacataaagagtctttaaggtattctgcaacctcagcccttccacttgatattttgaataaaaagcatgcagcagtggtctttttctttagagaccacactgttgacattgtacagcattttattcacaaactgcatggaataagatgatttgggcctataagtaaaagccaagattctacaattcgagcattattttgttttgttatttttcaacacttttatgaggcaggggaaaaacattgatgctggacacttttgtggggttcttcttgcagggagaatcagcttcatgcaatgaaaaggatatgacatggggctcagctatacctggaaagaaatctcagcccttccaacacttatttgcaatcctgggcaagtaatctcactgaatttctgttttcttatttagaaagtacgaataataagccctcatttaaccacagtattttgtaaaataaactagagtaggctgatgaagcacatgtagttacaagtgctggaaatcccagtctccttggcactagacggtggtgtacactgcgtggtggatttcccacacactgggaccagcatcctctacgtgccctgagggtggatgtcgccccttctcctcccacctctctaactcacgtggctgaatggcatacggcagacaaacgacctctcctgacatgtcgcctgcttggtttgcttgggcaatggggagtaccggagggaaattgaagagtattggggagcgagtttggcattgtgtggctttagcttcaaattccggagggaatttgaagagtattggggggcgagtttggcgttttgttgctttagcttcttcctgttttcaaaggaaggcttcctctcccacaggtaatggtttctgtccgtggcctctgctgaggcaaccccactttccctaagaacattcaaccccaagcatagagaaagatgcaatgaggtattcaactatccaccgggtttcccatgctctgtgtacaacgttgtagactcttcaaattattccatttgatgtgccgtttatttcctctgggaaccagactaaaacacctttataatatgttataatattataataattatcttttaaaaaaaacagaatgccttacactgaacacttcctcctttttcagtaacaaactgaggaaaactttctactttcctttgacttgaatattgggattaagactttgaaggaagaaagcaaaggaatgagagcaagtcctagatttcttcactagattaagtgaagaaaaccatcaagagggagctagcagtgttagctccaaactaaacctaaaaactgccaagacagaagagaaaattgacaattagctgagagctcctttccacaaagcaccaataacatcgttagagtgctatggattacttaagagcactagcagagaaaatctggagtcctctacaagattttatagtaaggtggaaaggaaatttaagaattcaatatcgcaatggggcatcgtcattttctcttgtgcaagaatgctgtagaatgctagcagaacatgacgtctaccagagcaacatggttgatttctaacaaggatcagataagagaatgatgaaagctaatatagatacaagataaatagagttacagataaatgtatataatacctctatttggatataattatcagatataatttacatatcataaaatttaccattttaaataatacgtttcagtggttttcagtatattgaaatgcaagatcatcaccactctctcattttgaacatttttatcatcccaaaaagaaatacccatgaccattagcagtcaatttattttctcctcatcaaccagatgttgacaaccactaccatattttccaaatctagacatttgccaattccaagcatttcgtataatagaatcacataatattttgtggctggcttctttcacttagtataatctgtcaaggttaattcatattgtagcatgtattagtactttatgctttttattgcggaataataaccaattgtatggccataccatattttgtgtatttattctttggttgatgggcatttgttattttttcacattttggttattatcaacaatgctgctatgaacattcatgtacacaaaaaatatttttttgtgagcatttattttaatttctcttagatttataactgggggtgaaatttctgggtcatatggtaactttatgtctaacattttgaggaactgccagactgttttccaaagagattgcaatatttcacatttccactagctgcctacgagccttccaatttcttccaatcctctacaatacttgctattgtctgtatttttgataatagccttcgtagtgaatgtcaaatggtgtctcactatggttggatttgcatttccctgatggcaaatgatattgaacaaatttccagaaggtgatctgtctactttactgggatcaatgtctattcacaccttttgcttcttttaaaaaatttggttgcctttttattattgagctgtaagaacttcgtgtgtgtgtgtgtgtgtacacacacacatacctatgtttatatatacatgttattttttctagttacaagtatcttaccagatagatgattcgcccaatttatctcccattctgtgggttatctttgtgttttcctgatgatttcctttgaggtacaacgtttagagttttgatgaagtccaatatctatatgtattttttgttgttgttgcttgtgcttttgcttttatctgaaaacaaaattgctttctacatgcctgtagagattcatgcctgtgttttctttgtaaggattttataattttagctctttcatttaggtcctttttgagttaatttttgtatattgagatggattgggcttcgacttcatcactttgcatttgaatatctagttgttctagcatatttgttgaaaagtctattactttatttgaattgtcttggcagtcatatcaaataacaattgcccagaaaaataagggtttatttttggactctcagtttccttccttggatcaataggtctatccttaagtcactgcaactctgtcttattgcggtagctttggaataagatttgggaagcatgagttctctaactttattcccccttttcaagactaccttgggtatttggggttctcttgaatttcaacataaattttagggtcagcttatcaatttttgcaacatagatataggtattgcattgaagcttcagcttaactgaagattgctgtagcaatatgaaatctcccaacacagaaattcagtatttcatcctatttatttaggtcttctttaattcttttaaacaatattttgttttcagagtataaatttgaacttctttgttaaaagtattattgcattcttttagaagctactgtaaatggaatggtattcttaattttatttgcagagtctcatttcaagtatatagaattacaattgatttgtctactttatctggtaacctgcaagcctgctaaattttatttttagatataatagttttttaatcgaatttcttagcattttccatgtccaagagtgtaccatcagaaatgagagatagttttccttcttttttttattattctggatgccttgtctttcattttcttgcctaatatgctttctaaaacctctagcacaatgttgaacagaagtaccaaaaaggcacatcgatgtcttgttcctgatcttagggggaaagcgtttagtcttttaacattaagtataatcttacatgtgcaattttcataaatgtcctttatcaagttgagaaacaccactgtaattcttgtttgttgattttattatgaggaggtgttggattttgtcaaatgctttttctgcattactgagatgattaggtggcttttgtcctttatcctgttgatatagtatatcacattaatagattttcaggtgttgaatcaacctttctttcttcattaaatataaaactatttttaatattagagatataataaagatatacttatgtattataatatatagtaaataaaaatgaaacaatattttcactttcctgatggtttcctttcatgtgcaaagttttgagttctgaggaaatccaatttatatatgtattatttgttgcttgtgtttttgctcttatctgaaaacaaaacaaaaaaatcaacactgctttctccatgctgacaaagatttatgcctgtgttttctttgtaaggattttatcattttagctcttacatttaggtctctgatcctttttatttacttatttacttatttatttacttatttgagacagtgtctccctctgttgtccaggctggactgcagtggtgcaatcttggatcactgcaacctccgtctcccaggttcagacgatcctcctgcctcagcctcctgagtagctgagaccacaggcacatgccacgactcccagctaatttttgtatttttagtaaagatcaggtttcaccatgttggccaggctggtctcaaactcctgacctcaagcaaaccactgcctcggcctctcaaaatgctggaatttctgatccgttttgagcttcaactttgtcactttgcatttgaatatctagttgttccagcactatatatatttttttattttatgtatattataaatgtatattccttaatacattattatgatgctggatttttcttgataatgttttgttgaggaaatttgcatctatattcataaaagatattggtctgtggatttctttatgatgtctttttagtttattggcatcaaatttctactgaccttgtaaaatgagttggaaagtgtttccttctcttttattttttgaaagtgtggatatatttacattaggtcttctttaattgtttcatataattcagcagtaaaactgtgatgcctggggtttccattgtgagtagatatttttatttccaagtaatcacagtacatatcacagattcattcagattttctatttcttcttgagtcacttttggtactcggtgtcttctttctaggacttctaaaaaaatttattttaccagatttgttggcataaatttattcttaaaatatttttatttctgtaaaattgttaaatgatctcttctgtcatttcagatttaagtaacttttctttttgctttaattggaaagtctatttaagactttttaaaaatatttagtcgatgttacataaccaacttttgatttcactcattttctgtgttttctattctgtatttcatcattttctgctcaactcttatatatttccttcctcttgcttggtttgtgttaatgttgataatccatttccaatgtgctaggtggaagtttaggatattaattggagatttttcttcttttatatataaacatttacagctataaatattcatctaagcccagttttacctgcattccataagatctgatatgttcagtcattatatgcctttaccgcaaagtattttataatttacattgtgattattttgcctcatgatttatttagttgtatgctgtttaatttccatacatgtagacttttcctagtttctactagaggcttttaactcaattacaatgtgttaaagaacatattttgtaggatttcaatccgtttaaatgtattaaggcttattttatgacgtaaatacagttatcatggacaacagttcatctgcaaatgagaaccgaggtatattagatttttttcacttggctacttttacaaacgtttttgttacgtgtagataattcatgatgctattcaattcttctagttccttgttattttttacatagttttttatttgttaacgaaagtgggatattgaagtcaccaaccattattttaatctatttctgctttttaattctattggttttgctttattttcaatatttattaattctactggttttgctttatttatatttgctttatttatttatttatttgctttatttgctttgttggtaggtgcatatatatttacatttgttatattttcctgatgagttgacaattttatcattttttttaaatgtctcacttcgtttctagtgacactttttgttttaaagtcttttttgagcagtgttcgtacagccactccagcttttgcatgactgatatttgcataatgcgttagttttcattcttttacttgaacatacacgtattttttatctaaagtgagtctcatgtagtcaatatatggttaaatctcatttttaaaatccagtctaacaatataggcttacatgcctctctctctttcccttccttttttgacccatatatgccacttctaggaatttactctgaagataaactttcaacaatgtaaaaatacatatgtacactcttaattataaaatattagaaataatctaaatgccatatataaaagagtatatgaataaattgatacattggtacatccatattgtattcatgaagtataataaaagaaagaaaaaatagaaagaaaataaagctatatttaggaatcgataaggagtaattttcaagatatgttgttaaatacacaccctctcctcacatcaagcccctggaggtaaccattatcattagttattgatttattatttttacatttccttttttaaaaaatgaggagatatatgtatattttcttatttcccattctttcattcaaaactgtcacacaacatatgatatacatatatattgttttgcacgtataggtgtgtgagcacacatacagaaggatagactgatagatgagagagagagagagagagagagaggtatgtgtgtgtttatgtgagagtctatggacccctgtaccctaactctatctgctaagaaggactacggcagtgacatcccaacaccaaaaagcaaattggtaaacagatcttcaccataaatatcatttgccaacaaaagaaaccaggggtccttgaggtaatgactcattccatggccggtgcagggaaagtgcaggccaagcctgggatatgtgttagggctaaaaagtaagaacatttccaaaaatcacaggacatatcaaaaggtcacaaaggccaacttgaagagacttccaataggcatctgggagattttcagcaacaaagagagtgaaataatagcaaagatttgtaacccatacattcacacaaattaataattaaatgagttaatgaatgaggagaagggaaaatctttacttacaatataattccaatttccaagcatcaaagaaatgatggaaatagaaaaatcaccatttggcaaacacgatggcatttattgtttcaggcaagaaggatgaatatgtggtaagcccagtgaatgaacgtttgatgagaaacggaatatgtgcaatgtccgaaagtatcactcacagtattttcattaatcacaaaaagaacaagttactttaaggtggagaatactgacagacatgccccaaccaagtgtcaaagctggtatcagtaggaatgactctgaaaacacaaaattagttctattattgccaaaaatccatagcctaaattgaatcatgaggaaacattagagaaactcaaattgaggagaattttatgaatcaagttttctacaaatgtgtcaacctcttgaaagataaggaagactgagaaaccaccaaatgcagtgagtaagcctgaatcctggctgggaaaagtagccaaaatttgaataagctttgtaggtgaggccattttttattaacattattttccttgcttatatccttgtgatatgtttatcattacaggaagttgtatgaaaggtagacaacaattcttgttatttttaaactgtctataagtgtgaaatgtcaaaaaaatagaaaaaaaaccataatgactggcttaaggttactggtagccataagagactgcaaatataaggttttatttaaagctggagagaaaaacagtaagtaaaggtaattaaaagcaaagaaaatttaccttaataggtccttggctatttttgacacattatattttatgtattcttcctagaacactaatagtgagggcctactatgttgaaacttgatgtgcaaaccacagccactagaattgctggagttactttgtatttattgatgatgaaacagagaatcaaaatgtatagcaatttgtccagttcacagagccagttttggaatgtggtcctctttacagccagaatgtatgacctttcaactacatcacaactatgaaacagaaatatatgacttcaggtatcttacctaataattaatatttcctgaggttcttgaggtgaaaggtaaaggtgctaaaactatgttcaatcagtttatacgtcagaaactagttctaagaaagaaaactattttatgatggcctctagaaaaatcccattttccccttaattttgttttaaagaaataatttctagtcattttagtcaatatctcataaacacacttgatcttggctcaggctggaagaagactgaagcagcacgatagagtggagtgaatttggtgagaaacgagaaatgcaaatgtctacgaagtaagctgaaaaggagagagaacctccaggttcctatggattagagtaggaaggcacatacaggggagatggcactcgggtcctcacagccatgggcatcctgggcaagacaggtgagagcgtgactccgacaccctcccgcaggacaggtgagaacgtgactctgacaccctcttctgcttcaggtcctcacagccatgggtatcctgggcaggacaggtgagagcgtgactctgacaccctcctctccttcaggtcctcacagtcatgggcatcctgggcaggacaggtgagagcgtgactctgacaccctcccctgcttcaggtcctcacagccatgggcatcctgggcaggacagatgagagcgtgtgactccgacaccctcccctgctttggttttgttctgcatgttattaggtcgctgcaaaagtaattgcggtgtttgcaattgaaagtcatggaagaaagcgcaatcacttttgcaccgacctaatacattccggttaaggacgcttttgtcgacattaagatgtgtgtttgctttagtcacagatcacattgagtgacaagaaacatgatttcagccaaacccctagagctcacaaggagggagtggtgcacctggggaaacgcaaaggcagagaatccaagggaaagtattggtggtgtttgatttcatagtaagaacacatgttttcaatcaagacctctccaaataaatagatatgtggaaatggttccattcattacatgcccaaattaatagttaatagaataatgggccattttccagctttggaactagcaaagccttcctgagagcagaggctgatgccacggtatgaactctgtgttttgagtcaatgagatttctgaaaatacatctggaagtgaaacatgtgacagtcacatctcactatgaagaggtaaaattctatgtgcaaataattgtacctatctctacatccttaggtaaaacaagaatactcttacaagtgaagacactaagctaacaatgtaaccttacttgaaagactgaagtttattgaagtgaattagagagcattttattcattgaataacttgacccttgatcaggttggtacattgagctttcattcctctgatacatgctactgtgtgtgaacctaatttaagtttacaatgtttttcttaatttgaaaggtctgtaattaaaagaattagacaatagtgttttatactaaaaatatttttatagggagtttgccttgaaattcctagcatcttgcaatttatttttcatctcttttaggaaatgtcttaagcacataatcggatgttttgctgaaagatgctgaatccaaatttattgaaattggaaacactatgtatttatcctaagggcttatattaatgcatacaaaaccactttaaagagttttcaaataaaatactgaattaattatttcccaaaactccctagttatttcagtcaagcaattatttagcaacccatgtagtctaacttaattaaatgcatttacattatttgtgtagactatacaccttgtattatccattgattgtaaaagttgacattcactgtattagattctattttagcaaacaaacagatggtaggttatcaacaataaaagaaaaaagaagatggcctttacagacataaattccaaaagaggtaagaccaaaatagctcttaaacactgtaatgagagcaccactaacaccaccagatgtagaaataaacattctgagtcagtagaaggtgcgggaggtaggaagaaatagaacttgctattttcttcctctctgtcacagggaaattttttttcccatttgtcacctgcaatttgaacaaagtagtttcattaaggcataattgaaacaacttttcaagattctttcaggccttaaaatacattgccaataaaatagtgctcttctaaaatggtaataccacctgggtagccaggtgtccctttattttaaaaggaagtcaatcacatactcagatggttgatacttaggtgacgaagccatctccacagcaagaaaaatggtgtgaacaagagcaagggggagttgagaatcctgagcttacagccctgcgtcctgtgtccctctactgcaaatagagattataaaaaaataggttcatgtcttttaatcacgttttactaactgaaaaatatagtaaatatttgcaaagacacctgggctaataagggtaatattacttgtactagcgttaggtattgcctaattatatttaaaaaatcatacagaaatatatacagaaaaaagtaaaagtagtctttccttagacgtgaacacttaacttttgagtgttttcttcttcagacttatgttttctatgcattcatatagtctttttgtacatttactgatatattgcttttaacacttttgctttctgatttgcatctcatttttattctttgtattatataataataatagggtataaatctaccttgtagatgggaacttctgtatgctactccatagtataaacacaccttaatttatttaacaatattcttactaagaggcattagactgttttccctttggctttataaagtattaatgaagtgaatatattttatatgccacatggtgcattaatatgagcatattgtgaaagatttccaaggaatacgcttgcacggtgtgatactgcatctgtgtttgtaatttgcatggtcaatgtcaaactgacttccaggaatgagggctgtgtcgattatcccctccagggctcgtcactggatattatctctctttctagtttttgtcagtgtgacaggtaaacataatacctttttgttgttttaatttgcttttctgtgattttcatcagctttattaactcactaaaatagttgtattggtatctgaatttcttcttttaattgcctacttaatatttttccaatgtttctaactgatgtttttcttgaactagaagctccttatatattctgtagagtaatccattattttatgttgtttagtatttttctgtcacttttttaactttgtttaccatgcttttattaatacagaattttttttcttaatgtttatattcacaaagatgtagttaaatgtttttctttatgtcttcagggtttatttgttgtctttaagagcttcccaattaatgtattataaaaatgcacattttaatttacccactttgaataataattttatgttttcctcaaacccagatgacaattcttttgtaaatgtgtgatgtatttacataaattacattttctgcaataagatatgctaatttgccaatacattttatgagaagccgaacttctttttcctaactggttcaaactgtcacctgtaccatagtctaaactcacatttacataaaagtcttcttctggactacttgctttgtttcattaatctatgtgctgctttcagagccaatgtcacattgttcagattccaatgtctttttagcatatgttgatatctggaacggtgagtagcatacagttgttcttaccccttttttccccaaaaacagaaaaaaatctatttaaccaagggggcggggcaatgtctttttcgcaaaatgttggtttaaatgttgtaaagctttttgtcttttttttaggtacagattttcaagaaggatttcaacatctgttatgtatagatacctttggattttctctttgatttattttgtttaagttgtattttcctagagaataatgaattttaactagcttaccaaaagtcttcatataggcctgcgcactgtatcccatacatttgaaaaattatctctattttaacagtgaacagtttttatgttattagctctttctatatgtcttatcagatatgcccaaacttcatccatttatttcagaatttgaagaataagctttgatcttttacctatcaagtcttttgttttgctttttcaaatttattgaatttatatacatttttcattttttatttaattttctactaattcactgcttgtagattcttaaaaacacttagataatttactttcatattctctctttcactctttctctgcccatttcaggttatgtattttgctttaagagctgcttgggaggctgaggcaggagaatcacttgaacccgggaggcagaggttgcagtgagccgagatcgcaccatcgcattccagcctggggacaacagcgagaactcatctcaaaaaagaaaaaaaaaaaaaaaagctacattggcaatattgtgaatgaaataatattctatccacccattatcatttatctgcaaatatctgcaaagggattttaatgtgtttcattcttgatttaagtcaagttatctgaaagactgtgtgtgtgtgtgtgtgtgtgtgtctgaggaggaccgagggggaccaagtgtgtttgtgtgcacatgtataaaatcttctgacttttaattttatttcctcatgaacggacaacttgatctgtgccaatttgcttttgaatttttattaaggttctctgtgtgactttatatgttattgttcatgaatccttgccaaaaatgcacattttcaaggaaggacactttgaaacataaggccaggaatcaaatggctgaggttcagggctcagcttccacttttctgatctactgccttcggcaagtaacttcacttctcttgacctgagttttttcattgataagaatatctgttttgtttctgtacattaaacatgagtaaatatgtttcactctcaggaactggttattaaagagttttcactcaaaaatacatttgatttacattcgcttctgtacaaaaaataataactatttgtagaaggttcaataataacaaaaaactaagctaaccatgtacaactaagacaacctgaatcacgttcagagatgaacaatttctgactcaggtgtgttacgattatgaaaatggtaagtccgtatgacttagttgtctttgtttctctccaatatttcagtttctggagtaatgtaagtgtaacagcatgtttagctcagtatgatgcaccaaacacatccctctttttcccatgcaaagcctgagtaaatttcattttctgtgatatcaacattgttattctgctttatcattggcatttgtctagtacatgttttctttcttaattcacagtctttttatacaaattttaaaagtcaaggagtgtttttactgataaagaaattttgctgattcaaaggtattgattatagttattcgggggcttctttttatgatatgactttcctactctgatgttgtggttggtctgatgaggctcctttttccaaattgctatccaccttcaccttccctgatttttttttttctcctcagtcttcaaacctacaaagcctctatttttctagtaattaaccaaagatattaaactttaccaaagtaaatttaaaatcaataagctgtacagctgctcctaaatcccctaaaatattgagaactttaccacgatattatttatcttcctttcacttgccttttgttacttcccctgttgtaaatacgttgaattttggttcagaattgttaccaattatttttttgacatcatccctccattttcagacctaattttcaatgtttaaattcttgccatcctcccctaaccattttctgattgagatatttgtaatgattctacaattctttgtagttcaatgtgtggtttgcactatttagaggccttcctctgtctgaaaatttttttctgccttctgaaatcaatgctacttttagtagcataaatatttttttaaacatttgaaagattgtttcctttgtctttcatattcagcatggcttttgtgaagtgtcttgtcagtctggttctttcaactttgcaggtcaccttgatccagtccgtctctatatgcttttccctagcatatcgctaattatgggtctctttacattcatgcttttcaatatttaattcacactttaatctgcatatttgagcttaacacagggagcattgcttttgcattttcaaaattatttactcgcttcgattatttactgatgttttctcaattcttttgttatggagcatctaccaggaaaatgttgaaactctcaaactgaaactctgtctctaaaatttttatcttatgttgtcactctctctgctctttgcttcatgtcttcagatacttccttcacctaaccttacacatactgatttaatatttaaccatgttcataaattatccattctgagtcccagtggaaaaacagaaaccactgcaagtatttaaatattggaaattttttccgggggaaggattgcatacgtgctggaagatccaagacttcaagcttgtgatgatggtgaggagtcctccgattctaagcaagattgaaggaataagggaaggaggtagtttcagggctccagcggggtagggcggggggaagtgcagggctatccagtgagagccggagccacggagggttgcagcagctgccgggaacactgtccaaggcaggaaaaagtaacagtatcttgggctcctttattcttcctacccgcctgtctccctgggcaaacccaaggaagggctctccatttacatttctttcatttttgtgatgtgtctcgttttttacactgacttctcttttcccatgacagttttatcaatgttttaaaactcaggagtaaaatcatgaccggcctttcctgagtgcctacaatttcaggcttgactttgggtattttatttaaatgaatttatgagcaaggcaggtgcacgttattatctcccgagtgcagaagaggaagctgtgcaatgtcaggggaggtagaataaaactcacaacacgtctgttttgtttctactgtgtcaaaatcctttcatcgtatcaaccaaaaatttaagtgttcatttaggtaagaaaaaaacggaaaaaataaaatagagttttaccaagtatgccaatatatattgtttctataggccatgggcgagtggggtaccaattcaatccattcaacaggaaaaaagttacaacaaatatgacttaccaagaaaacaagtgactcttttccacttgctgatgggaatatctttaaggagtggtttgggttgctgtagaccctggctataacctctcatatcctattcggtgacaaaattaaactatgtgctagtgtttaatagattgcaatttgttactccgttttataaattcttagtgaccaatacaattcaaaactcattatttgtcattacgttaatgtccaataatatgatattatttatacagtatcttaagccagcacaacttttttttacatattacttaaatacattctatctgcgtattgaagaataaattctactcatcaactgttactgcattatgttattttaagaattcaagttatatgccagtagatgatacagaagagacagagacttaaataagtttttgtataatgctaagaagagaaaggcaatctagattttgtagtctctacattacatcgtaaaccagagcaaggcgtggctttgttaagtggggacattagattctaaacataagtctaatttttataatatgcttagttttaaattatcccgggctactttcttttagctctgtactggaaaaacagacttcagtttataaaacaagaaaattaaagaaaatttggttttattagttggaaatatttagaaatggattattggttaaatgaagcaaacgaataagtaaataaatattgcccatatatatgtgtatatcctctgccttctgatatttgagggaggaatgcccagcgtgcattgctatattgcaaatggaatgattaaaacgcacacatgaacggagagcatcggggtgcttagatgacttgcccgttttaggccaaaaataaaatgttcattttgtatttttccaagacacctgtcatctttgacagggtccattagatttataattatttgttgcaatttctgtgtcacacctgccatttttttgcagtcaagtactagcaattcaggccacacagtgactgggtgatggtcacagaaggaccgcatgggtgtagaaagtgtaagtgagagccgaccaaaatccaaatgcttgcctgctcactcccattacagaaggacaataaaacaggtctttatgcctctgttcttttaaatccaagggtgagcatggctcacaaatcatatcctagttctttgaatggctaataacgacagtgtctggaatgaaattttttttatgaaaaatttttatgaaaattgtcaaattatacagacaggaaagactgagaaaaacgaaatggaatagattttattatatagtccttgaaaacctctctgactttcatgtaaatttagttcatcgttggaagcggggggaagtgaaatgaaaactgcataataaatatttatattttctattaatcaaaagttgtggcaggacagaaatgacagtgtggtttatttgtctaagttttaacataacagctagatacattatttatcgtttaataagattagatttagagataatgaattttattctgagattacagttataaaattatttttaatattacggtaatgatatctacttaaaaatagaaaagtgagagttttatgctaaacacaatcgactcctttggggacagcttgatcatttaaaatgtagccctatcctgtgatttaagtgtgatctgttacataaatctgaaatggtaatttggttatacacgtatcaataggcaaattgagctaaaacctttctctcaactgcatttatatgtgtgggtatatgtcctatcggaagaaacatcatttgaagcaaatacttcagagaagttttggttgaaattgtaaggtattgccatccatgcattataagcaaaacataacattattgataacataaattcttacctttaaaattgaagtggcatacactaacaaaaagtgagccactcaaaataaagatgaaatatactgaggaattatttggaaggatataaacatacttctcccaggaagtattttaggtaattgagaattaaatgtagatacgcatgtccatagtcaattaaagagaagaaatcccaatatgttagatctcattgtctcacaaaataagaagcaaatgagcgtatctatatcactctttcttgtcatggtgatctggacactgaaagtcaatattttttcttctagaagttacctgtggttacataacatatagggttttgtctgtagttttgcaaaaatataagatgaccatgtcttgaacaactctcattaaaatgtgtatagttaaaaatttctaatcatatctcactggacctttttcttgtgggaaaagaaaaagctagaatgcactataacttcatcttccaagaggatacaagcacagaatatagagggcctcacacagtgtaacaaataagcaggtcttgcagatagctttttctctggtgtcagacatacctggggacaagcctttcagctgctctgtccctagagtttacccatcaccagagtcttgttcacagtaggcctttaagaaatagttgttaaataaatgggtcttatttttagtctaagtaggatgtctgttgctttaatctattctcttctctcttcctcaaaatacgacgtttttgcatttcctcctccatctctggtagttccttctgcttccactgcagactcaccttccaccttcccatgcctggcttttgtgtcttcttcacactctagttttcttaaagacatacctcaccacattcaagtcccaaagtgacaggggtatgaagacacgggttgggtgcctctatctccaacctcccttcgagcttcacctgccagtgtcaccttctttcgcactttgaatcagtatatgcaactcatccacctcctatgtccttaggctccatgaatagctacaccatttgtcaactttcatggcagaaatgttggagcaacccttgacgaacctccttccgcacgcctctgcaccatatctatcaccaatttctggagatgcagcctcctaaataacattcagtttatccagtcctcctacccttccccttcaccctggcccaggctgtcatcacttctggtctgccagtctctgatttctacacaatccagatgctgatgtgcatgcttctcccagtgccacctttctggcctcttctgatttccagcatctctggttccagattcgtgcccctaggctgttcatccagctcctgtactcgccctactctctgctgtccaaggagatttgcaaatgttgctgggggcttagaaaatctgcttctctcttccactcacggagttaacttatcctttcattttcagctcagaatcacattctctcaacagaattcactgacttttctatctaggccaaactatgacacatgaattctcacggctctaatttctgtccttatgtaatgcacacttccttcagtcgagcacagtcaccgtaagggcaggtgcaccactagttacttctctcccttgcatcctaagtgcccagcacagtgcggccacatggcaagtcttaataaatatatttgaatgaattaatgattcaccatactatttgaaagtaaagaatgccgatgttcaacaaattaaactattgtcaaaaggagattacacagagttgaagcaattcaacttattattttgggcaacagtataccctcgtcagtattacacagcaattgcatgttcaaagtgtcatctgggctaagaaagattttcttaaaccaaaagttagtatagatcaacctcttttattttgtagaaacaactatatttcagacgcttcctcaaaagttgtctttttaacctctagaaaacaaaactacattgttaagtttgtgataattttttattccgcttgtgtcatctgaacacaaaatttcaggtataatggtattagaagtgtagttatctatagaagactattgcagttaggatttctacacttgaaagcagctcattgcttcttccattattcaagttttcatagaatttaatacatagttgagaattatttcaaaacaaagctacatcaattatgtttttccatctttgtgagcttaaaattacctctgtaagaattcatatgatctccccaccaaaaaagtgaaagaaaatgtcagatgtttctttacgtttccggacacttctattagcctttgtccccatacttcatttttaatttaaaactagaaagtttgcaaggctctttgtagctttaaaaaatccaactggcagtatgcatactagcatattagcatagagcatagaggatgctgaatcatattagcatagaggacggtaagtaaatgatagggagaggtgccttccttggagggaggcacaattgtgattacatattctcaaagaaataagataaatctgagtgagtagcatcatgatgatgacatatatatacacttcccaccagccaaaaggacacttccatttaccctaaatacgttaaaaagattgtcagtcagatattgatcttcacaaccagaggtcaaataccaaagacataatgtcaacctcaaacatcatttaagaggctgtaaggaaatgcagctatgatgcaaacatactgtggctttggctatatggacttacattaaagaatatatatgtgtatatttgttgattttcatcttttcttccaaataactatatatcaatgaagtttgttaaaaagaaaaatgcctgtcaacccagctttttgggagaacaagatggaaggatcacttgaagccaagagtttgaaactcacctgggcaacttagcaagactccatccattaaaaagacaaaacatctcgctctatctattaaaaaaaaaaaaaaatcctggcatgatggcacacgcctctagtcccagccactcaggagactgaggcagaaggattgattgagcccaggagttgaagactgcagtgacccatgattgtgccacttagcaacagaacaagaacccatctctaaagaggagaaaaaaaaaaaagaaaggaaactactctataatcttttcaggaataaatgaaaaatataatgtagtttgcaaagcaaatgtcaactttacatcaaattttacatgaaacattcaagacattttcttcttagaattagaaaatattatgctgtggctaataacatcctttgaccattgtaatattttgattatctatttaactctttataacttttatggcatatactttaatcatttacttttgaataggtgatatacgcacatgatacaaaattctacatatatcaaaatatataaatggaaaatgtgtctccctctggcctctgtagcttatctgcccaggcagtaaacacagttaccaggttcatgtgtatccttttcacaaaatatacatacatacacatatttttatttttatcatttatgttttttctatacatacatatgtactgcatgtatatttttacacaagcaatatgcaacctaaacttatttagcacatttcattttatatataataataaactttgaatactaaactaaataataataaataaatgataaataatattaataataaataaataaataaataaataaataataaactaaataataaactttgaatactgtcatgtattagatatacgcagccatacactgttccactgatatgaacttacctttgctctatctttgtactcttatttaatcttgaacagtttgtaatgcaatcttcccacaggaacatttgttatttagttttaaaacagtgcttctctctgaccaaccctgcacttacagccagacttagtgtgtcatcttcattccctggagtgaattacagctgacctttctgatttccatttagcaattgctttatggataaaattaccatctttgataagtagctcttaaatatacccctgtggttttaattcaggaagcttcatgtctttaaaacgaagtccaagcagttgagtgactttttttacccttgagaatgataccgtgctaaggcatacaccaattgtacaaatgtatatcgttaatgttttatgagctatgttgtttaaaactgcaaaaaatactgaaacaggagatatatttagcagcatgtggtctctctggtggcaatttaaaatacctgtaaatgtcaacttgttacatgataaaacattatgaagtaaacttggattagaaactcctttctttgaagcaagttattcaggactaaatgtttataccaaaggttgtaataaggtcccacaactctaaagagcaacacagatgaagcagtcagagctccacaatggaaaggtgagaggagaaggacctggagtcttcttagcagcaggacctactgttagcctggctcttcaaactcaaatggccaagaagtacttcccatcccttgatttaaccacatcagctgcatggatgccttcaacgccgataatgcatttattgacattgaagactatatttccttgagcctattacggaatttgctattataatttaaataaatcttctcataaagtgtaaaatcatatggcttcattttgtatttatttcttttattttaatactttttttggaggactggcattagtgtaagatttgagaaaggacttaccatggaaaagaaccaggataggataggctcgaattccaatgtatgttagaatcatttctggagtcagaggaagtcagggcaggtgttctaccttcttcaaatctctgaactctggtcataacatgatgaccaaccatcacctaaaattaggcatcatagaaagctccaattcctcattattccttaactgtggattttaggaacaatgaaagtacagtaaatgtatttcccattaaaaaatcaataatttattacatctatgagtatttatgcctacagcatgcaagaaggttgggttttaaatttctctttcacagtagtcaggcaaagaacaaacaacttatatctcacaaataaaactagctatttgaagaggtaagagacatgttcaaagtcaaacagctggtagggctcaatcgtcctgactcagagcctactaccctttccaggtcctacactgccctctctgtggacacatggagccacagaatatcattaaacacatatagtgaatatcattaagcacatatatgagtgagccagggagcgcccaaccatccaagtcaaccagaagttcaagagtgttgtgagcctgtccttgttaagtactggggaaaactaaaatggaagaaagtaacacaggtaaatgtgatcttaaagcaaaattaaaaaaacaaaaacacctttaatatgtaaaaacttcagcagttattttggacagttataataacatgaaacagaaagtctggcatgaagatccctatcagcaatgatctgtaaattactacctttcgggactgtattcatttattttccaatgaaaaagagcctgcaagcacttctgtagaatactgtccagggcctctttgggacaagggaccatgccgccgcttcaaccaacatagtacaatttgcaaaggtattactcactctaaggtagtgtgacagtagaaattaaaaatagctgggaccttctgaagctctcaaacatttctctgccagcataggatcgttccctgtggtgtatttttagtgctctatatactcaacttttaaatgtcataaggaatgaaatcctgggagtactattcgaacacatctctgaaaaaaaaagttatatttgatatctcatctgtgattttcatacaggcattatctctcctccaagtaacacattaaccagctattttcagtcatttgctgaagtttagggtgcccagagtctaatggataactcgctgtgtcaagtaatatcataaaggctaccatttcttctcattagactcttagatagatttataaaatatatatatttacacagtgtatatttatagatttataaaatacatatacatgtacacatagtaaaagactctcactttctgctttaggcattctaaaacaggacacacattatttccatctattccctatcatcactaactctctaaagaaaaagaaatcggtcagacacagtggctcacatctgtaatcccagcactttgggaggccaaggtgggcccatcacgaggtcatgagatcgaggccatcctggctaacacggtgaaaccccgtctctactaaaactacaaaaaaattagccgggcgtggtggcgggcgcctgtagtcccagctcctcgggaggctgaggcaggagaatggcgtgaaaccgggaggcggagcttgcagtgagccgagattgtgccactgcactccagcctgggccacagagcgagactccatctcaaaaaaaaaaaaaaagaaaaaaagaaaaagtaaaaaagaaatcttactatccttaaaattattattctcacatctaattgcctttctcagagccactctttcctttcaccagtcccagtttcccaaacccccattcattcttcctgccttcaaatactttcggcaacaccacttttggcaggaagtctgatccgataaattaaaatagaaagcatattaaaaaatatactgtaagaaactttcagaccctctcacctctggagctgaccaataatcaaattatccttgtatgatatatggtaggtttctagatgctacctgcactcttcgcttcaaaggaagtttcctgtgagaacccttgagtctagaaaatcaccctttcactagcagaagaaactatttgctgtctaaattctgaagatgacacttcctgaactcttttccaagtaaatattaacaaaacaaatacattattcagttaacactctttatatgctttattaagtattattttcctttaaaacacattcttgcatacaacttatgttattgtgggtagaacactgagttgtcaaagggatgaatagaggtggtctggccccagcaacttaaaggaccaaggactgtgttcattaagttttttgtagcaaaggaatacatcctcttacatgatttcacacactttgtttttcagtttttattctaaatattttaaataagtttgtcttttcaaggtagctattacattttgagttgcttttttttcccccactttgtcgaccaggttgaagtgcagtggcacaatctcagctgtgcaacctccaactccggggttcaagcaattctcctgcctcagtctcccgagtagctgggactacaggcgcatgccaccatgtccagctaatttttgtattttttttagtagagacggggtttcaccatgctggccaggttggtctccaactcttgacctcgtgatctgcctgcctcggcctcccatagtgctgagattacaggcgtgagccgctgcccccggccttgagtttcttttttcaaagtacctttagtttcacaatgtgagtaaatgtggaaactgactatattagtaggtattttcctattagtctttcctaaatgacttgcctactaaatatagcacaattgtacttattcaagacttaattcatctatatgtcttaaagtgccatcataatgtttgcattcaacataacagtgagagaatgttctattttctgtttggtatgtaacaagccacagttaagataattgctgctttctgtgtgtgcaagagttagggaataatgatgaaatattcttacttaaatcactttccctgtccttctattttttccacaacttttactctctttgaaatcttcctagtgaaaagctacttctctacttttaagaataaattattctccattttgtgatgtaccttctgcattgatttctactataaaagccaaaagaactctctcgctattaaccttcagacaaaacggcaaaaagcttgggctcctaaatgagaaggtcccttgttaaaatccctcaagtatgaattactgcaaataggacattgggcaaaatacataaatatcctaaacctcagcatctgtacctttaaaataaatataaaaatcctaaactcataacatcttactagaattaaatggaaaaaaaatttaaattatttttggtttgtgtttctttttgttgttgttttattggttttttgagacaggttttcactctgttacccaagctgaagtgcagtggcaaaaacatggctcactgcagcctcaattttccaggctctaatgatcctcctagtcaactactagagtagctgggaccacaggcacatgccactatccccggcaattttttttttttttcattttttgtagagatggggtcttgctttgtttcccaggctgctccgaaacccctgggctcaagcaatcctctttcctcagcctcgcaaagtgctgggattacagacaatagccatctcactttggccattgtttattaattatatcctgcagccataacaaaaaattgtgtttctttttgtgagttaaaatcatttgatagaaaataaaagtaaggttatgactcagatataggcatagatattctaatacaccatctgggaattattacttttaaaataattacttttcttctgtggaatgtacaatagttttccattaatttaaggtggttttctttctccatggaagtcgtctatgtccttcacttttgcagtataattttgctgggtacagaattctaggtagttgtatttttcctttcaaaactttaaatattttgctccattctcttcttgtttgcagtttctgataagaaatttgctgcagtgtttatacttgctattctgtagggtaaagtattccttcctgaattctttcaaggtttcctttatctctggttttgtgcagtatgcatatgatataggtaggtgtagataatttgggatttataattcttgatgttctctgaccttcttggttctgtagtttagtgtctatcattaattttggaaagctcccagtatattcctcaaatctatctttctctgctctccttttcttcttttagtattccaatgaattttacggtgtaccttttgaaaccattccatagttcttggatgttctcttctgttttttttctttgttttgtgtttcttttttctcttttcatttcaatgtagagagtttttattcaacagcagtcaagctccgagtcttttctaggctatattcagtctagcaatgagtccaccagactcttttctaggctgtattcagtctagcaatgagtccatcagaggtattcttcatttctgtcaccatgttattttctagtaattcattttgatgcttagagttttcatgtttctgcttgcatagcttatctgctcttacatgttgtctacttttcccattagcactctaagcatactaatcatactcacttaaaatatctgataaatcataattgttctaaattccctgactggcaatgtcaacatatctctcaaatctcagtcattccactgcattgcctcttccgaacgtgttttccttgcctttagcatgccccgtgctttttctcgttttctttttggtaaaaggctgacatgtattggttaataaaaaatgtgataagcaggactttagcatgaagatttgtgttaatcggactaggagttggattatgtttaatgcttgctgtaggtgtaggtgtcagaggatttgattttcttctcagagaggactgtccctggcagggccttctgctgtaatccactcttataatgcaggaggcctgttgctgtggtagtgagggatggtagagtgttttataaccttcctactagctgtgagtcttttagtgatcctgtgtttcagggctatgacttttctgagaattttcccagcaaaatacctccttttacctccttgccttctactacttttccagttatagaaatcccattttatttccttgaagccatgacacccactaagtatgaattttccactagcaagacaggaaggctaaaggggtctgtctgacatggaagtaacacccttccctgataaccttctagcagagatttttccctaaagagaaagccttcctgatgtagaaggatctaggatacttcacaatgtccatttttccttgacctgccagaggtaagaagggatattcctggaattttcaccgtgagcacttcatggggttcctagaagtaaaggcaatgagtgtaggggcctcctaagactgcacacccccggattttctccttctcacaccactgcttccagcagctcatgaaagtgaccatttaagtgatctcacctgtatatagctcctatagtctctgatccatgtacatttgttttggttgtgactctgtggacccacctgtccttcatttccaggtggcaatttaactgcaacctcagttctctgatgggttcagagaagtcattgatttggggtttgcccagctttttcttcttatgaggatgggagtgagccctttacacgactagctgaaactgaagtcttgtggatgattttactatattatttatcttttctaaactttatcaatgattgaaatgtttcagcatatatgaataaccaatagcatgtcagattcttaactcccactttctgtaactcacaaaaccagactttacttaggactgaatcttaattattgtctaaatttttatatcagttttaatgttataatgttgcagaacatatatttcaaattgtgtttcattatacacatacacacacttgttatactggactaaattattattcatcttgggaaatgtgactatttacacttccattgtattatctcatcacagtgaacagtcaacgcatatatcttgatttatacaactttataagctttttctgtcaatgttgatgatgtatcttagtcaattttggctgctataaaaaatactataaactggattgcttataaacaatagaaatttatttttcacattctggaggctgagaagtccaggatcaagttattagcgggtttgtcctctgatgcagggtcttgcctggtttctagaaggcaccttcccgctgtgttttcccatggtaaaaacgacaaggaatctctgaagcttttttatagacgctaattccattcatgaaagctccctcctcataacctaatcacttcccaaagtctgctcctccaaatattaccattttggggattagattttaacatattaattttgaagggggcacaaacattcagtcatagaaatgtgttttaagatattctttgtaagtgttaaaaaataataaagcacataattatatattgtctcaccccaacaaggaccttataaggtgggaaaatatagtcatccaattgataaatgtcattagatagtcatcaaactgatatggtttggctgtgtccccacccaaatctcatcttgaattcccatgtgttgtgaaagggacccagtgggaggtaattgaatcatggggtcaggtctctcccatgctgttctcacctagtgaataagcctcaggagacctgatggttccataagggggaatttccctacaaaaactctctctttgcctgctgccatccatgtaagatgtgacttgctcctccttgccttccaccacgattgtgaggcctccccagccatgtggaactgtaagtccattaaacctctttcttttgtaaattctccagtcttgggtatgtctttatcagcagtgtgaaaatggactaataccaatgcacattaaagattttggcttttcctcaaattctgtctgctccatcagtttcaaatgacctttgtccaccagtcgtaatttctgcctatacatactggataaagtgtttcatcaggtgctgagagaataacttaaccaatatgcagatgaaagacaattatttttgaaaatcactggggaaaagtctgttggtctttctctagatttgttaggtaattcccttgacctctgacacagcatatttttccaggtcccatgaatacacttttccataggatgtgattaaggtgtgggtctatacctcaatgtcattaacattccttaataattttccttaatcccaagtcagggccaaactttactgctaatacctgccctctacctgcatccagggatctcagagctctcctgacagaagcgtttaacttcctgtgaggaaatgttcatataatttacacactaaataactacttcgaagtctgcataaatagactgaaataagtttttataaccacccagaaactgaatcaactctagcaagggactggtaaatcacgttggtttcttcttgggcttccaacatagaagccgccagatcaatcacttctagattggagttgctcattaaacttcacggtgttttctcatttctctccaaataaatttgacaattcctctctgaggcttctgagaagctcatcagaaaaattactagacaggtattttgtggcaacatattttagcttgtactattttaagccccacccagaaagttcagtttaataatttctccacaagaagtacgtactcttttggtctttcttctgtaacctttattaaaggaaaaaaagaagaaaaagaaaaagaaaaaacctaaatcccagttctttccaatttcagatcctgtacttttctagtgctcaacatagcttcaaaaaaaaaaaaaaaaaaagaaagaaagaaaagaaaagaacggaaaagaaaaagacaatgcataaaattagaaaagtcctcttactgagctaggtggagacctgcttccagagctaccactgaaattattggcaagaacatgcgaaggcagtagattgtactaaaatgacgtggacagaaacagaatctaataaaagaagagggaagaatttcttacattaagaaatcattttctgcttttttttttttttttcttttcacaggaaaacttgctgtggggttgtctagatcaatgccattgcagaaaggctggacaaggattgaaggtgaaaacgggaggagagcatttctagaaaactctttccatacaaagtgccagaggcttcatgccagatgccccataagctcgtctcaatcccacctttagtgacttcactggggtagtctgaaatgaacactctcaaaagcctgccttcctattttagctcaagtttgtttggcttcctttgtaaatacctgtgacatgtaggtcaggaaccaaagagtttagcactttcatttatttctgtttttggtctaagggaaacagaataaccaccagtgactttctattagtttgaaattttggaggccaaatgacataaaatgacatacagcaccagctattttttttggagggggggcacagagtcttgctctgtctcctagactagagtgcagtggtgcaaccttggcttactacaacctccacctcctgggttcaagtaattctactgcctcagcttcccaagtagctgggactacaggcacccaccacctcacccagctaatttgttttgtatttttagtagagatggggttttaccgtgttggccaggatagtctcgaactcctgacctcaagtgatccacctgcctcggcctcccaaactgctgggattacaggggtgagcccccacaagtggccagcaccagctgctttaaaaaaaatcgtgagggatcacagatcaaagcagagtccaccactcagaacaggcacaggacagtgggtcttgcaaagattaggttggtgcaaacctagtagcgttgctgttaggtacatcccaaactccgtcacgcaacacaagttgtttctcttctttcctgccacaggtttgtggattctattgctatcctcatttggtgttataattacttgcaataattgtttacagcctcacctctgtcccttaaaatgtttctggcgggggaccattgctttttcttgattgttttcctaattcctagtaaagtgcttggacactcagtgaatatttcttcactgaatgctattaatggccattgtccatcagcatcaaatagagaatgaaaactacccccatatgtcttattttaaacagaagccctgccctcaaagagctctacaggggaacgccaccaacatatgcgtccacagctcatttaataatgctcccatccatatgttttgcagtaggtgttgctggaccaagactgagttctgcgtcaaccagatgtactgtgcagattagaattccatcttcatgcttttcctgactacaattaatcttaggaagaaccattgacaaatctgcaagcgagggagttgtccatgtgttaccagaattagggagtcactgccaaattgcacgccaaccttcccaccagactctttggggcttcataaccagaagagcttctccagccagcagctgttaagggatattattgtttggatggaacccgattactgtgcatccttcttaattaatgcgattaccaaaggaatgtatacaaaatagggctctaattaattgtagccaattaagattttaaactataaattctgtgattatttcacatataaggtgtgatgctgcagtttcttaaagacatttcctgaagaaacaaatcttagtacgatacctaaattactcagagaggaagattttacatttatggatgattgatttgtgttgagctccctacacagtttctttctgaaaagtgcatataaagttaaagaaacaaaagcacggagtcatgagactctatagtattacaggtgcaatcatttctgttacaaagctatggaattatgcaagtgagtgtgcagaggaaatagaaacatttcactttaaaaattggaagatagggccgggtgcggtggctcacacctgtaatcccaacactttgggagactgaggcaggcagatcacgaggtcaggagatcgagaccatcctggctaacacggtgaaactccgtctccactaaaaaatacaaaaaaattaaccgggtgaggtggcgggcccctgtagtcccagctactcgggaggctgaggcaggagaatggcgtgaacctgggatgcggagtttgcagtgagctgagatcgcgccactgcactccagcctgggagacagcgagactccatctcccaaaaagaaaaaaaaaaaaaaaaaaaatagaagatagaaatataacggtcgcctttaacttctgcaagttttgtagcagatcctctgtttggacactaatccgtgaaaatgaactcggaaaaggaaattagtaataaacatgagacgttttcacacttaagaggctaatgtgttttctcagtttacgtcactacctgcatgagttcccatgtaaccacaatgtaagacaaagctgtggcagaggcctgtggacatcagggagtttcacctactgctatttcaccttcacctcctgaactcacaagaaagacatggggtattcccaagtcacagaaaacaggaacagaacatttatccaaagaaaatgatgatgatgatgaaacgcattccgtttcatgtgaaattaccaggcaatagctaccgtatttaattcaattcatattagatatgagaaactgcacgtgtggagggaatagaaattgaattaaatacactcggtttctcagatgtaatatggtcaggccgagtcaagtgttaccaactgtggttgccgaacgaagaaaatggaatacgcatgcttatgattatatatataagagaaatgcatatatacacatacatatacctgtgtatttatacataacatatatataaaatatgtataacaagaaaaatctaacacaaatactccaattcataggcataacacccctcccaaaagcagactttcccgtgtggatttattgcaatggtaaaaagctaactcttgctaaagtagattacatatagtctgacaatcgtagattctgatccgtattttagataagaaattgtttacactgtgttgtcgagtatagattggaaaccacatatctgcgtacaatcttcctttcctcagaaccaacatatatttatttttcttgggtttccatacaaaaagcaggcctggcaggagcacggctctgaggtgtcatggacctgcgtctgcagtagagggcaggagcagggacagctgggggactgttgcatccgattgaactctgggctagcagttcccaaccttcacacccagacctcggacgagggaacgttagcgcccggcggcagtggatttcgggagagggtcacgccctaaacattatgtccgggtttggagacagacatccatttggattttcctggcggggattcaaacttttagcagagacacttgatgcatagaatacttggcatcttggccacacggagacccatctgtcacaatggcatcctgcctatttcaaagttgcttagatcttttcagcaagccataagtgccaggcaggagtggctcttcatggggagtgggtataaaactgcaagtggcatctcttccacaggaacatcttctcttccgctagttcccatccctggtccagcttgcaagagctacacctgttgcccctcgttcatagaatacactagatttgccctggaaaggcaacgccagcacttcagattacgttcatatgccagaaagacaggtggtgcttcagcaggagtctgatgaagtcaggaagataactcagggcataaaaatgtttttataaaagaaagtagagtcctctccatgggagcattgtgaggcagctccgtagatgaccacaattataaaactaaatagaatttcggcacactacgatgacaagaacacggggtaatatcacatcaagaacttgctcttcacatcagcagatattgttgacaatgtttatgggcaacttttaaatatggcaaaaccctttgaaaaaagtattctggttatagattcagagtacattggaacacatatgcacatataaatatggctttcatttacatgaaatcaattgtttgtcagggaagatggttttgttcaacttgcaatgtatgttttctttcttcctcatggaaatatgaaagctaaatgcagttgtttagaatgagaaaatgcacgtggcactcaaatactgccctgctcaataaatgtaagttgaaaatatcagatcatcctacttggggaaactctgtagtaataacctccaataaaaatactttacacaaagagtctaggcatttttttacagctgattttatttaatgaattgtaaggcaccataactattgtgatatcgcaaagaataaataggtatcaaggttcatattttaacaaagtgacagctagatgctaacgtaggctttactatattaaaagtagataatgcattcaacagaatccctgagaatattttacttttgcaagaaatgacagaaaggaatcctttgtcagcattacagtttttgactggtgatggataccaacattcatgtcaacagggtgtgagacatgtcattaggcatccgcaggtgtacagggttcagtaggtgtattagctcattcttaccttgctataaataaccacctgagactgggtaatttttgaagaagagagatttaattggctcaggttcggtagactatctataggaagcacggctgtggaggcctcagtaaacttacagtcatggtggaagggaaagggaaagttggcatgtcctacttggctggagcaggaggaagacagagagaagtgggaggtgctacacactttaaaataagcagatctcctgtgaactctatcatgagacagcagtagggggatggttctaaaccattaaaaaccacccccacgatccaatcacctccaatcaggccccaccttcaacactgggcattacaattcaacatgagatttggggcagggtgcggcggctcacgcctgtaaccccagcactttgggaggccaaggtgggcagactacaaggtcaggagatcgagaccaccctggctaacacggtgaaactccatctctactaaaaatacaaaaaattagccgggcatggtggcgggtgcctgtactcccagctactcgggaagctgaagcaggagaatcgcttgaacccaggaagcggaggttgcagtgagccgagatcatgccactgcactccagcctgggcgacagagcgagactccgtctcaaaataaataaataaatgaaataaaataaaaaataaaataagagatttggatgggggcatagagacaaaccgtatcagtgggaaccctagaatgtgactatccacaaaacaaggatgccaagttcacaatacctaataataaaagccataatgtgaaaagtgttgcaagataggaacagagtgtggcagtggttcagatggaggaggagatttccaaagactgtaacatttgagatgggcctggaaggctaggtacgattcaaaacaggtcactgctcttaaggcatttacaatcagaagttgatacagaaaatatgctaaggtctatttagtagagtgagtattgttactgtctgtgataacaaagctgaaatgacagaaaaatcacttgtaaaataatactagactttgtgatgtttaaagtcttatttctctgattatgagttagcaatacttttaaaaaaagaaaatatgtattctattacaaaactgccccctgaaaaattcttcctttgaatggaatcccgtgttggtgttggtgactcctgagttgaaatcattacgaaggggatgatgctgatcgagggatcaaggacatcactcaaggccccctccatgtgcgaagcatgtgagctttctgggacagacttatttttgtatttatgagcttcgaaaatcacaaagtgtattgccttctctctcttttctttttgctggaaatctcagagtgaaaggtgggtgttcctcccagattcagacctttctgccgattcttgcacaatatcctcctcttgtccttctgtatatccacctggacttcattacccattttctaactttctgcacaatgtgtatgtctgctccaatatttattagaaaaaggacagggatataaatgtgaaaaaaaaagccaatttccaatgtctagacaagcactgcgagttgtgctttaaaaagacacaaagctgaaaagtgatagctgaatcacgttacttcagattgataaatcttttctttcttgacccaatctcactatttcagtgaaataaacttattatttgactaatacatttttcgtaatttcaccaagaactttccagtaattaatttccacacatatatgcaggtatgtgcatatggaattttaaataatttatatataaacacacttgtgaatatgtatgtttgtacatatatgcagatatatattgttcatataatcaccacacacacacacccctacaacatgtaattttaaataagtgagttttaaaaaaagtagtaaaattctggggggtgtatgtatgtttggtttatatttttttcctttgctattacgattgagttgtttgggcacctaaaatacatgtaccaaaagataagccacttaggtgcagggacgaatgtaacagagccatggttttcagtgaggtagtagtttgttaaacagagaaaataatgattatgtaacatgtcatgccttacttctataaagttagaatggaaacatactcagttaaaatcactaaagtaaaattaaaatcctgtaaaactgaaacgtacttgaaattaaaacactttgtaatttagtcatagctacaattcagaaataatctcttgcccaaagggaaaaagaagagttctgtcaattagagtatatttagaaccacgggttagatgtaaatgttaaattcttccttactatgaaactttgctggtacttaaaatttagcataaacaaataatctaataaattttattcattagaaatatgaccaaaatttccaatataataacaaaaattaagggggatttaatgtatattttctattagccattccctggctatttgaagcatgttatcggtcattttgatagaaggcagaagtttgcattagttccagatctttcataaaatgttgacataaaataaaatgattcaatacccagtactcagtacactaaatgtagtaacaatttgtaccataatatgaaaagttttaatatcgatactccagtacattgtactactaattaacataggaggtgtgaatctgtcccctctaaaatctgggtgttgccaatgtgatagtattggaagctgggcctagaataagtgattagcctgtgatggctgctcttttgtgattacagtaggtccccccattataaaagggcatgacccagagttcatccccttttgccctttcaccttctttcatgtgaagggagagcattccttccctccagagggtgcagcaacaaggtattctcttggaagcagagaacagccctcaacagacaccagacctgccaatgccttgatcttggacttcccagcctccagaaccatgagaaatacatttctgttctctatcagttagtcccaggtattttgctgcagtagcacaaaagagctaagacagtagaggaaaataaaatgaaaagacaaatagaagacaatgttgagatcaatcaaggtaggttatcatgaaaattcctaccttgtatatataatatttgtaatgttgagtcaatgccttttctaagagtcttatgctaatgaaccaaacaggacaggatcttcacccccaaatctactcagacttattctagaaagtattatacttatgactggctgaaatgagcgatccaaggcagttcaagataagtcaatttcttgagtctacacataggaaaattagaatattaataacaaagtatttagagagaaaatgcatatggaaatgctggcagtataaatctagggaattcactcatatcttgaaaatccgtttaatgacattagttttgaaaacaaaagtatatgtctgcagcaagatcatttttctcaggaatcaaggatttagttactggggacctgtcctcagaaattacaatggtgaggccaggcacagtggctcatgcctgtaatcccagcactttgggaggctgaggcaggtggatcacctgaagtcaggagtttgagaccagcctgacctacatggtgaaaccctgtatttagtaaataccaaaaaaatagccatgcgtgggtggtgcatgtctgcaatcccagctacttagaaggctaaggcaggagaatcacttgaacccaggaggcagaggttgcaccaagccaagattgtgccattgcggtccagcctgggcaacaagagcaaaactctgtcaaagaaaagaaaaagagaacgaaagaaaagaaaagaaaagaaaagaaaagaaaagaaaagaaaagaaaagaaaagaaaagaaaagaaaagaaaagaaaagaaaagaaagagagaaagaaagaaagaaagaaagaaagaaagaaagaaagaaagaaagaaacaaagaaagaaagaaaagaaagaaagaaagaaaagaaagaaaggaagaaagaaaggaaggaagaaagaaaagagaaagaaaagaaagagaaagaaaaagaaagaaagaaaaagaaaaaagaagaaagaaagaaagaaaagaaaagaaagtaaaagaaagaaagaaattatgatgattatgatggtgatttagggtcagaaacaggcaatttcaagtgacttgttagctccctctcacgttccattcagaaacctcttccaccagccagaggcaacatttattgtcagccaatctgagtgggggtgctaaacacatttcacatttaggatatactcaggaaaattcaaattccattataaattatgttttaatcttcctaagctatctcaaaaattatcattatttaatatgaaacatgtataatgtgaattaatgggagtttatatttttaagatcatgttaaagataagaatgtctttatactgtcccctgaaaacacagtattctctgtatgtaagtttgtgatgttggaatcactatatagttggtaaaatggcactttaaactgtgaacatagaaattcagatgcttattaacatacaatgcatattttccaaaataccttttattttactcagataatggaaggataaccaacaagtgtgaattacccacagaagtgatgggtgtgtgtgtgtcggtctctgtgtacaggaatgtgtatgcaatgtttactcaccctaagacaaaatgtgttccttgttgttctgagtaattattcttctccaccagccatttttttcttatatgttgttttcacagatcatggcgagaggactttataaaagttcaagggaacgttactcaatctgagagaaaacccaagagtgactgtattcactcagaattgaaccttccatgcaagaagccacctccagccttctgaacgtaccctcacatctgtttggaatacttgccctcttcactcagccaaatttgcttcagatccaatcctgcaatttccttcctatgaaaagcctttcaagaatcccccagcatggataaactgccctcttcacttgtacccagagcacctgagcttttgtaatcatgatccaggaagtcactctggtgagattacccattgccttgcaggtatctcccaccagagtaaattctagaaggggtgaagtactgcctgtgtgtgcgagtgtgtgcgtgcatgtctgtctgtgtttttttaatgtaccttcagttctaatggcagatgatacgtacactgaatgtgttgtttaaaggtataaataggcatcattgattcttgttacataacctatccctgtcccaccccatctcaaactagcacttctaattatgtatgcttatatatagcacaatattttacaaaatcctgttttacttgagaaaaattagaaattaaaggtcaaatgatatttagcaataagaacttctaataacttgatattatcacttttatgtattcttcctaccttaaaatttgactcgttttacattgctgggcaaaccattcacaccctttcagtttttaagtgcacatattacatttgttttctataaaagctattgatagcgctcatgagagaaggtatgcagataacaagaaacaacacatcttgtccacagttcacatggtgcagcctgggaaatttctgagagcccctgcagaccttcagatgacagaccagcccattatatgcattctgtgttctcacgcccctagattgccagaggtgtaaagaaggctactgaaggacaccaaagtcaccccaagaagtgtttccttctacacagggaaatgacttgaggaattcctttaccaagtttttcctagtgctaaagttttaactggcatcttctctaagcctcaaaagagtctctcactcccttaaatcttcttattcctagtcttggtgtatatgcatattacacactttccatcacagaaatactcacattaatgtgaacagtaacagtccctagcatccacctcagctagatggggtgctactactcaggcataactccaagaattttccaacttaggggaacaatcttaaaaaatgatttgaaataaagggatatcaattatactagcatggaattaggggaaatatttttaaaatatataataccatcaatttttcagttttagatgaccactgtcattttctttcaatagttacataatagtagacacaagtgtccattcattaaacagctgtcctttcttctacccttcacacttgactcactcatgcctcatcctcaaaggcaatgtgagttgatgctttcgtattggttaggagcatgaacagttaacttcttaaagggttggcatacattttaaaataaagagtgtaactggattgtttgatactcaaaggataaatgttggaggggatggatatacattctccatggtgtgcttatttcatattacatgcctgtgtcaaaacatcttatgtactttctctctaaatataaataaacacacatatatattcatatatatatatactatgtgcccacataacttaaaaataaatataaaatgaagcccttgtgataacctcattgagtttaaacatacacactacacttgtattctacattgcttcctgcactcacatgttctctcctggtatacctatccacggagagcactcagtgggactatcagtgcttgggagttagcatgattacagaaatttaccaaggaaccttggaaaggtcattctattatatatctccaagattcagtgtcccaatggtagaaatataataattccaataatgagttttcaataataaatgagataatgaagaagtaactggcccacaaactataggcagtatccaaactttatctgtataggtttctttggtttgggttctatggaggaaagaaagtagcttagcaagctattctcaaccttgcatctgaatcatcctttgatagtttaagaaagttttataatagaattcatttttgtcctctgtcacatctcagcttgcttgaagtctcaatcactgtaggcagaaaagtgatgaacaagacaagtttctgccgtcatgattctgacaatgtaaatcaagcatccaggctcacaaataaacatccagacactcgatgttgaatacagatttgacaatctctgctagaaaaaaatgtaggatccactttgagttatgatcatgtaagttttattttcatctatgtgaccatgataaagttgtaaacagttttgtatcattttactaagatattttcatcccagtatcctaattatgttcatgtaaaatgaattttcctctcaagaatttgaacgttttctgttctatttttattgaattaaaaaccatctatatgatattttcaataaaagatgtaatagtaaacataagtataaaacctacagccaggcacggtggctcacgcctgtaatctcagtactttgagaggctggggcgggtagatcacctgaggtcaggagttcgagaccagcctggccaacatggcaaaacccgtctctactaaaaatacaaaaattagcctggtgtggtggcccgtgcctgtaatcccagctactcaggaggctgagacaagagaattacttgaaactgggaggtggaggttgcagtgagccgagatcgcaccattgcactctagcctgggagacaagaatgaaactccatctcaaaaaaaaaaaaaaaaaaaaaaacctacaaaaaacttttataaacattttaaaatcactcaaactttttgacatatgtatcatattgttttcatttgtcatattaagattattacagttcgggaagaaaatatgtttctcaagtttccccaaccagcacaagacaaaactgggatttgaacccaaatcttgtctcttcaaatcccgtctctttttctgtattatgcaacggaagaatctttgcatccaccatggtgtctacattgcataaatacctccaataaatatttctggaatgaatgagcaagtgacttgaattactacataccttaaatagtttgggttgttatcaagcatatttgaatatattatgacagaatgaactagcattataagtctttctgaatgtttagtccctgagcagcagacacaaggaaggacaacatcactatggttaatcagagaataaaacatggtgaataccagttttatggtttttttttttttttttttttttttgcagtgtggcccacttttggttctgggaaggggctcaagagttcaacttgaaggttaatttccagacacaagtaggtggtctttgacggggtcatgtgttgtcacatgactcctgttgaaacctgacatttctttagcagttaaatacatggcattttgtaaaacaatctaaaatatacctttcctacagaacttactgttaatcatttcaaaatcaaccataaaatatttaaaactcagtaatttctagtcttgtgttccttattctgaaacgtgggtattctgtctggcattttcttttttttttcttttttctttttttttgagacggagtctcgctctgtctcccaggctggagtgcagtggtgcagtctcggctcactgcaagctctgcctcccgggttcacgccattctcctgcctcagcctcccaagtagctgggactacaggcgcccgccaccacgcagggctaatttttttgtatttttagtagagacggggtttcaccgtgttggtcaggatggtctcaaactcctgacctcgtgatccgccctcctcggcctcccaaagtgttgggattacaggcgtgagccctcgcgcctggcctctatctggcattttgtaattgtgaaatggcattctgtcatgctcagtatgcaaaacatatcttttatttccctggtcatttgatgcatttccagccagaggtttatatttttgttttcctattacagttttagcaatgcattctttccaggttatatttaatgactacaaaagtgagagctcataaaccaacctaaataaacaaacaaatacacattttaaaagtggacttattcttttgaattgtttttattaaaagaacatattttatcaatgccgatattcatgaggctgccatatcataaattgaaaggacagccaagcctatcaagtctgaaatattcaaattgcagggtaaagaaagaggctgctattacatttattttttcttgtggacacaatgaataaatggatgtatcacagagttaaacatgaattttttttggttctaacgaaaggaagaaataaaacacctataattttgtgtaataacctttgctctgaccccaccatgaactctttatctttacgatattttctgtatttgtgagatctacgcatgtggccgtgtaattctctcacacttaatactggcgcttgcatctactagaagctttggaatttcaaaacggtgtaatttttctatgtaaatgtataaatagcagttatcttatttgtttttaattaacctccttatttaggtacagatgtgatatagccttggggaaaaaccaactcaaataataaagaaaatatggaataaaaagcatgtatatagttccttaattcttgatttccttgcaaaaaaatatgaccagtattcttctgggcttttcttttttttcggtcagttaatacaaacaaactttacaggactttacaatctatactgtgacttacattttaaattcaccaatgctttcatgtcatctctctgtattgggatgcctactgctattttgtgtttgaatatctacctagaactcctccctaaatagtttgctatcaatgaactttaagctctttccagattttttatataatgagcaaaggtaactttgttttagttaatttttaaaccatttacttggacccaagtttaaaactaaaaagcattcagctagagcacatactattttcatttataaagattcaaagcagtagacatcccgtatctaaaagacatgcttcagcattccttttaatgaaaaaaatagggctgtgttatttgctttcaatgcattattattattattattattattattattattattaagatagacactcactctgttgcaccaggctggagtgcaatggcacaatctcagctcagggcaatctccacctcccacgttcaagtgctttttggctaatttttttttatttttagtagagacagggtttcaccatcttggctaggctggtctcgaactcccgtcctcaagcgatctgccagcctcagcttcccaaagtggtaggattacaggtatgagccaccacgcccggccaaatgcattatttaatctaatcttagtataaatccctgccaaactgccccagcaactgtcagtgaggcacagtgtgaaagtttaatgtaggactcaagaactgaggcttggggctcaagtctttgctttgtagcttagctctgcgatgccagtcctttttttccgagagcaagtgagttggaaaggggcaacaactagcatgtaagagttatgccttactaaatagttcttagaggttcttcatggcatcctaaactgacgaaagacaacaggcagggcatctacattggtataattactcaggtaagtggtgatgacactgtgaactagggctaagggagtagatatgtcagatgatacttatctgcaagttaacataaataggacttggcaaatgcatttgtccatttgctcagactgaaaccttggattccaacttggctcctctccttctcacactcaccagcaaatcctccaaactctgccttcaagatatacccagaattctaccaagattccccaaagatcccaccttgtcatgtccagcagctctaacagatgaaaatcattttctaagtgttttccacactacatctccagtgattctttcagacccaagtctgtgtaaagctcccgagtcacaccccacatcctcagcggcaaaagtagaaatccttccctgatacaggatgctcaccaggcctggctcctgtggcctctctgagctccattcttagccctcatcctcagcccactttgctattccaccccagcctctgcccacgtgggacgcacacatagactttcccgttgccattggcactgcctggagtgcccgtcaccaagaagctgaccagcatgtcttgctctcttgcttccactggatctcagctcaaaccccactcatcagaacaaactgtcctgacctcccatatgtgcacaatcccctttatttttctacggaatttttgccaccatccggtatcactgtctgtggttatttagttatttactatcttctctgactatgcaagagctggggctttccctgattgtctctgatacatcgataactactaacattgttccaagtgcaccataggggctcagagatatttatgaaataattatgtgagcctgagcaagttactggccctcctgaacttcagcttcttctctctgaaataacaattctaattccagtcttgcagatgtgcacgatcatttacgaaagaggctatccacaaacgcgctgagaagtaactggctcatagtaaggggctgacaggaattcattgttactcagggttttaattcagctgaattgtgccaccctagaattcatacactgaaataataatccccagtgcctcagaataggattttatttgcacataggcccattaaagaggtaattaagttaaaatgaggcccttaggtgctggctcactcctgtaatcacaggactttgggaggctgaggtgagtggatcacctgaggttgggagttcgagaccagcctgccaacatggtgaaaccccatctcaactaaaaatataaaaaatttagccaggcaggttggtacatgcctgtaatcccagctacttggaaggctgaagcataagagtcacttgaacccgggcggcagaggttgcagtgagccgagattgcaccactgcattccagcctggggtgacaaagtgacactctatctaaacaacaacaaaaaaaggcctttaggatgggctttaattcagtcccactggtgtctttataaaaggagaagatgtggacacacagagaaagacatcagagaagctcctgcaaagggaacagagcacgaggggacacagtgagaaggcagctgtctgaaagccagcgagagaggctgcagagaaaccaaacctgcagacaccgtcgttgtggacttccagcctcccgaaccatgggcaacacatttctactctttaagccacctaccctatcacagtttgttatggcagccccagcaaggactacaattattaaaggactcctcctaaataacagatattcaagaaataggcatttctattagaagtttaattcacaaagatatatctaactatgcatagggtcgtgaaaaatgagatgctggatatttcagggaactcctgtcttgatatttcagaagcactaggtaacactcacctcagtgtagaaaggaaaaaagctagtctcaaggtgtgttcagtccatttgtctacaaatgatttcatcatttgtcaccattttcatctgattcaattaactgacacatcattctacacatctcccagaaaacttcagcttctgttttatttttattttttctggagcccgcacttgacaaatggggtgacattcaccctaagccatggttattataagccacaggagatgatggtgggagagagaattcagccacctccacaaccacattccctcactgccaaaaacatccccattggcaaatttaagtttttacaaaggcacttggcaccacagaatcagtagattctccagctattgtagtaaaagtatattgcaagagctaatttagttcctgagtgaagctacagttttctgttgtgagatcaggaattttaacattttattcacgttaagcactgatgaggtgaatgaagaaaggaacaggggtgcacggtgcagaagcaaaccccacagggccaaggaaaaagagcttgtttctcgccctagctctgtcactgtttttgtgtgaccttacatcaattgcgttgattggtttaggttctagattcatatcacataaaacgtaggcatggacagacgttctccaattccaatatgcaatcaatgtcctttcacatattaggcatctcgtgctaactaatcacacaaatattaaaacaaaatttatttcatgtaaaagtgtcatatgcaattggtgtgatattaacaccaattctgaacactgtaataatgtaattctgatttcattcataggtgcgcgcacacacacacacgcatatatatatacacatatacatgcacacatcattttgagaagtggcgcttaaagagaaatttgacatactgttagcttattagtttactcagcacagctgtgctgaaaattgttcaaaactacagccgagcatacagctgagtaagccaattccttgcagcagcatatattctttctagtttaagatcccctgctaggattggcaaggatagaacacaattacatttatcacctgtctctccaaagactggttcctaccaaacccagaaacattaatatttcctaccccaggtatcaatgtttaggtcgtttatattgtggataataccatataattgttacttttagatacaaaaggttaccaggtgctagaaagtgttaaagtacataaattaaggaaagcaatttcagctgtgaaatttacatttatttgatgtgtgaccattgtaaatacaggatagatcttaatttcttaataaagggttcccagaattactgtatgtctagttttctgtatcccaccatctaacacagtggttgacattgtacagaactggaaatttacagaagcttatggaactttgatttaaaaataaaaacagtaagacaatatatgtattatcaatgggagacatgagaaaaaggaaatctgcccttacaaatccttgacttatctgtaataattggcttggaaattcaggcaattatatagatatcttcattttccattagcctgatatgattggttttattacgttttaccttaatttgtgtcttatatgaaataaagttatttggggcagtcctaaaagattgaaatataactcactcccctttttttagaatattgttttctccttcaattttaacatttctgtgtttgacattacttttgttctctccttctgatcaggacatagttctccttctggtcgctacgaggagtaaacatcccatccctttgatattaggcataatcatgtaactcactttagctaatacttcctgagtgacactgactcgggtctttgctggctggttacctttagttgccaatttcaaacgcccagcctgcccaccgtctgtcccagcaatcatggaaacacatgttattatgttatgtatccatgaaccatccaacgcaaggtgactgccttggaggatcacccagactatagctgatttcaagaaaaaagtctggtttatagctacgttataaactagctgtgtcctgcaaccataaaacatctacctcctttggaaaaagggattagatacctatttgtgtttaagattatgtaaagcaaaactaaccaggattgaattattgagctgttcccagtaccatctcctcacataagcaatttggagagaatggctaccacagaaagggtggtgaggctcagaaagacatttgcaaacattttagcttgttaagagttttaaaatgcagtatatttttaggggattttcaaaacttcaaagtttattgattgttatatggagatatgtactttagaaatgtcccttggacattaagatgcttatgtaagaaattcttgtgtaacatgtattagttattaaaattcaggaaaaaatttaaaaccacaataatttgagagattcacatagctactaataaataaaatgcatattgctaacatttctttggtatatattaaacaatagcatgaatgcatttattaaagcaattttcatttggaatctttcaatgtttaatcacatttctgttgcttctagataaattgattacagcaatagagatagctttgctataattaaaactgtaaactttgaatttgctcccttcattttattttgggaagacttttaaatataacttctctggttttaaaaaaaagtgaattttacataaaattgtcttaaaaagtaacatttggtaccaagtaactacacacttgacatatttctagaaaaaaaaaaacactcaaagtctgatttcagaaactagaatatctacagacagagtttgttccttctgtgaggtgaagacacgaagacttccaaaatctttctgccagtttgtcttaaagagaaataatatactacctcattaaggcctatttcaattaaaatgagatataaatgaacgtattcacctagaagctaatagaaaataaagcttgtgacgtgtgctcttgtcttagaaatatgatactgcaggattttggcaaatagacccaacagggtagcaagttgacgtgtttctatgcactttcaggacaaattggtaaaggctgcaggaatgaatgacacagtaaatgccagcaacacaccatgtgctggcacagaagtgatcagccttaagtacgatccttaaaataatccaagcttacactgacttaaaggtaaatttttaaatattcaatagagttttaccccttccctgtgctccctggttcaaattttcaactacaggtcctgtcgacgcctcaaacataggaaaatgcaatattaatttttactatggcttaaaattgctgcctaatagtgaattaaattattataggtacataacatgtatctagccaaaatgcaggaattgaagatgggattataaaagaaacttacaataaacatttctctttgctgatgagttaaaagattttctttttaacttcaaggaatcaggtaatcaatagcactttcttttgcggcttgaagtaattaatcaccttacatacttgtatggatatgttctctatctggtatatgtttttcttttttacttttttttctttcttccccttcctttcttccttgctccctccctctcttctgtcttctgaatcatgttttcccactaagtatgatatgacggcactagtaaattttagaaaagcaacagcaacattctctcagaggagcacaacctgtccagctgtataatcatgcattaatatgccgtttaaatatagtatcccccattttggtaaactgtaagtgctgcttcctcctcgccatctgaccttatggggaaaaaagtcatattttgggtctttgtgtcaagataaagaaaattaatttcaaagccaacaaggagagaactgtcagtgcagaaggtaagtaaatgccagcagttgctctgtgacttcaagacagagagaaaaatactttcgaaaagtagcactttgatacatacaatactggaagttttgcaacaagcctctccggcaccaagtgcagaccccacaaccacaatgtactttccgaatgcctgtcaaataaatggatagatgaaaggaaggaaggaaggaaagataaatggatggatggaagaatggatgaatgcacagatggtggtgaaaagatatactaacttataactacaactatccttattgctttcttcctctcttccttctaaagggacctagatgtgagcccgatacatttattttgattaaaaatttgtactatagatatttacaaagatacattgaggcagagaagcatcatttcaagtagggttttcatttgttacatttttaaatttcataataggcagaatcacaatgtattcatctttgcccacacagtcactctcactcaacagttacttacgtttatgctttttttttaaaaaaaaatgaaggttttgatgatgagataaatgtgttctagcatgaatgcaaagaaggtctccatgaactgagaactttgaggcggcagccgtgagcaccagggagagacctttgacaaggaactcctggcccagtgactctgagaagaggccaggctaacaagaaacagaagaggctgcctgagctcagaagcaaagctcctccaacatttttatccagacatcccccaaggcagaaaaaaataaatatttccccacagaatgctttgggaccatccaacatacagttgtccatatcaacatcaaccttgttttgcagccctatgtattaaattcaaaattatttgtatagatatgaaaatattgttttatgaagccatcaagaataataattcaggaaggcattctatcatttcatgtagttttgcaaacctctagcttgtattcacatcaacactccactgagttatagaaaatacgaagagcttatcagagagagcttccggggctttgagctgacttaagttgctactaggaacgagatggagactgcaacatggacaaagaaaggacacaggcccaatataatgtctacctttttatttttcacttatctacctatctatatatcatgtatttattgatcaattattgacctatcatctatgatccatctacttataatctataatctatcaatcagttttcatccatctatatatctataaactatctatatctatctacctacctatactataggtatcatctatcaatcatctattatctataaacctacctatcatgtatcaatcacctatcatccatctatcaatcaatcaatcatctaactatactacatcaatcatgtctatctgtatctatcatctacctataatgtatcaatcagcaatcatccatcaatcatctatttaaatccatctacctgcctatatctatcatctatcaatcatctgtctatattcatcatctatctatacatatctatctagaacttaaggatttctatatacacacttatgcagataaacttaaaatcccatatcacaacaggccccatgatcaggattctgccttcattccttatagctcaccactttcaatatgtgtatcagtcacaggtgaggattttaaattccccagatgggccatgctgtttcacagctctgccttcccatatgtggtccctggatccagagttcttcctgccccacacctttcttcttcagttagatatcctcaacctgaaattgttccccatgactgagctcaggcagaggtctcattaggaaatgcccctgcgccctctgggtggagacatcgccctgtgtgtatccttacctcctgcacatgcacctcaaaagccctattactctgtgttgaagttaccggttcatttctaatgcttgcagaagactaacagttaccagaaatcagaaactaagtctttcagtgtgaatccattaagccatgtgtttcatgaatgaacgaatgaatgaatacaactctataaggttatacacttttttctgaatttcaatattttcagcaaaaagtctataagcctattttcatttgctctcattctccaaaatgtggattcactctctctcgatgatatcaccattgtaactaaagaaacgagttttacatatttttagttcttgttaggattgaggaatggcgtgcaggcattttgatagaagaaaataaaatctgagaagttcttctgtgattagaaagaaagacgaggaatacaagaataggaattgcaacttgagagagtgctcggcctgctgtttaccaaaagcagattcaaacgtcttcacatgagaagcagaactcatgcaatttctgggctgtcttcctccccagcaggatgctcctggatgccacgctgccgctcagaacagttagtacttacactgccttttcagcagcttcatggaagaatcagcaaaaacagccaggaataataggaacccaaagtgcaatgcattagggagtgaagacttaatcaaagaaacagcaaagggaaattgaaatcatcataggcaaggagtggaggtaattacagttataaaaatggtttctgtcctgttccacataatctttcttgctacatctagatcctgaaaatcacattaagttgagaggcagaaattattatgcttccatataataaagattagttaaaatgtgcccacagatattatatcatcagataacagatgttttatctttgaaatttcaattttaaaatgtgtgcatgggattgtgaataaacaaacagggacaggaaaaaactgaaatagtaaatcggcctggttaaggtttttagagtgggcagcagtataatttttaaaattgaagatgtactcaaattgatataaatagaaaaaaatagaaggatttttgtccagaacatcttattatttcaaggctttaaaactttgcccaccttttccaattacacttctattggatggattgtaccttcgtgaataaatgtttggaggtagaaattcataagcattttaagtagacctacctgtgaaacactttatttgatatatttgtcaacactaaattacctggggatgcattttaattcaagagctagttatggacattattaaccattgtctatgactagtaaatatttcactgtaattcattaaacatcaatgttaataggcaggacctgataaaacccatattggaattgtctatatgtgttgtccctaaaacacactcaaataaaatatattaaatggattttataacagctttgctgctaaataaaaataatacataaaacactattattttgactaggttttttgttcaaattattattttctcttgtgttttattttctttaaatgttatttttgttgtcggctctggtggctcatacctataaccctagcaccttagcaggccaaggctggaggataccttgaggtcaggaattggagaccagcctggccaaaataacaggactctgtctgtatgaacaattaaaaataattagccaggcattgtggcacacacctgtagtcccagctatccaggaggctgaaggtggaggactgcttgggcccaggagctcaaggctgcagtgagctctgatcctgagactgcattacagcctgagcaacagagccaggccctgtctcaaaataaataaataaataaaattattttttataaatataaggacaaatctggtggtatagtcctatcttcactgggggataccatattcatggactctacaagttactttccactgtttgtttttgtaaaatagtgaaagcacacctgctgggacttgatgtagtgtattctttactgggaaatatgacaggttgaagaattcatataaaaatagtgtttttctctatgatgagtaatactaaggcaaggtattttcttatgtgttggatgaaaagagatttacaaagcacagaatggtgacaaaaaaaacaatggctagtaacttacagtaccaaattcctctttctgtcagcatgacaaagaacaaagataggaaaagtcccctaaataccttggcagtgtcagagtatctgacggaggcatcaaataaaagcacatgaattatttcacctcatttaaaatagagcagtggtttctttaggggtatgaacgatttcttgactttacgcctgagcagagtaagataagtgtgatctgatctagagagaagtttctcacacagtggcgcgtgcacacacacacacacacacacaactacaaagtgtcagaattttaatcacacaggaaatctacattcgaagctaaaaaatatatattaacattacaattttcaccttgcttgtttttcctctttcccaaatgtcagctacctacttatctaaattttgtttttattaattttaatctgttttcaacagtagttttattggcctttgtgactcatcctccctcatgcaatctttgtactcaaaaatagttagaataatattacatcaaaaagtattaatttccaaatgattaaaattttatcccttttagtagcaacaaagaattttaagttaataattaaaaatacccattggtgcactgatgtcagaacataatagagttggggaaatatagaaatagtcagaactgttgactttgagctactagtgaagctctggagtgactggtacactagaaaatggatttcaataatttccaaaactctatttgttggactttgcagagtgggaaatttgacaggaaaagtttaactgcaatgagttcataaatgcaacatttcaaagattccaaaatgcttcccaatacagctgtcctatagttattacaaatatgactccatgcccacttctcatcaacaagtggcatatgcatactcacttgttctctagtaaaaagacaaacattttcacaaatggtttgacaaaaaactgatcgatggtatagacacctggtgactacccagacactgtgctgagtatgacagggatattccctgccctcacacagttgtcagtcttatcgggaaaacgcatacttgcataaacatttatacaagcacatttacataaacacgtagctgtaatcagtgcttgaactccaggatcaagcctcatgataatggggtggaaagaaacagataatcttctcatgataaattcgatctgaaatctgagaatgggaaggttaaaaagtgtgtggcctgtgggtcaagaagtgcaggggaatgcttttttatatttcatatttttggcaaaaggtgccaaacattattgaaacaggtgtaacgtgatgttactcagtggttttaatttgcattttcctgatgattactgacgttgaacctcttttcatatacttgttaaacttttgtgtgtcttctttggagaaatgttattctagtcctttgtccatgtttaaatcaggttatttgttttctttctattgagtcataggaatgttttctacgtgttgtacattaaccctgcatcagatgcacagtttgcaaataattctcccccctctgcgggttgcctctttattttattatttcttttgttgtgcagaagctttttagtttgatgccattcatttgtctatttttgcttcttggggaaaagaaaatccacgtacactgttggtgggaatgtaaattagtaaagcaaatatggaaaattatatcgagattcctcaaaaaactaaaaatagaacaaccatatgatgcagcaatcctactgggtatgcatccaaaggagaagtccatatgtcgaggcggtatctgcaagctcatgtctctagcagcactattcattaatagccaagctatggaaacaacctcagtgaccctcaacaggtgaatcgataaagaaacgtaatctatatacctaatggagtactattcagcctttaaaaagaagacagtcctgtcatttgtgacaatatgaatgaaacagacatcacattaaatgaaatgagccaggcgcagaaagacaaatatcacatgatcttgcttacatgtagaatctaaaatagttgaactcaatgaagccgagagtagaacggccattaacaagggctgggggtgagtgggaaggaattgggagatactggccaaatgttacagaattaaaatcagaggacaaggaataatttcaagtgatctattgtacagcacagagagtacgtgtggagtatgcagtgtactgcctacttgaaaactgttaatagagtcgattttaagtgttctcatcacaaaaaagaattcacatgtgatgtagcatggaagtgaataagctccactgagcaattccacaatgtatacctatttctatcaggttgtgtaccataaatatatatacaattttgatttgtcaattaaaatataaatttaaaaaaagattgggaaaacttgaaaaatcttcagagtagggttattgggaagattgggaaaactgaaagatccatgtgcctgcactcccgtcagagaagacaagagctgaggtaggagaaccgggcagaaaagttgcatgtgaactaccgggggctgctgaggaggtcttggctccccctgtgagagcagggaggggtcaggggagtgtgggaagcaagatattgactgacctatttcctctttaagaagatcctggccaccctagtcaaagcgtatttgagaaggacaagaacagaaatagtgtgagcagttaacagtccattgagtggaaaatgcagagtaaaatgatatggcttcaatctgaattattttctgacgtgcccatgtaatttcacatttttaaaatatgcaaattgagtggaaatatacagttatattacatgagttaagaaattccaattatgtgtaaaatatgtactttgattctctttaattataaatatacaagagttgggaagggcatggtctgtgtccccactttgtttgctaacctaggcacttgaattagctttgcagaaatcaaactgaaaattcatccacacagtatcaactagcctcgtgaagtttagagaggcaggtcagtgttttgattctgtttatttctgggacaaattctcacttaggcattagaggttcttacgttctttaacacataaaacaaaccaataccttacaagatcaaatcaaccaattaaaatatgcatgttttgctcacaaatctccagggtagcagcacaggtggtaatgcttcaacatagaaaatgagggggcaaaaaaattttaaatcataatctctgtaccatgtgtcagcttgtaccatgtgtcaggtaaggcttagaggtcatggttaaaaattgttttttcttcaggtaattttatcaccatttctttattctccaagaggagaagtgtttgggcaatatttctttaacagttcttagatctagatggatttttcaaatgtattttttcttaaagttcaagaaagagcgattaattttgagagaggaacaatctacacttttcatttctgttattatttttgtaatctgacagataaaccatctcaaacataattatattgaattttggagtttgtctttcgcctctgattttgactaattggttttacaataaattggatcactcaataaatattaaaataaaaaacaaaaatattgtaacattcattcttgtttcaaaacaacaaaacattgtaacattgtaacactcttttgttgtttcaaacacagtaacattctttgattcaaaaagttattttgatgtaatatactttgtttttgtaaagcacacgcttcataataaatgttttgagtactaaaatatgatattcaaaataaaaatattatcttttgatggtctaagatatttgtgacattctgtaccaacagtgtttatataggaagccatgttgtacaacaagtgtgccacaatttcaaaaaagcaagaattgatcttcagaatcaacagttatctacacatgtaacttgttgtgtttcttctgcagtctttgtcaatttttttcatttttatcctgttcatggaaacaatcagttttttttaatttttaatttttattttttttgagacagagccttgcactgtcacccaggctggggtacagtaccacaatcacagctctctgcagcctcgatccctctagctcaagcaattctctcgcctcaacctcctgagtagttgggaccacaggcatgtgccattatgcccgactgattttcaattcttttgtagggacagggtctccccatgttgcccaggatggtcttgaactcctgagctcaaagcaatcctcccacctcagcctaccaaagtgctaggattacaggtgtgagccaccacatctggccccatcagcaatttgatgatgctaaatttgcaaacacaacagtttttatctgcttcttccagtgagtatgtgttgtttttaaaagtcatttaaaacctgaatcaaatcattacagtcttcaaaattaccctgggtaaatgggattgtctggctcttctactttaagaatctctcttcacttcctatttttacaggtaacattccacaattcctaaatattctcttccaatcaaagtataatatactccctatttatttttcaagtcacttattttcatccacttttgcttccttccccccaacacacagacacatataaaccaggcttcactcttattttttccctgttctgaaatcacttccctcttccatcttgataaaactatgattcaaaagaattcctctgtgaattcttgcctaactctgacagatagaataacccattgctttctcggtacccttgtagtttgatgtttctttgctgagattactcttatcatgttgtactggaggaattcacagttatctacatcatgcccaaccaaccatcatgacaaagacagttttcacattttaaaaaatattttaacttatatttgttaaattcattttttcaaaatattttcctctattaaataatgtacagattagtaattctcacatatttaaaagtgtgacttcactctaatgactaagtcatcaagaactaatgttccaatatggatcttgccacttttcaccatctatccactaaatatacacatgtgagtcaccgcatatcacactgtgataggcagtttggcagacacagaatcagtggagaatccaataccgaccttcatcaacacagacagggagaaatgacatacacagatgatgtagctagggaattggaaactgcaacttaaatgaagctgtgataataggtgttaactaattcacagatagtgggacctttatttgtatccaaaacattctatgaaagctttttggaaagatataaacattgaaacaatggtttggattaggttatagatgatgggtgtgcattcaggattgagatagcttaaggcagcttcccagaaagtcaggcgctctcaggactctgttgagagtatggctttctttgaggaagaccaaatcaagaaatagtgagacatgaaagtaattgttcataacagatgaagacaatgactccatagattttacaatttgaaggaattagtggaggattaatttcacttctaatcagttagtaaggtcttcattatgtataccgttttcaaagcacatttgcactttatttgaaaatcatggccgggtgcagtggctcatgcttgtaatcccagcactttgggcggcccaggcgggcagatcacgaggtcaggagatcaagatcgtcctggctgacactatgaaaacccgtctctactaaaatatacaaaaaattagccgggcgtggtggtggacgcctgtagtcccagttactcgggaggctgaggcaggagaatggcgtgaacccgggaggcggagcttgcagtgagctgaggtcgcaccactgcactccagcttgggggacagagtgagacaccgtctcaaaaaaataaaatgaaataaaataaaataaaataaaataaaataaaatcatcacctctctgtaaccaattacctttataaatacctttaaacaattaaaaaatatatctcatatatcaaatgaaaagggtgtgatgatttatactatgttgtccaagttatcctatctagaactttgcagactgaatcacatatctgttccacatgtcattcctaaaaacatttgaagatatccatcatgatgtgataagcaaaggactttggtaagttactttccctgaaaattgcatgttagaaaaaatcccttatgaacgaagatttgacagcatcattattcagaacaaatcgaagccaagatagagccataaataagtgtaagagcccaaaacgcttaaaggtacgcagaattgcggtgatggagggccgagctggatattgattatggaaagacagaaaatgtattaagggaaagaaacatgacaagacatactggcggttgtatttgagtagtaaaaaagacttgggaatcaaaataagctggaaagtctggggaaagaagtgaggaagatgtttgatagacaggaggaagtttggagtagaaggaaaggcagattcaagtctaaattctgctgagttttaggcatctgaatatcttggaagtctcatgaaagagaaaaaatccacgaacttagatttggaaattcctagtgtatgtaataattaaagaccaaaagatgatagaaagtagagcgacctcaacagagctctgaggattctatactgtgagtattatggagatcaatgcaaagtttacagagcagaccaagagaagaaagctagttatcagtgagtttgggtttaaattataagggccagcaaaaatgctcaacacactattcagatggttgtaggaattctcttgaaatactttttgagatataattttcattctttcttgaaatcctcatttgactaacccagacaccaaacagatcttgggaaagctgaaagaacacatcagagactcagactcagaggcagttactaaaaggagtctacagtccacctgaagagacaaaataaatacacaagaaataaattgaaacattaattcaaaaatgtatgcggactggccaacaagcatatgaagagatgttcgatattattgatcattagaggaatgcaaatatcatcacctcacacccacgcagatgactactgtcgaaaagaaataaatcaataaaaacaaaatagcaactgttggcgaggatgtaaagggatggcaaacccgctgcactcttggtgggaatgcaaaatggtgcgtggtggctactgtgaaaaacagtatggtgattcttctgaaaattaaaaataaaactgccatataatagaggaatccacttctgaggatatactcaaaacagtcgacatcagggtctcacagagatatttgcatgtccacgtgtgtatcagagctattcaaaacagacgagaggtggaaccaacccgtgtcccttggcagatgaatggataagcaaaaggtggtctcttcacacgaaaattatttatcctaaaaaggaagaaaatcctgacataggctacaacacagatggacctcaagcacaatataatcagcgtaattagccacccacaacaagagaaatactgaatgatcccaaatacatgaggtttgtagagcagtgaaatccttagagatagaaagtagaatggtgattgccagaggctgtggaagggaacatggggagttactgttgaatgggaacagagttttagttttgcaaaataaataagtcctggagatggatgatgtggttgattgcacagccatgtgaagatacataacacttctgaactgcctgccgaaaaatagttcagatagtaaatttcatattatgtatatttttaccgcaatttaaaaaaatacatcccagcattttgggaagctgaggtgggcggattacttgagcccaagagttttaaaaaaacaaaataaaaagaggaaggacatgaaaaaaaaaaaagtggtactcagtaaaaatgctttaaaaaataaagacaagaatagcctcagtaaatctctggataagaaattctaagtgatgtattcaaggtgataaagtttgaatatttgaattagttttgggaaaggagacttttttcaagagaacttggcattaacaaagacaaagagaaaactaattacagcttttggagggtacaaggaggagatgatgccacctggagaagatgatgaatactggagaatggtgacggatgaggttaagtaggcagcagaacccagttttggagagtccaaggtcacgccttgccactgaaactagcaggatttggcagacaatcacagaaactcctgaataatagcattcactcgaagaaaacagaatgttatcaaactccgctgggagctatgtgcaagaaagtaggacatatcagaggctccagaagacacggtagagacctgtaataagaaccagtgggctcttgtgaacatcagacttctcccgtctgctgtggtccttcagcattgccgctggcaacgaaagtccacttgcacacccagctgtctctacgtggctctgagtccaatcgggttacagggataacttcaaaagcagtttcaattaaaaactttgatactccgtgttgttttggtctgactcaacatacttaatttatggatctaaatccctgtcttgttacgttctcagagactgatgcttttggtcttgtgagatgaagaaagctttttcccaaaactaacctcaatcaattaatatgactaactgaaaccttaaaacaatttttgagggtgctttagtcaccattgagaaatgcccccacctagtgatgaaggaactaggtcatcggtcattgtccatgaagatggctttggaccgtgtgttgagtgacaggctggtctgcccagtgaccctctatggagactaccctccccaggtacaatatgacagccatccccccagctgcctctaaccaggcctgaagcatgtccttatgaaggattctgactctgtataagtgaatagaacactaaattctaggcttatgtctaaggaaggaggtactaaatttatgccatatttagaatctgactcccgaattaaaaatgaagcaatgtggtaacaattgtattattcactcactctccccaaaggttgaatatgtgtagttggtgtacagttcagcatcagtaggttcagttataacaccaatgttactggcttcactacagggaaataaattagactgtgattctatttaaataaaacatgcctccaattacacatttattttgacataagattttaaatcatagccatgatttaataatcagaaaatatatgtttcttttagaaagacagagcatatgtacatacgtattttaatatttcactttcttcatatatattattttgaggagtcagtaatcaatgtctgtaatccaaatgctaaacaatcagcaaaataagaactttcttttaccagtagtattgttgcaaatgctacagaatttgtaataggataatccatttgtagttacatagtcatctataactacttgtatccatctgtgcataaatttatatttaacacaaattcacaacaaaataaaacagaaaaatatgttaacagaatacattcactgctgttatctactttttaaatgttgtctgacttcaaacagtgaaatttttaaaattaccttggcaatgatataataaactcaggaaacctataagaccatttggtagtttggaaaaaggtcagttcttctcccagttaaaatgcataactaaccaaattctcagcactaattaatgggaaattccctaaaataattaattatgtctaagaattaccagtttttttctcacataggtaagaaatgtcaatatttgacttgtcatctgtccagatcatcaacaatgagaaaatgagaaccatgtggtaataacatcaatcccacatgtggtcagaaaggtggcatgataattctctgaatataaattaacttgtatgaaaaatttgaagattttcttcccctacatgtaaacttacggcattcttcttcctccccccagtgacagataaccacttacattttgggttgatcattcttggcattgaaaaataaattcatcataaatatattttgtctaaagtttgtagctgagtttgcttgcttgatacattataaaactagtgtcctacttgaatttgcattttttcaaacaaaaatatgtttctaaaactcatcaagtttttgcatatagctgtgttttatttatcctcactgctatacaaaatatcattttgtgaacatattgcaaggtgtgcgtccattctcctgtaagacattcgggtaattcttgggtgctttgtgcgtttattcctattgttttctttttttaagatatccataaaaaaatctgctgtatgaactttcttccacatgtcagcttgtgttacacattcacttttctgtaggaatgtagataccatagtagtagaatttcaagaacattaatttttttttaagtgccaattattttccaaatggtcgtatcaatttatactactatcatcatggtacaaagtttcctaatgatcaatttatttttacctctcgctattgctacaggtcataatatatacgagtttagtaggtatcaaatagtatcaaggttttaattttttatcgtctttaccattaatggggttgaatatttttataatgttaggtatagttgttattttgttttccttttttgaagtgtcaattcaaaatatttgcacatttttttcttagaataattgtttatatattctgtactagttacttgccagtcattcattgggcatatctatctattcctgatttgttctttctatttctttcttatccagtaatcttgatgtctgcatttatttagattgcataatgaccttcattaaagtttcataatcttgtgaatactggttttgtaaatctgctagaaaatttattcatagtacctttatgtttcattcttattttcaatggtgtccttctcaattacattataaaattatcactgaaatatagtattataaatatgttgctaggttgctaaactcatatttttaaataatttgtgtgtataatcttttgaattttctatgtaggcatctgtaccatttaagaaaagtgatagtttagtttctttctttataaccctgaaagtcttaacgtgtttttatattcccttattcccctagaatggagctgcagcataaggatttttagaaaaggttatggtgtgaatcttttcattccgattttagataaaagaccatgtttttacataaaaataatgtttcctgtggatttttggtagatataattttagatgtactttatatagcaaggctgatataatttatcactttaaggaagcctccttctgttctttgtttgctaaatgtctttatcctaaatgagtgtaacattttaacaaatgcctttttggcttctgttgggataactttttttgtaactttaatctgtaaatgtggtaaatggtaaaggttttctgatgttaaactgcctttgtattcttaggataaactcaagtttatcatgttataatattgtcttaaataccattgcatttggtttgtctataatttttttagaatttttgcacctatcttcataaatgagagtggcctgggattgtccttttcctatggtatgcgtagctgttttgttaaaaaaaagttattttggcctcattaactgatatttcactttattatttgtaaatgtttgtgtaaaattgcagtcatctataccttcaacatgtggtgaaactttcctggaaaattatttgagtatgctgtattatttatagaaaaatattcaaccactgcctcatctaatttagtagttctcaaccaggggcaattctgcctcccaggggatatgctgcaatgtccagacgtgcttagttgttgcatgtcacatctggtatccagtgatgctgccaaagttcctgaaatgcccagtcaattgcccttccacatccccaaccaagaagcatctgaccccacatggcaatagtgccaaggctgagaaatactgcattagttattatgagaattttaatgggatcatttgggttacagttttctaaaaatgtattaattttatcttttcaaaaaaattgatatgaagtttctgtggcatttcctaaacatgtactcgaagcaatattgagcatatctgaaggacaggatatatatatagagagaatatataaggttagttcaaaagtaattgcctggcaaaaactccaattacttttgcaccaacttgagtgtgtgtgtgtgtgtgtattctatctacattgcaagaatattttaaacagttaatgcaaatgttttttatctaattggtcacgactattgattgagattaaagcaaaacaccttgatgaataatggcacagggaagaacctagaaataatacctagaaatatttctctataaatatttataaaacatagaaatgtttcatatgataagattttaatatatgtctatgttcccatgtagcacacttttgtatatgattgtgctatcataatctttgtaccaatgtcttctgaaaagtatttgatgcttatctaattaaaaatacaaaattagtcatttatgccacacacatattttcattactttatggttaattctgattagtaagtaaatgattttctcaagtgacatttgcagttgtctttaaaagacagattttcaaaagttaaataagtagagggttaattcataggacaatgttacccacaaacaagcgtttttagattcttttattttaaataaacgactcaacttgtgaaaaagcagaacacctgcaaaataggataagaaataaatcagcctacatctattaaacatacactactttattcataaaaaagtaagttgtttttagtaaagcaactaactttttataaatttagtttctatgtaaaacactacacatttaaggaaaaagcaaagttacttttgtggtaatatttgtcattgttttaaatggccaaggatttccggaaaaagaattcagagtttactttgattacattggcaataaaaagagttggtcattgaataccacgcactttcaaacaatatagcattatttataagtggcagcacgctaagtcagacaatgaccgtaagcatcaccactcaaccactcttggtgaccattaggagcaccactcaaccactcttggtgtaccctaccttggcttaagaaaaagtaccagggtggcaaacaaatgtacttgtttaaagtaccattcttgacaaataactgaccaattacaaaacttggagacttgtggtaaaaaaaacaaaaacaaaaacaaaaacaaacaaacaaaaaaaattaatagagaagggacctatacataatttaacccccaagaagtagcttcaacaaatacaaataataaatgaagaatgagatttagacaatgtgaaaaaaatgtccatctttctgacacacaccctcctcttggactgtccccttgtttctgcatcactccttgccttaaatcttggtttcatggtagcctgcaacattccatatggtccacattaatccacaaagaaactgtctctttcctgtgtcattgctgataacgacttttagtctctgcctgaaattgttcacgctcagtctttgaactgcggacttcacaaaccatatttctattacttgagctatctctgctcttaattgctaattattctagccagtcaggatcagaggtgtgactcctttactaccttctattaaaaaaaaagaaaaagaaagaaagagggaaggaaggaaggaaagaaggaaggaaggaaggaaaaggaaacagaacagggaaagggaaagaggaaggatgggaggggagaaagagaaaagaaaagaaaagaaaaaaggaaaagagaaaataaaaaagaaaagaagcaaaaaaaaaagaaaaacctgcggggtttttttaatgcctgtgaatgacttctgggactgtgaaatgttttatctggatttcctacttttagtaaaaaatgaggaatccttggctgtggttctaccagaagaatctccctatattaataatgttactcacaatctttctccacccacaccccctacctttccttaatatctctggtgaaagatatttctgagccttctcctttgcacaagctgcttataaagatcaacaaagttaatacactgaaggaccaccctgcatatacaatgagctataaaatattaatgacattttatttatatatttagaaaaaaaaattattttttcccctaggcctgaaactggtgactccttcagagccaagcttctaaacatagtttatcttaaaaggttttaattatatatataatatagaaatacatatatatacacaaaatatattttacacgtaattgtaagcaaatatgctgctatattaatgcatcccaaatagatctgaatagtcttaatttcactaaatatcttgcacaaaataatgtcttaaaattatcacacacacctctcctacacaggaaaagtaatgtaatcaaaacgtaaataaagccatgtttgctccgtggagttaatttggatttttttctataagataaactattatagataataaaacgcaacaaatattataatcaagttaattagccaacgctttttgggaatgaaaacaaacccaataagtgaaactgaataatgtatgcgttgattcaaatgtccacacagtttcacacttaaaaattgtaaaatggaagagtctatattagtgagtcatacttactggatttcaattacctatgtctaaaagaaaaggcaaaatatttaaggacataaaagtttaccttttcatgaattacttaaattctattttttcaatactttaatatgatttttaaattttcactttaaaattatccacactatgattttgtatttaattcacaattcacaattagagcatagttgatatggtgattgtggtagaggttcaaatatggatttaaaaatctatcagaagcaaaacatggaatacattaaaatgagtattaaaatgagtatatcaaatattgagagattcctttatttttatttgaaatttcctgtaatttcaatttatagcttacatcctaatgaaacaatacttctacacagtaatcagcgtttttaataactctgactatatgcaggtaagcttgttggatgtagactgtgatgttgttaacaaatgtttttgaatgaaatctatactgaactgattcactgctacatactacaagacatggcagtaattgatacaaaagtagaaggctgtttttattccacatccatgcattcatacttatactaaaggttttccacatgtgagatgagagtgaccattaatacgtgagcagatgttaagacaaaaaaacattatagtccttaaaagaaatatatattcaaatggaattgtaacagttattaactcaaattaactgaatttaattctcaaggtagaagatacactcaaagtataaggtagcactcattgtaggaggaaaatcttttatttcctaatgagttttgctgaaaattttccagccttatcttttgaacatatatttctaaatagcctaactaaatcagtcttttagaaagtacaatatctattcacaattgaacttgttgtaacttttcattaacagatactaaatcctgaatcaccatttatggaaggactatgcgatcaacacatgtaatcaatatgaaggacaaataaaatcattaagattaacactatcacttcaaatactaaataattgctttataaggagcatttctggatgaacccaacatcgtccacggtggcaagttatgtaacttgaactgtgcccttataaacctttatctcaatttgtttctcactgttgagaaacgattgtcaactagtcataaaatttagtaaagaaaaaaacttggcaatactcatagaaatacacagaagcagtcagaattaaatgttattcacattaagaaaagaattatcaatatgctatttttacatgttgctaaatttgcctgttccaagatttggatggagatcaatacctgtctttctgcaaggctaattctctctgtctttggtaattttcccaaaatgtggtttgtgaactatctgccacaggaagaattatctgggatccctgttcaaatgcaggttgcaggactcaaccctgggcttagagattggactacccaggagtagggatcaagggttttgatgtttaaaaagctctcctggtgcacctaatgcacagtaaagttaagaaatactaccgagattaccagaaacacagcagcaatgaagacgttacccttcccacccacctgttaaaaagaattgagtgcttttctttctccaaattcataaacatttcttccatgtatcctacctgtgccaatttaaacacattattttatttctaaatgccaaagagtaggttcaaataagaaccaactatttgccatttagaaataaacaaacagaaaacacattatgtgttccctaacctcaaggagctcagagtttaagaaattatttttaaacaattaccaattacgatatggtgtgataagtgttacaacagaggtgcaaataacaggttttaaataaaggaagcttgttatttaaaaaggtgatatttccatttgtaactctaaagacacattttttgtgtgtgattgttttctgattgaagctgtttccaggttagcactcccaatgctgtgcacaattgtatagctgacaccatttattgatttgaatgatgactgaaattgatcacgtggcacaacagaatagatgcattccacctcaattcatctatagattttatttttttaaaaaatatgtttaaatgataaacacattttatctacttagaacttttatactttctaaaagaaggatatactataaaataaaatcctaccaaaagcaaatacccaatgtgtactcatctgaattcatgtgtgtgaatgttccttataagctatcataaactacataagcaccatggaaatatgcagagactggaggataagagcaatattaataataactgctattacacagaattacggttttccatacttgactttaagaaaaaaattctcattttctcttacttttgcttttggtgttgacaagattacacatactaactcataacttcaggaattcagagtactttgtttcaaaatacctgattgaaatgatcagtgaaaacatgtttctgtttgtctgtgacacttttatcttttagaatgttcctgtctaatttttctgggttttcaatgttctttcttagacgagaaagccagctgattttctcgggacatccattgctgtatgtcagtggctctcaaaataggctctggaacaatcgcttcagcatcacagaaatggctttaaatgggactctttggctgcacctccagttccctatatcagaaaccctctgagtgcagacctacggggctgttcccgttggcttctacccattcgtgtgcacagaagttttcagaaatgttgcaatgcatctttgaaacacagtcatccttaaaaaccaataaagttgcataaacttgtaattaatttgtattttaaaaactaaggttataaatacagaaaacagtacttcccatgcattttatgactttttattatgattggtgtctttcatgtgttgagattattgatgcctactgtgtctgtttggtggatgcactacttcgaccgcaactctcacctctcttttttttttttattgtgagacagagtctcactctgtcacccaggctggagtgcagtggcatgatctcggcacactgcaacctccgcctcctgggttcaagagactctcctgcctcagcctcccgagtagctgagattacaagcatgtaccactacacccggctaatttttgtatttttaatagagacgggctttccccatattggccaggctggtctcgaactcctgacctcaggtgatccacccacctcggcctcctaaagtgctgggattacaggcgtgagccaccacgcccgggccctctcttccaaactgcatgttaggtggtggcgtaacagtaccttcaaattggccaacatgggaatatttaggtcgtagaaattggcaaacactgccaatcagtatctttcccctctagaaagtagttgttaaacttcagaggcaaaaaattatatttaaaaagccatccaggcgattcagatgaatggctgagtttgagaaacgctgtgctgcgttctgtgattttcagtatctgaaggattctagacaactactctcagactgctccagtcacgtgctcaaagaccacttgctcctatcctggggtgacgtaaaaccacttaggggagagttatttggttatcaccctaagaactgctaattactttctcgctcataatggatgacagagttatcatttttctagagttgtttcttttctacttggggccactggagatttgttttctttttaagttgttcaacacctttacagccctccttactcgctatttttttttaatttaaagtgacagaccttgcatagtctcataattttaaaacatttaatagcatatgaataataaaaataattaacatccactataaatgtatacttgtttaccgtaagataggatgatataagatgtatatatacacatacattttcaagatattataaaattcatatgtgcatatatttaatatacatattaaaatatattttaaatatattataaaatgcatatgtgtataaaaatatatgttatcatatacacacgtattttaaatatattataaaatatatgtgtatatcataacatataatatatttaaaatacatgtgtatatcatcataacagatatttttattttataaatatatgtaaatgcagaaaattactggagaaaatatgaaactttcagaaaacaaacaagttgatattcactcacttacagtatgatgaacttaatgttccaacaaagactatgtcaacacaagaggaaaatattccagggaatggagacttcacaaacaggacaagttcaccttccacttagattttctcctcccacctgttgcattgcttccacgcacctcctgcagaagtcagtgtgaactcatggtgttccctccacaccaagcggcaatccccaaccaggcgctctcatttttgtccacattcaattgcactggacacaagggaggaaagcagctatttgggaagcctaaccatgctcctgattcttgtgtctgctgaagcagaatcctaagtctagctagaaatgtgagaagaaattcaggaagaggaaacacattaatttgagactgttgccagatatgctagaagtatgaattttaaaatataataaatcatgaagagtaataaaagcaaatgaaatctggcaattaggtaaaaacagtttgtgacaactgaaaaacactgacctgtagacctaaagctatagcaaactgttctgcctgggagcctaatattactgagttgccttcaggaatcctggagtcaggcttgaaattctcaccccacacaaagggcaaagcccctaatatttttttaaacaaggaaagatgcgttggcagagaagagcacatttggcagtttgtgaaaaattatgttcaaaaagcaatgaaacacaaatctacgggcactatggtcggaaaccctatgtaacaggcgctttcttctttttgcctaagttctcttgatcatttcagggaagacacacatatcagagtagaaataactacttcttatcaacttttctgaagtgcttatatgagaaattcattgtgatatcagtgtctttgtagacaattaaaaataatcttgtgaaagatcctcatatgaaagaaaaaaatgcactgaagaaataaatgatgtttaccattctagagttaaaattaacaaaaggatataaaaactcattgctatagtaagattttttgtttgtttcttaccatgtctcttttcccattccccttctctataaggactcaccatgcttaatttaaaacgtgtacacaaactgactaggacaggggtgtactagctaagtaggtggatagtacaattggacaatactcagctcctgcagtcactctgccagcccctgcaatatggaagtgtggattgataaagctggtgtctgtaaggagaagtattttagtcatttacttgaagtactccttctgcttttctctccttagtaagatgttattttttccataattgtgtgatgtcaacagatggttcaagtcacgacgttgaggagaaagcatctttagcattcatttgataagagggagcttcatgtatttgagtgttcataatccataaagtgatgtctcaaattctatgaggtctttcctgtccttagaacatatgtttccctcaaacaaaatgttgtttcgatcaatttgtgtttaacatactctgtttccacattatatttttatagttttcatgaagagtcaatatattcaatatgagattagaaaaacaggttcaatgaaagtgcacatatttgacacatcaatttttttttaacttttacaaatatttccaattgtcaaaatcaagttaaaggtgaacatggttgatctttacccacctattttaaaacaatttttaagcaattgacatttcttcaaaatgtaagtctataataaaggtagatgaaggttaaaagtattaacagaaaactgcaatatatattgaagatattgaggcttacagaatcaagcactccatagttcagccagaaatattcccacagttaatttataagctcttgaaatgaatagaaattctgacagcttcttaagcaaggcagtgttctgagttctgctacaataataagctattcaagtatgggatctatgtgaaccagtctttctggttttgtgagttaccatggagtttttaagaataatagacataattagatttagtgactcaataaataaatgaagcttttatataagtcatcagtaatttccccctgtttcaaactagaagtgaaaaaagcggggctttcatgaagaaaatatatcccatgcttctgacaagtgtctaaaaaatgcatgtcctttagtcaaagaaagcaggtaatttattgacttctcattccttcaacaaagaggaaagaatatttttagaaaaaaatataagcagctgcctttgcttccttaggtcttgtgagaattacaaaattaaaaacaagaaacgtgaaaacttaaatcttaattgtatgctttaactgagattatcaagccatgctatatagtatatgtcatcaaatggaagatgatttcatctagagggaaatagtttagtctatgcttagttttaatatagatttttaaaggttatatgagaatttggaaagaaattgcacatatcactggtttctatgacacagcttccaagtacgttctgttcaacgttactgccatgaagcggtgcttgttatgtatttttaaaatggattctggggtcatatgttttggaaaagctaagtagatatgtaacaggtatgtttattgtaggaatttctgggaccttcttattcaacatgtacctggtgttccccgcatgtcaggtggcaatccccaaccaggcgctctcatttttgtccacactcagttgcactggacacaagtgaggaaagcaactagttgggtagcctaaccatgcacagagaggcaacgccctcaggatatcctgtttgttctatcttcaaacgtatccagaatccaacaacttccagctgctccatggtgaccactctggtcacggcactataattatcacccgatacctatctaactgctgtaggcattgagcaggcttcctggcttccagccttgttcctttctattctaatctcttctcagcgtattatctagcttgtctaactttgatcaaaaccctccaatagttctctcagttcacggaatgtcaaaatcctaatgaccaacttacaccagaagtcttcctgtacgtgacctttgttctgactgttgcttatttctagaatgattttcccagatatccacatagctaactacctaaccatttaacagtctctgtgaaaacatcagtgtctcaatgaggtgaactccctcattagaattgcaacaacaatcttccctattttctgctctacacttttaaaataacacttactctccttaaaaataggaaaatgtattttgttactgacttatggtttctctttgctcactaggatgcaatttcaacaaggcatatgtagccttcacagttactcagaacagtgccttaccaccattgggactctaaaaaaattgccaaataatgaatacatttttaggagggatataatgtgctcattacttctgaaatgtactagacccacaaaactctttttcaatatttctaaagatcactgtctcaggaaatcttgatctaggacactcagaagatgaaatacaaataatatcttgaaggaaatggaaaagataaactatacataacatttgtttaattttgcaacgcccctgatatatagacaagtgtgtttaatgttctgacatcttacttagaagagaataagaaatatcactatgatgatgtaaatttgagagagctggcaagctaccgatctcactcttctttcccactgttgaaaactactttcacctggcatgtgctggggataaacaaagtaccaaactaagctgaattccttgtttatgattcttcaaggaacaagatagatgtaaagttaagcgcttgtacatcttatgttaaaaagtatcctgcaatcttcatacacaatagatagaataatgccagtgcatacatacagtcatgggtgcatgcatccatacatccatatatccatacatatgtacatccattcatacgtacatacatacatgcataaattatttcttgctagttttagtccggtagtttcctaaaaataaaattgcaaattcctttataagggtacacaagtttcttacatctaagcaagaacagatgatcatctgttataaaatggtaaaactattttatcaaatgaattcatttacatcataagttatataataataaaatgtttatttttaaaagattcctcaactcctgaaatacaactatttacaatgcatgtggctgttacttctgatttcactgcacatttttaaacaatgcacttagcccatcttatctattgacatcctaacatcatagatgagcattttactctcttacagaaagattcttcctcttctcaccctacgaaatagtcactacactttggagtaaaattaacaacgggtgtttacctcattaggactataaaatccaagtcatttactatgattaacttcttaccttgaacaactttttgttttcctgtaattgatacatcttacttttagaatgcatagtattctgtgtaactagtgatattttccctaacacttctgcagttatataaaatcctcaaaatattttatcccatcaaacgcatccaaaaatggatccatcccattattccaccgaagacctcactcttagagccttttcaaacattctttcaacctgacctgattgcccctgaggcattcagtagaatgtttgtctcaacttcacttttctcacaggctctttactccttgaaatgtcctcttctagttgatttcctcaatacagtgaaacatattctccaatgacattttattcagcaccaataagtatccattagtttggctagtttgaaaattagttcctcttagaattttgaagacgttaaccattgttatctagtgctcatggttactgtgaaattctgtgccgttttgtcgctcaaacttttgtatgagctctattttcatccagaaaaaccctacaagttgtatagagtaatttttattgttttttttctgaaatgataacgtaattttatttggctgatatttttctgagtttcacaacattttcaatctagcaatttctgtccatttctgagactctttttgtattgtttgacaaatactgctaatctactttcttgttatttcctgttgtccacgtcttgatttcactttaaattttcatcattttctaacacgtgcaaaaattccttccttttttttccaatctattattttattcagttataacatttgttattgtctgcagatatttcttgtctttgaatgtcaaaatcctgtacatggatacaaaatttctgttatctctctgagattagtaataactttgggaaggtttttttgatttactccattatatctattttctttaagtttttgtcatgcatgtaagtatgtatttttttgttgttttttttttgtattggaggcttttacaactatccagtgaaacacaaaacaataatataaatgtaaatttctgctttttttttaaaaaaaaaagaaaaaaacaaatatttgttggagacagagactcactctgtcacccaaactggagtacagtgtcacagtcatagcttatggcagcttggaactcctggtctcaaaagagcttcccatctttgcctcccaattagctaggactacaggtgcaagccatcttgactgcttaattttataattttgtgtagagacagggtctttctatgtcgccaaagctggccttgaactactgccctcaaaggatcttcccacctaggccatctaaagctctgagattccaggcatgtcccatcgtgcccagcctaaattctgtttttatcttatgaagcatggaggacattttctgattagtttactataggattttggcataatcagatgggtatttgataaagcaccccagatgccagtatttctaatttctctgccatcacttcaatttattcagtgaagaatactgcagtctcttgctccatgtgggtggaagggatgtgcaagattgatggatgggcaagaacggcaggagaagccagtctagctgccaatgttcttgggatatggcagagagaggggacaaaaaattacactccttagtaaaaataatttcacttaatctccatttttagacctcttttgtgcttggtgtcctaaatgcagaggcactgccacttaattcctgtaaaaaataaatctatctccacttttctggtagtaaagcaggatgagagatgggaggagaacatgggttggcgctgggaaaaggatcgaagaatctagtgacgctatatacgtatttttcaaccaggtgccctgtttatagcctcccaccttactcctgcatggaactgcacccaggagctcaggtgttatgcctctccaggcctccgcaagaatataggcttatttcccatgggtggccctcctacaggcagtcaattgccctctgtaagctttggtaaatcagctgtaatcccttcattcactttatttatttacttatttattttatttgagatggagtcttgctctgtcacgcaggctggagtgcagtggtgcaatcttgactcactgtaacctccacctccggggttcaagcaatcatgtgcctcagccttctgagtagctgggattacagtcacacaccaccctgcccagctaatttttgtatttttagtagagacgaggtttcaccatgttgaccagcttggtctcgaactcctgacctcaagcaatccacccacctcgacctcccaaagtgctgggattacaggggtgagacaccatgcctggcccctcattcactttctacctcctagaaatagatttacctcccttacctgcttttgtgtctttcctattggtctttgtgtgtttatacatttatttttattgctatcatttatttcctgtaacttagatgatctcaggtggaagataatacgtgtagtatgaatttgcgttgaaattcctctgtgtagacacaggtgtctaaaagctcttctttgaccatacaattttaacactcaactcaagttttcttggtcacttaacaaaataacatgactttcatggcaacgtcaaaatggtaagcaatagaattattgaaattttcactaaccatgggagtagtcacccaatcatactagcctaacctaagctcatagaaatacctccactttccaattcctatcaaatattttatacacctcacttactagtattaaaaaaacaagctgatttcataccaaatactctataacatatagattgtcaaatcctaaaagttaagcatatggcacatgtgaagaacatataaaatttcttattatcttgatagctgggtgaatctggcaagacatatctggctttctgggtttattttattttttttactttctcaagtggcactatcttcatttttatcttcacattctttccaaagacttcaggaccaaggaggagataagagaaaagggaaatacattaatacattttagagcaaaatgaatgaatgagtagcaggcagccaggtatggtggctaacacctgtaatcccagcagtttgggaggcaaaggggggcaaattgcttaagtcccaaagttcaacaccagcagggcagcatggcaaaatcccatttctacaaaaagtacaagaaaaaaaataagccgggtctagtggcatgcacctgtagtcccagctacctgggaagctgaggtgggagaatcacctgatcccaggaggtcgaggctgcagtgaaacgtgatcccatcacaacacagcaagaccctgtctccaaaaaaaaaaaaaaaaaaaaaaaggaaggaaggaaggaaaaaaaaaaaggatgactagcaggagcacagaaccaagaaggacaagaaggactggagttaatcaatgaccctgaagcaggtggatcttccaaaaatacatttttctaacactctttaaaatcttctcagagattctccattctccaggttccagaaactcagttatggtcactaagccaaactgaaaaaaaatgaaaacttctttgtcattgaacctgacaaaaactcattttgtgaatgaaattgttctttttatcgtcgttgtccacctgttgtgcacccacgatggactttaataccagtcgtgtctgatgtaattgctccagctgtatttgatggttctggagcggagtttggggagcaggattttcagcacatcagcccttggtgaattaacctttctttgcatatgtacttgctacctattgattccttttgctttgggtcacttcttcacttcaaaaactgtcctccacaatatgcacgttgctttactttaaagaaggaatcaaatatatttcaaagcctctcaaaatctctattgtaggcaaatagcttatgtaatgtgaatatgcacatctgttctgaagatacaagcaaatatttgtagatagcatacagatatcatgagttatgtatctaagaaaacacacatgaagggcctctgatataaggattttaacacatttcagattttaaaaatgttcccattgataacaattagccaatacttactgagtacttattgtgtatcaggcatagttgcaaatgctttacatgtattacttcaatcaaagtcaaacctgtttatttaaagcaggtgtacacaaggtccccctatctgaatattttgattgaccactcacctgatttatttttcaattttatagatagatgagttgtctcagtgataatgcaggacatgtggattcagaaggatcagaaggatgactgagtctctgcttcacttcgcaatggggcatgtggccctggccaaactgtttaacatctttcagaaccagttttctgtttacttctttataaatgaaagaactgggtttgtccctgaagtttactgaatttcacttcctgtagctgtataagtggaatgaaagtacatgctcttagtctcccataaggttggctggatgttcaaataagataataaaattgaatgcacattttaatttttagagtgaaatactaatgattatttaggaaggaaaaactgcccagaattcaatctaattttatgagcttccagagacatctggaacaaaataaatgcatcttcatgttgattggaggataaacatgttaaaataaagaagatatatatttacataagtagagaaagataacttgaagcaggatgtgtatgtaatttgagaatgatctctcaacatgtgtgagcataactcaagtttacaccttaatcctcatatccagaatgcaaatcagactgaaggatactttatgatatgcaagtatttttagctgaacaatgacttttaccaatactcgaattgaaagagttccaggccgggtgtgatggctcacttctgtaatccccgcactttgggaggccgaggcaggtggatcacctgaggtaaggagttccagaccagcttggctaacatagtggaagcccgtctctactaaatatacaaaaaaaaaaaaaaaaaaaattagctgggtatggtggcacatgcctgtaatcccagctacttgggaggctgaggcaggaggatcacttgaacccaggagacgaaggttgcagtgagccaagatcacaccattgcactccagcctgggcaacaagagtgaaactccatctcaaacaaaaaacaacaacaaaaaaagagttccaaactatctcccggtatttggaacacatttccttgttaggctaatatcaaccatcacttccagatctcaatgggacacatcgcgaggcccttaaggggctgcagacatctgaaacccaactgtcactgtccatctgagagtgactgatgtgcaagtgtcacactgacatgctaaatacatttgtgattgagaggtactgtcttaggtaggttcaccctgtacaaacacagaaggatggtgatgaaatacaagttaaaatttataattaagttcactcaaattatccttctaataatttttatttggcaaaaaactaaaaaggactataaaattggatttaacatgtgtcttaatttaaaataactcagatatactcgaactgtaaaaatccaaagaatttattgcatgctgtcaacatgcccttcaaattactgaagttaattatgtaagatcatctttcccttattcacaagcacggttaaaaatatcaactaaagtgactgaagcattggcaatccagtgttgcaaattccttagagaacgtttgctttttacaaattgccattttactttatgtcattttgtacttctgatgttattgcatggcaggaaattgaccagacatcgcagtgttctccagtgggtgaaggctaattcaattagtcactgatttgaaatgtctgagcagataaatttgtcttaaaaaaaaatcagggttcattcaaaggaagagactccttgtattcggaaaataattttaaacactatgagctgttacttctcatttgtttgcaaagaagagcacagcagtaagtaaaaaatcaaagttggataatacttaggttgagtttttatcaattattctcttgtctgtagccatttcaggcattttaagttgtccttctctgaacaattagttttaagatatccaagtcttctgaagaaaaaaacaataatcactgccatgataaagccattttgcctataatacatattgataaataactacattagtaagcactactaaggtaagagatgttaagtctattaccagtgaatatattaggtgttctatgtacacactctcatgaaattactattccatacctatctctaaatcttaagccaatattttcccccatgcaaatttggaaattcttattaactatttttaattttaacagagttgtaacagtacctatacttcggttctatgttcagttcttaaatgattttattctctggttctaatgagcatgaatcttgcatacatttcttcctcaaatgttaataagtctgtgtgtgtgtcgttcacatagcattagttcatcaataatgaacttcttgtgtcatgtgacttacgtagctagagaactgttagaattcacagggtcgactgacccaaagtttaaaaggaagttgtaacagttgagatgacaactttacaagtcaaaggatgtgctgactcctgcagtaccataccgtgtgtggaagcagaacatttgaaactttccaaaatgattgaaaatgatgtatttttttttctaaataaagacgataggtagatataacatggtcagagattcaaattggcatcattttatataattgaatctgacaaataaaccaagccagccaaattagagttcttaggttagctgagaaatataatttgtttcatgatggatttccattcaaatatgaaagagaagtgatttttattaagcagcaaaaatacaaatgccatacttctgaaataggataattttttccagataattagatttttggtattttagaatcagggttttgattcatttttaaaaattcaatttatattatggagagctaactacaaagtctgccaatttcaccagttataagtgtacaattcagtgacattaagaacattcacaagattgtgtcaccatcaccactatccacgtccaaaactttttccttacccccaacagaaaatctgtaactgttaaaaaaaaataacacccaagcccctggtaaccactattgaaatagagccatttaactgcaaagacctctactgcatagattaagatataggaaaatgcaaaatgcaaaaactaatttccacctgcactactaaaaaccaattaatattttttatatatatttttttccgggcctgaaccaaaggagactctccataatcagaccagtttctctcccctccctcagtgctgatttcaaatattctatcaacagctagtgtggttcaaaagacttagctatctctgctttcaaatactaacctctaccagtggcagcagataaacgtttgctggtttagttaacagaccttaccatgtctcttctttaccaaaaataataaaaataaaaaaaggaaagtctggcagttgcatctcttctgccatttcccaaccagaagattaggatctactgcacaccgcttagtgctacacacaaagcatcagtctgtctctcgggttgccaccaactactgcaatgctcagcccaaacattttgtcattctctccatcactccatgaatgttcaagcccctgtgcttttgcacataggtttttatgaaaccaagatactgtcgcttctggaaagccactattcactctccagaattcatcctgaatgccaccatgtaggtaaagtgttgacagctcactgacctggtggttgcttttataatttgcaggacgaatggatatgtaccttattgtactttattataccattatcatgggattgcgtgtgtgcgtgtgtgttggtctcctgctcactgctatgctagtgacttgtacaacaaacctaatgcttagtaagttaatgttctataagaattacttaggcattttcaatttgctagggcaaaatattttacatagacattattaaatatcagaatattggcatttccttatataatgaggaaagcattgtaccccagataaaacgagatggggatgctcttgccaagatccagtagggcaagttagcatgcatcatctataggagccagttcacagaaaatctttctattcatattcattcattctctctctctctttctgtctccatccattcctccacccaagtagaagacaggccagtgtctaggaaataatattactcttatctcacaacagctcagttctatttttatctcaaaaagccaggttttattcaaatacacatagggctgtgcttttgaacatgttgttcattttgagcccattgatttcgaggtgtgtcaatattttggggacttggagggaagattcctgcggctggctttctcttccacactattgcactatgctccactgttttgatttcctgagaagacaatgaggctgctatgtggaactttaacactacctaatttaattgtttttctcaggcagtagtgaattttctctctctttacttaaacaagtaggatatagtgtcactacgagtgtatcaaaataaaggtagtttagagtttgagtttgaagtatactacggttaaaactggatgcaaacatgaaacatttgtgtattttacatacgtaccatgccttccatggtccgtatattaattatttctgcaatacctaaaaattgaaatgcaaatgaatgtccaataatagcacacagaaatgacaaaagtattcagtttcacataaaaataatatataaagtaattgtatgtaaaaattctatacacatttagaaggcatatcctactttattattggaggtacacagtgtagagggagaacttgacttcagactcgaatcttgtttcttactctgccattcattcactttgggagctgagtaagttgtgagtctctttgatctgcctgtaagtgatagatcatttgtctgtaaaatgggaataagtaaatgtggcaaggggatgtgtattaaagtacccagaacaaaaagattcaaaaatggtatcagcttttatgctaatgttatcattatttttatcttcatcaactttacaaacataattcatgaaagatgtttatgtgaccaaaatgacatcggtcatttatgagctccattataaccccattctcatggaatagaggtttcttcttaaactatatgatatattatggtaactttggacaacaggtggtatgaacaatactaatgatcttgatttttttttaccagaaatatctctactctttacaatgataggaagcttgtgtgacttaaacacatcataaaaacacttaaataaaaagttataaataaatagcctgacaaatgctatcttaactcaggacgtggattctgaaagagcaagtgtgcctgccgtggttctttttttgacaaaaccaaacaagggtcttaattttccaactacagaatctcaaaaccaggtaataccctagctctagtcatcaaaatcaaagtatggtagattttgaaaattttttcagtattttattaagaaaggaaagtaacgaagtgctttttatgtaataaaggttggagttaccttacaattccttgttaacatatgatatcagtgtgtttacagaagaataataagagtgttatttatggtcctttgtagagaaaaatctagttattccagggtaagaattgacttagtcttaactaactttggtcttaactatgtctgtgactttttttggatctcatttttttcatataccaaattcagacttcaaacaatctgaaccctggggtcccttccaactctcataatctatagtttttgaactcaaaaacaaagcatatgctgacataatgatattaatgatatccagtacctttaagttgataaagtggttaaaaattattttatataagcctcttataaatgctctcaacatggattttctacacattcatgcttaaatcatgaattaactctgatactaaaaaataatctcaacaactctatggtaaaatagaaaatacttataaagaaatgtttagaagaaactcttttctctaacactacaataattcaagtttccataattctaaccttctgaaaggaaagctggcagacaggtggtatttgccataattattataaaactaaggaaatgatgaagaatttatttttatctgacataatttcttgagttttaagccagaaatatatttagcagtaggctatgtttaccacacattcaaagactatgatttctaattgcaaatgcatgcatcaaaatgtatagtcttattcttacttccttgcacacatatgactgagaactattctgaaatatatatatatatatataatttgcttctatgattacattcttcatataaatattaccaacttttatgtcctaattcctctaaaattaatacaattctcattattataagtagaaatatagaatttaaagataagttgatttgtctcattaattttaattcaggaagaaatggactgtaatccccttttagctcagaaatagtagtaggtgatgacttaggacattttctataaaataaactcattgggagcaaacatcatgcatttgaaggataataaacaggtgttagtgatcaacatttatcttcaaagcagcagccaacaattgaagaaagtcttaaagaagtttagggaaaaagccaaggtgaagaggtaagcgataccatacccgttttcaagtatgttcaagcctatctgataaaagaaagagtaatatcgttatacgctgcccctgtaggtagaaatgagaccacacacgtagaagttataaaaacagagacttcaggcttagtacacaaagatggaaatttttgtgtcctgtaagagtcacaaaaccatggaatgggacactgatattgttttgctctgtcaccaccaaaaatttcatcttgaattgtaatcccctactcccgataatccccaagtgtcaagggggagaccgggtgcaggtaattgaatcatgggagcagttccccccatgctgttctcatgatagcaagtgaattctcatgagatttaatggttttataagtgtttggtagttcttcctgtgttcattctccttcctgccatcttgtgaagaaggtgcctgacttccccttcacctgccatgattgtaagtttcctgaagcctcccagccatggggaactgtgagtcaattaaatatctttcctttctaaattatctcacctcaggcagttctttatagcagtatgaaaatgaactaatacagacactaagcaatattcaaagacaaatcgttgactttccttcaacaaccctgaatttaaaacttttgctttaggtaagaaatattgtttgagttttgaagattaccaacacattttccagctatctaaatgacaggcatcatgaagttaggagctaggtgttgtcttgttaattgctctatttcctgaatattgcccagtatctggaatgaagtgaaactgcataattacctgctaaatgaacataggtactgggacctaccttgtggagagtactcttgaaaatactgtaagttaactctccagcatagccgtcattttaaaaattaaaaatcacttggactttctgtgtgatttgatcccatcgttttatattttatatattttaaaagatgtagtaaagaaggtaaaataatgcatagaacctcaattataagagtgcttgggcaatcaaaggaaactcatgctactgtataggtattaaatataaaacacaccaagaaatatgcattaattatccaatatcttgcagaacactttattactttttagtgcctttttggttcctctcatcatattattgagagaaagcattttcttggaatttaaaatgcttgagggcagggactttatctcattcgctttaggtacatgataactgcacaggccttgacttataggcgaagtcaatagagttcattgaacaaacatttgaaatcatttcagtgatttttgtgaaatttacttataaatactatttgcttgtcctgaagcattactttccccagtatgggttttagaacattttctagctcttaaattatacattttcatttgataaaataaaaaataataccatagaaactttgttgaattctatagaatcctacagtttacttcagcttaatgtagtaaagactcaaaaacatctctgcaatcaaacataaaattgacttaaagtgttctctaatttcgtatctctacaaatcttccaaatgccattaagtacactctattgaagaataatacccattcattatcctgaccataagcagagctcttcaaggcttatgttgtgataatagacttgctgatgtgcatttatttattttttattcacccaaagatgtaaaagggaaacttagaattttatgtaataacttagctgttcctgaactgagtataggtataggaaaacccattattcctttcaaatcaacgtgacaaatccaacacaatcacacctggctgaaaacatttttctccaaagtctgtctgtttcttggaataaaaaggaaaagtaatttttacaaagctaagtcacttaataacaagccatccaaagcaagaaagttttagattagcctctctggaaattattttatttacttatttattttagacagagtctcaccctgttgcccaggctggagagtagtggtgcgatcttggctcactgcaatctccgcctcttgggcttgattcttctgcttcagcctcccgagtagctgagattacaggcacatgccaccacacccagctaattttttttttttttgtatttttaatagagatgagatttcaccatgttggccaggctggtcttgaactcctgacctcatgtgatccacctgtctccacctcccaaagtgctgggattacaggcgcaagattttatttttgaagagcacagtctcacaatgtctcacatgtcggttagcacttagctgcaatattaaaagtttcccttgattatctccaatatttatatttggagttgagatatatttaaatttttgacagaattttagcagacacaggctatatataaatcactacatgttgatggagaatgatcattacatgaaaattatttttaacataataacgtgagagttagttcaggcatacaatctttgaaaaaagattggagtcgacgttttatgtataacaaacatcaacatatatatttttaaaattctgtatataatagcaggaatatgcagttggaaggcatgtacaaataatggttagactcagagacctaagagtaagacagatgtcgaaggataacacctttggtctttgctctgcaatccacaatatctgactagaaggtgattttttgagcctcaaatctttgtcaggaaaatatgggatgataaaatacagtattgagctgtctcccaatgatgatgtatgttattaagcattataactatgttgcaactgtatcaactttcacacaaaaaaactatgatggtttatgttgatatactggggtttaaagagagagacaaagaattattcgacaatagattcaagtcgaaattttatatatgttagtctgtgagaaaatggatgtttttttctagagctctactagaaggcattcacatacagcaggctggggaaagaggcttctccccaaaatctgcaataaacatttatctaccaagaagggctaggtccccataaaaaagataatcaatgtgacctagtggttccagcaaattaagagggaaccaaggtcctactgtttttaattcaccacggtgacttttctttccaaagttatgaaaatatcagaaaaaaagtctccaaggataattaatttcaacttacgcttattaaagagaatatctgctgtatatcatttgaagagagactgtagattattgagttaaaagcattggcaataagaaaagaaaaagaataattgcacacatagcaagtattccttttacttcctggctgtaagcggccttattgaatgtgggctactttgctttaaccttctaagtatgtattcatcaatctgatagccactaaaaacagaagtcaagttatgtcagggctgaaagcaaaaggccaaatcacttatttttcagatgaaggaagtgaagcccaggaaggtcccaaaactggaatacagtggagtttggactagaaaccccatcctgtaggctccaggtacaagtattgcatccgaacaaaacaggtgttactctgaagtgaggtaacggtaattcaagaagtaggcaaagggctattaccattgtgagctcttcagggtttcatctgatgtgctgagacaatgaagacacggccaactgtttccataataaccactatgaccagttgtggaggagtcatgaatagtgtatgcattttttttgcaataatagaaaaaaacccagcagatactacttatgaaactcagcactctaagataaaccaattagaggattaaatagtatttcctatgttgctcacattggccatatgtgataaaacataattttatttactatgagaaaatctgcttgaaaaagaaataggtgtacaacagacactcaaccctttctggtttggactggagcttttgtttacttgcaggtaataatttcttaagcataagtgtcaataattggttgacacatgttctcacctattactgggataaacattggataaatatggacataagggaagaacagacactggagaatcctagagggagcagagagacaagggctgaaaaaccatctattggaccctaactcactgcctgggtgacaagagtatccataccccaaacctctgagttaagcaatacacctgcgtaacaagtaataatttatttacaaatgtatggagtagctacctcagaagttgcagctgttccttctctcagtttctttcaatacatcttaacataattatcttatctatttacatactacattaaattaatgaaggcattttaatgaaatataaagaaagtttgttcttaaatacaattttgacaaaaaatacaaaaactgacttcacaatgctcctataatattacgttgttttttatccttacctctgtggcatgcctagcattcaatacttacaaaattattgggactgatttgttgttagtatgtccaaaataatgcaacaatttataaacagcttaaagacaagcacattgtgtgctaaactcatttgctatgaccctcgtccaccctaaataggatgagaaggtattttactccagcatttttatttgttttaatataccccatgccatgtccagcatgtccttgctggaaatgagcttcactttcatggcaaatgtgatatggtaggtatatgacacatcacttcctctcactgatatttttattaaatattcatttaagtaagtgccactttggggcaactgtgcttaaagaaatatagagggacattgctggtcagctataaacataaaaaaaaatcctccagagcatcaagtgtgttctgaagcagtggaatgagggcagatgctgttgtctttctctcctaatagagcaatttgtcagatgtctcccatgtgtactcgaactgaccatattatgtgttggcaaaatgctcatttttatacagcttttagtatcaacagttatattggcgtttctctcaagatggagcacatttatatcaacagctggccttaaaatgttcctatagtaatgatcatttgttttgaacttttccttgttaactattttctgtttatattaatttatatttaattgaatacatattcccttcaataaaagccaagtgagagcaaaactctttctgcaaaggtaagactgaacttaacattcttcctgaaataaggcaagaagggttatacgcccttctaaccttgattgaaaacgcagcagcacttaccccaggcccactgagcagctctcctcatggcacaagttgaaaggatttcaggctggaggagactgttgtgtgtgaggggtgggtgcatgtccacggactcatgcacattgggaaagaaggtctcatctcttctgggctttcttcacattggcatgaaaacgtaaattcacagagctccctttgagagggaacacagcgcacagtggctggctccagcccgcctttgggtggatctcactgaaatcactctcctgaacacgcacccacccacagctgctgccttaccccacgtgcagacccagatgcctcactagttgacataattgttaagtgagcgcctcctaaggaggtcccatttgaaaactaagtcactaagctacaaattaggttgcaggcaggttcacctgctagagatgaatgcattgaaagtgaaagacatttggcatactgcagcgcttttactgaataagtatagggctggcctgataggaattgactaagcacagtggaagaagacccatcatcaatacttaatcaactcattcattcacacattcgaaggtgtccaatacccaagacctcacaagctatttgttgctgagggtcctgcacaggtgctgtatttacgaggtttccctgttgatgtgtgcttggccacaatcgatgtgagagagatacacattcacttttacagccagactcagcatacctgactttgagaagtgtgtatctcgatcatggccacgtgagttctgggtagcctattccaaaggtctcagtcacgtggccctggaagaaacatctaattttcatgtcataatttgggatttatttttatattataacttgggatctcacagatagagacccaaccttttaagatataattgcaggtgttcaaaggggggacaggcaggtggaggtatagcagctttttcaactcaagggtccctctaatttgagtcaggacactctaatcttggaatctaaagccagaaggaaaaagccagatcacactgactgccttaacattattaagccctctatgtttagtttgggtggagggtatgtttaagtcaaagaattgggccctacttatgttaaagatgttaataaacccagcatctttgatttcactaaccgctcctcaccttgaaaaagctaacagatttactatattgccaagtaaataaattaactatgtttttcaaatggcttcactgggaattcacaccatttaaaacactcaaaagtagcctctggtgcttttttgaacaaaagtaagcagttagaaaaatatatgggccagacacggtggctcattcctgtaatcccagcactttgggaggccaaggggaatggattacttgaggtcagtagttcgagaccagcctggccaacacagtgaaaccccgtctccactaaaaatacaaaaattagctgggcatggtggcaggtgcctgtaatcccagctactcgggaggttgaggcaggagaatcgcttgaacccaggaggcggaggttgcagtgagctgagattgtgccactgcactccagcctgggcgacagagctattgggaacagtcagcacaaagacattaggatctttagaaaaaataactctggagaaagtagtagcaaaccttaaaaatctactttgaagagcaaaatttcctattatttcctctcatcgttcttttcatagtcacttcaaatttccaggccttcctggtgttaaatgatgttaaaacacgtcttttctacctgactctactgagtctctaattgtattcaagctaaatttcatgtacaagttcaaatgatgaactaggaggacacatctcatagaactgagagtctaatttttttttagttgcagtaataaaatagctgctcacatttatttaagcttagtaagagccatgcgtggttctatgctttttacatgtgtttcttcttgtaatccttatgatattgagcacagttgacattccctttgtaaagacaaagaaaccaagtgtcaagaagtttaacattttccacggccacactatgaggaggagagacggaactcgagcttacttagccgtatagcagatgccgtcaaaggtacctttagaacacttgagtgtgtgaaagctaagggaaattatttctatcataagatactcactgtctacctaaagaaggagctagttttcacttttttgaaatcattttttccttcaatgtatttaaatcattaagaaatctaaaaatgcaattgtctaattgttctaattggagcagtcctcacaaaatatgttggtgtggtgaaaatgtgtttagttcttcagaattaaatattctgtagtgacaaatatacagatcaaatcatattgatataaaacatattaactagttggccacgcgtggtggctcacgcctgtaatcccagcactttgggaggctgaagcgggtggatcactaggtcagcagatctagatcatcctggctaacacattgaaaccccatctctactaaaaatacaaaaaaattagccaggcgtgaaggtgggcgccagtactcccagctactggggaggctgaggcaggagaatggtgtgaacctgggaggcgcagcttgcagtgagccaagatagtgcactgcactccagcctgggcgacagagtgagactccatcccaaaaaataaataaataaataaattaaatagttaacacaatgttatcacaaccatgcattttttacctcaaataaattatcgttacttcctatacaaagcaataaaaccctgtaacacgcacacacagagagttctgtgtcaccagtgacagctctcagccatctcctgagcttcgaggttggatactgtgcttatccagctgcctgggtaatcttaagtttaagcccagaactttcctagcatgctgctcttcccagagtgtagccacaagggctgtgtgcctattacattaggagagaatcagtgcctcagttgcacttagagccccagcaaggagcaatagaggcggagtgagatggagaggcaggtctggtcttgtgtgtgtgggaaggaaggagtttgtcaggcgaggaggctttcaagaggcctgtgggcctcctgggagaaacactgtaaaatgaaaggagaattccttagactgagctctgccttttgggtgagatattgaaatcctctggacaaaaataaatgagagacttgaatttgtgaactggaaggtcactttgaattcaaaaatcttatctagccaggcatggtggctcacgcctgtaatcctagcactttgggaggccaaagttggtggatcacttgagatcaggagtccaagaccagcgtggacaacaggacaagaccctgtctctgcaaaaagctacaccaagtgagctgagtgtggtggcatgggtctgtagtcccagctacttgggggctgacacgggaggatcacttgatcccaggaagttgaggctgcagtgagcgaagatcgcaccactgcactccagcctgggtgacaaagtgagactgtctcgaaaaaaaaaaaaacttattatctatctgtactttgcccagcaacatggactagtatgagcaacttgtccttttcttcaatttttttaaatttaacaattattatttcacttagagaaggttgacatagttagaagaaaccaaacaagattcaagcgtgaacaccatgatgcgtgcatctttgcagatatttcccatgtgtgtacaagtagcctgccttttctgtacctgaaaatgggatcaaaatatagatattatttgaaacgttcaactgaaaacgctttaccatggaaacacattcatgaaggcagtacagtgtgtcatacaacaatctatttggccattttaggatggtaaacatttaagctctgtccaacttttcagtatgagagagggggctacagtgaagaagcccctactggagcaggatgtattaactctctagattgaaacatctgataatttagaatttgactgataggaccgaattatcccctcccctcatttttctagatatccaacaagagtataagggagtgtcctctctgtgcacaaccaaaacctgatatcatcaattagagtttcacaaatgcactggggaaaatgacaatgtttaatgcactgctttcaatcaattatacacttgggaatcttttcctacatttattatttatgtttgttcttcctataaaatacctatttgtacttaatggttgctaagctctttgctgactgtgagatgatctttttatattacttttctagaagagtgtgtggtgaacagactcttagggggccatgcggcacccccacctgctgatgtccgtgccctagggatccttttctccttgagagtgggcaggacccgtggcttcctttcaaccaacacagcaaactgacagtgataggctacatgtgattatgtgtacaggattatgtgattacatatggaattgtagcactcaactgtggagtctccctctcaccctctctctctcccccaaccccactcctaacctggtttgagccatgctaggaagtcccaggtgacaaccgtgtgtggcccccaggaactgatggtaaactctggccaaaagccagcaaaaaacttaatgcctcattcctacaactgcaaggaactgaattctgccagctgcccaactatcttagaagtggattctaccccagctgagcctcaggtggcaatgaagtcccagccaacacttgatggctgctttgtgagaccttaagcagagacccagctaagctgccaagccatgcacagacccctgacccacggaaactatcaggtaatgcatgtgtgctgtttgaagctgttgcgtttgcaataataatgttacaacacagtagttagctaatgcaaaaagtattcaaatgggagattgctcccccaatctgtccttctatgtagctctgttttctagctcttgagttgttcctggtggcatctggtcctgcggagaggataaacctgggtaacagagaatgctataaaattatcttgctacaaatactgttggctttctgtctctctccctcatttggagacaaagaacgggtattgtcattaaaggcattaaaaagtggctcaaatctcttcttctgattttgaagctacagtaaatgacaccacatctttaacttaggtacttctttctttctcataggttctattcttaaaatataaaaggtaagaagaaatgatagtcacttcaacttgtcatataacactttacagtatttttatatggactctttttaaaagacctatcattgtccatccatcataaaaactgaaagaaaaacacatttgctaggagatatagatcataccccaaagttcggcttggctatactttttatactttcagttccgtagacgcctcagcttttcaacaccctgacgacatgccccttccgtgtctcttgttgccagcaaagaatgcaggaaaggtaattttgtaactgcagttgtaaaagaaagagactgattagctcttctttgttccataatcctctaatgtaattctttaaaattaaaaagcggagagataaaatagtcatgaagatcaaaatgacaattgaaggctggcatatctgctgaacaagctctaatattaaattattgtcaccagaagaaaaaaatgcaaacatctcagataacttactcagtatacaaagaaaaacagtcaagaaacagaaacacaattgaatcaaataagcatggcaaaataatatcttgaatatagggtttcaaagctaattatgttgacaagttctagtctcagtacatgagtcaataagcaggcacagtgactggaagaaatctttaccaacaccttccctaggtcaactcttcaacgagtgttttcacaaaatgttgatgacaaattaatttgaactcactaaaaataatggctggaatcaagtatattacatagactgagaacatttatttatttattaaagaaacagtgaatgtgtaagaaaccagaatgatgcttggatacttgcaagagtgcccttcagttctccaggactttaagatttatgaagtccaaacaatgtaaacaaatgaatgaaaaatcagcaagcaagaataacactttttgttttttgaaatggaatttcactcctgtcgcccaggctggaaggcagtggtgcaatctcgactgactgcaacctctgtctctagggttcaagcgattctcctgcctcaacctcccatgtagcttggattacgggtgccagccaccacacccagctaattttttttttcgtatttttggtagagacggggaagaacaacattttttaaaggaccctaaacctacagtttcctacatcatgactaataatttttaaacatagtaactgacaaaaaaattagatcaaggagagattgggtgatcaacatatgatagaactagaagtggactcaaagatgggtgggcttgagatacatggaaacaaagctcaaagttatggtcgatgaggtggaatagaaaactcctcaatggcgagaaaactgaaggtatagttagggtgtacctggcctggctgaattggaagtcacaagggcagatttgaaaagactgattatggaggactttgaaagtcagtttgggagagagatgctgtaccctacagagaaaagcatgtacagtacttaagaaaacaagatacatggccagtaaatcaaaaactgcttttctttccacactcagtgtcctgttggtattacatcctggaggtcattagaaaaactccagaacagcaagagtaaccatcacaggacttgaagggaaaatgtttaaaaatgtctaatgttctagcttccaataagtagatgatgttcaaacaaacatatgaccccttggctgcatgagagtagaaaggagcaaggcctaacataagttgcatataaatctgcatatttcagggactagtcccatgacagtagtgtacgcttccgatccgaccttcagctttaaagagcaatgaatcaatgtctgagaagggtggccctgagcatcagtgtttataggaccatttacctgcttgacgtttcaactggccctcactgagctaatgaaaaacacaaagttttcttgtctgttctccggctgcttctcctcaacatcctcatcttcagttcatgatgttgttcctgttcccttcctcctccattatttgacatagattagggtagtcatagccttttgtaaaggggaatgaacttgccagatagatggagagaacaaaccacttgactgggcacaaagcacaaccacttctatgtgggtagaagatcctgcagcaaggaggatgaacagcagaaggaaaaacccccagattcttgccagaacagaaacccatacttagtgtccttgggctgacctgttctaactggaatagtaaaaaacacacccctgggtggagatctaagatgctagtgagccatgtgatatatgtgctagcatgcagagcagtggcacatatgcatccggaagaccactggcaaagtcaaaatggaaactcctagaaagcactcagagattcatcctctttgttaaaaatgtgatgtagccatggaataccatgcagccataaaaaagaacaagatcatgtcctttgcagggacgtgggtggagctggaggccattatccttatcaaactaatctaggaacagaaaatcaaataccactgttctcacttataagtgggagcaaaatgatgagaacacatggacacatagaagggaacaacacacaccggggcctgtcagagggtggtgggtgggaggagggagaggattaggaaaagtaactaatggatactaggcttactaccttggtaatgatataatcggtacaacaaccccccatgacacacatttacctatgtaacaaaacttcatatcctgcacatctgccctggaacttaaaagttttttttaaaaaaaaatgtggtgtaggtgaataggaagggcccatgcgttacagttatactgaactgagtgattctgtttggcacatgccataattctttaggtgagcaaaattatgagtataatccttttcaagagtcaagtcttcccaattctcttcctatccccagtcatcattgttaaggatcatatcagactaaaaatgtgtatatcttccctaaatcacagtagttctacccagatcacattaatcaataaaactaattccacctaacagtaacaagatgactattctcacctgaatttcccttgatattatttatattttttaagtatggggcattacattcaaaatctgtattgtttccatgtaaaatggagcatggatgttgaacaagtgaactgcaacctcatgaatatagctgaaaccataagacaaaaacaaaataccctcacagatggattggtcttatgttgtccacaggaattctattttatgaagaaaggggaaaagagacacaacaagaattgcaagacatttggagtgcgcagaaattgtctgatgaattgttagtttcttgtaaaaatgtgactcttcttagtttgccaaggtctctcttctttttgtgaagtgccgatcatactctgcaatgctcgactatcccagctgtattatacatcaaagtacactactttcctaccaaataaaagggatagtttgaaatgtggtgactaaaattgttgatggactttgaacattcataaggcccatcctttgagataaaagtgaagatagactctaacttcagtggaatccaccattttcacaggaagtgaaaatttactcagagcgccgccaggaaagattttaggaaccacagttatgtcactaactatcaaggaggtgtaattttatagaaaagggaatgatgagagtccccgacatcctttacaggaatatcaacttcaggtagaagaaaattactcatttgttagagatcaatgaagacactttctgttaaaaaagaagaggaggaaaaagtttctctaaatagaggcatagacattcttcagtcatcttgaaaatgactgcctgcaatttataattaatttcaaaggtttttcattcatcagagatcactctccaaataattcaaattttaatctaacatttagccctttcttatataacacgaatgatatcagagtatactaaacagtaaaagaaaaaaaataattcactcgaacagtatttttatatgaaagagcataattatcccctgaagtctccccataatataaacattatggacaaggagcttgaatctctgttttgttgtaaaactattaaaaaaaagaagattagacagcattgaatgatggataccgataatagaggcactgatgataaagaagaaatcttctgaattaattgcacaatttcatagtatagtatattcttcatgaaatcagtgtgagctaaatggtctgtgaaagattagtgaaaacgttattagattttgatcacttttattgaaaggaaggtagagagatgacagattgatagactctacctatctatatttaaaatatataatacatagataatgtttatatacagataaatgcatatagtatacatcaggtattacacatatacagatatatccattgcatttttactatctcaaagttagaagccatattttactacctagcacccaatgtggcattccctaagtgagattacgtgtattctctgtatcagaattacctgggatgggcgtgggtagaaaataaatagatttctacctccatccaaaatccacttattcagaatcatttggaaaagaagccatggaatttgcattgaatcaaaattgaaacaagtaattcttaggcacacaaagtttacatagagtgttcaaaaactgtgtgtcatgcccaccctgactttgacagctataatgataacggtgacaggcgtgttcagtacagaaagcagagggttgctgcaacactttaggaaaacgctcagtgccttgcaaagttgctttaattccatcggggttcatggtttataattatctgaataattcagacaaaaagttgtagttatctctatcatatccacatcatattagtttttcttgaatttcattgaggttgaagctccccaaaatatatcacgccaaaaagtaaaaaataaaaagcactggaatctgactgatattttatataatataaaatattgagtgtcaacatgattggattggaggatgaaaattacggttcctgggtgtgtctatgaggatgttgccaaaaaagattaacatttgagtcaacggactgggaggggcagaccctccctcaatgtgggtgggcaccagctcatcaactgtcatcttggctaaaagaaagcccacatgctgagtcttcaggtcttcatctttctcctgtgctggatgcttcttgtcctcgaaaatcggactctaaggtgttcacctattggactcttggacttacaccagtggttttccggggtgtcttggactttaggccacaggctgaagactgcactgttgacttccttgctccacagcttgctgacagcctattgtgggaattcactttgtgctcctgtgagtcagtactacttaataaactcccctttatatatacatttatcctatttgttctgtccctctagagaatcctgactaatacagtgaaaaaaactgggaagagacaccaacaatttgactccttcatgtttatgttcttgatctcatgtctattataatgatagcttttaaaacatagcattatatgcattactctccgctttacaaaggatgaggcaaacttacattaaaattataagcatcaagtatcaaattatgagcattaagatgcaagtatcaaagtatccaaggatatttgggtggaatgacaacactgaaatattcctttcccttttataacttttaccaagctaaaactagttcaggatttcaaccagtaaattgcaaaatgtatcagtaaaataaaatacgtaagttatttttaacaaaaaaatatgcctgcatgatcttttttcttttcattccccaaagaaattttagatggggataaatgttgccaccgtaggtcaaagtgacactgactctaactgaagttaatttgttgaaatgttattccttggtggaatgtttacaacacatttagagttggtggatgagacagggtgcctaatggatgacaaaatctctcatcttcatagaacaaagatatttgaagataaataaacattctgcaacttccctaaagcactgatggcattttcctctcccataaagtacaggttgatacaaatggtttaaagaaaattgcaactgagctcagaaaagagaactgtttcacactctgcatccaaagaggttgatctgctggagggaaaaaacaaggtgtgcattatttccataaagctccctataatcagtcaatttcagctggctcaattatacaatgtccttctattctttttcctgtaaagggaattttaattccgttacttaccaacctcagtatcaaggactaaagtccatccaaaatagacatactggttaatcaaaggtcacttaaggtcattttaaagtccttatggaaaagactgacttacttccttgcatttaggcatgaatacctaagtgcaattatttgatttttataccaatcagttgttctggaatggacaactagtttgctaagcacaatgatcatgtaattgaaggcaaggtaaaaaggttgagttccttgaggattaattcatttcagtagagccgaaacatctatttctatttctttggctcaggttgcatatccatgccaggtctacagtaaaaaaagaaaaaaaaaaatctgcccctggttgctgtggtggctgtgccacagcgtcagattggttggacttgtttaccactgctggtctcttagtccaagttcctactttcctatcctaggagacaacaggctggtaatatttccatacaacccaaagacacaaatactgtagactgtggaagatctccgcctttacacaagtatcttcctctgatttgttagttgatcaaataaaacttaaattaaaaaagaagacatacttgacctttactatgtgcaactacgcatgcaacttcttagttatcttacagagcgaagtgagctcaaccagaagacatacaaaaggccaaagggaaaaggtagcttaaattgcatgtatgcaacttgtaatggcttattttcactatgagctcagcagaaaaattaccagaggcagatttaaaattcagcgcaatagagagtatttaatatgccatttgcattttgacagcttagaaacgtcttcactgggtttgctgtatcgtctgcttataagcacgaaccagccaccgagctttgtttatctgtttcttaaaggaagcagaaccattttcttgacatttttaaagctgggttggtgtttgcttgacacaataaactggagagtaaggaagcattgcccccgggaggagctgctttcgcctgtagaagcttcagcactgtggttgtggcagtcgtcttaccaagcatgattggccagctgaaagccaatataaaaatagccattctctctcttcccgaggcctctgccagtgagatgcttgagacatgggggaattctaccaccctgcactacttgccatttgcttctctggacttgtttgatgagacctcattgccctaccattcaagtttacaaaacctgtcacttccgaagaaagactcccttttgcgactaactacatgagtgctccagaagcactgaaaagctttccgctgaacagttctgatttgaagtcatagtaattagtaataatatcctgataatgcaacaggaaaaaaacatgatctgctcagcaatacagagatattaacttcattttaaggggttcacatttttttttttgagatggagcttagcttttgttgcccaggctggagtgcaatggcacgatctcagcctactgcaacctccacctcccgggttcaagagattctcctgcctcagcctcctgaatagctgggattacaggcatgcgccaccacgcccagctaatttcgtattttttttgtagagatggggtttcactatgttggtcaagctggtctcctgacctttgatgatccacccacctcagcctcccaaagtgctgagattacaggcatgagccacagcatccggcccacttttttattgctggatggggattaggggtttcctgcgaaagtatcttcttcacaggagtgtcctggcttcatcaggaggaagggtattgggtgcggctctgccataaaggagtctgacctgcaaattaaaggtcttagcatacttcttggtgggatgagtctttaataaggtaactcatctaaaaccatgcaggtatgggagggcgcacctctctcgcggtggagttacagggtttctctggaaactcagcagtgcgtgctcacatctctgctgggtgggtcaggaaatgtttgaattacttactttaacgaatgttccacctttctctttcgggcttctcaaaatgaggctgctctggcgtagtagtgttgtgtgtgctctcctttaggacgctttctgggtaagtaattgtctgcaaatacctgcattctcatggctgcacatatgcaagaaacaactgagaaggaaacttcttccaaacagccagtagatcagccccgggtaaaggggcagatacgagccagcatacacagaattaatattcctgtttaccagatgaaaatgcttacagccttactccttttcccctggtccctgaaaataggcatttaaagagaaaggcacacttgggattcaacctttacaatgccattaataatccagaagaaaaaggaaatcgccagtgaattttcgatatccccaacgctttattgaagagtacagcaccatcagctgaagctgatactcaagtacccacagtaacgggttccagtgacctcaactgcgaccgcctccagcctcacgactccgcaaacaggtcacgaattatgccccacgcatcaaaaactctgcgcctgccttcgccacagcgggagccgccacccgggcgcgcgcggcgcagctgcccacggcagtggccgggcgccctcctgccggagcgctcctccccgggaaagccctgctgcttgcaagcgcctccggtgggccctggagcgcgctgccgagccccggggcccagcgccgacgcccccggggggaggcccgaccttggtcacccgggctttgctaggcaaggggaacgcgacgccgccccaatggccagagcgcacaaacggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccacccgcgtgggggcggaatccgcccggcacacacgtgtgcggattattaagcagccgagctagggccgccgcggtctccacgcagcaacctctgctaattgcgggggaaggcagccggagcgtgcggaactcgagggaaccgagagtgagctcagaggctgagttgcctgcctggaaaggaggaagccccgggcccagttaggcttggagtgcaggggaaagggcgggaagttttgcggagttgcgtggcaggtgtttcctctccacgcaggggctcggctggaaaaagccaggtcctgtcccttgggctcctgccctcaccccgctgcgacacacacgccccagcacacctcacagggcacaaccctcttttccctagactttagctgcctcgccttccaattcccagccagtccagtgctgaccagaggccgctgccagtcgggccctgctcagcaggcgctgcctccgcagccggcaatgtcagaggcaccggccaaggcatccggactgagccgggcgggtgggcagagggtcggcgtctgcaagaagctccccagtcccgagcgaccacgagcttgggtgactaagacccactgtttgcgatccccgagatctcggggcgcattcccgcagacacccccttgtgagggtggatgccggtgaggaggagctggtgctgagcggtcagctttcacggagccctggacgccccgtggaggcaagtgcagggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatgtagggaaaaaagcaagtgaccattgaaaaaaaatcgtaagattggactccaacctttaaaaatgaaacgaaagaaaaaccctttgtagatacagatactcccgggaacatctatggaagtgctgactgataaagaaagcatctaaggaggctaaaaatgaggacaggggcaggtatttccaatgtgaaaaccaatcagtattctctctctctctgtctctctccctctttctcgccctgtctcaaaagggagcttatgttctttcccggagaataaacaagtacacaagctattgccagccttgaggtcgcagcctgtaggctacttagaagaaaacattccccaactcattcagggagaaaaccaagctcacagagccccaagcccaggagccacccagagaaactccttcccctgaccagcgtagaaggaggatacccgtgcgcccacagtgaatgtatctgacttggaagccggtccagaactcctagcctgtttcacgcaccttgccaacaccttacaacttgcaaggagcgaagtccgggggagaggaaagcgggggcgaccttctagaggcagctactcctcgccggctgaggacgttggagagggaaggaggagaggaggaatggggtgtatgggtgcgaggaggccgggccggcggagacctttgcctattggtaccaaaacccccgtagagagcccgaactttccaggccggcttcacccgggacgctttcccaggcgcgtcgggtccggggagaaagtcctgggaactgcccctcagccaccccgacccgtggagtccacgtctcggaggaggcaacaccgccccggcggagcacagttccagcccaactcgtattgggttcctttctccttgacaccctgtactgccgagaaaaagagatctctcctgtgagcccaagagagggggaaggaatggcggggtggggcgggggcccaggagggctggggagagcgcgatggaagctccctcccgtgcatcgcgttccccgagcttcggcgatggagcagcgccgggcagaggcggccactccgtaccctgcggtccccaaaacgcacactcgcgtccgcacacggggcctccgagggctctaccgcctccccggccaggagcaagtccgtcttacccttcgctgcagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccgagggcaaggcgagccggagagagagcccggtcccaagacccgccgcgcatccgacgcctcctgaaggtctgggcgcccggctcgcttccctctcatagcatcgggtcccgagccactgcagggctgagctgctccgagcgcggagacccgggctggcggggccggggccggggacgagcgccggccgagccgggcaggaaggcaccaaggcggcgaggctgcgggagggggagaagcggggagaggagcgcgcgcagccaggagagacctggagaggaggcagctggagagagagccagcgagtggg

SEQ ID NO: 1430 - DNA, 834697 bp, Homo sapiens
aggcagacaaccttttcttttttatttcgcttagacaaaatgcaaagagtgtctcattaaattaaaaaagaaacaagagagaaaaccaaattgattccccccaccccttcactgacggcactcatcctaattaacaacaaaagaagaccaaattgagaacccggtttctaatgggaaagaaaggtgtgcaaacgtgactgaagttttcccctgcccgcaaatcggtgttccttttaaattcacaaataggctgatttcccacccaccctgttttctttcttgcctcttgtgtgatagaacttccagtcagaaggtttaattaatcccccccatgcacttttgtagaaaatcagtaaaaatgcaatagcctgtgaagatcataaaactggacttctttcccaaaaaatcagatgcccaggcggatggagctcacactcagacagaaaaaaagcaggagagtctttgcactgtctgtggtttcagtattttctcttttttttttttaatatattttggcaattttctttaattataaatattggaattccgtaaaaaaaaggtagctttgattgaattgtttgaattgtatttacaaccgctgtccagtcatgctgtctgttataccagggtgtaagattttgcgtaaggattgtttcctttcaaatggccccgggagtcgagcagtgattcttgggagctgctcattttagctgcctgtcccagctctgctccctcccgctgaggtaatgtggccacggcccccggctgccacgactgtccttctctcgtggaggaggcggaggaggcggcttccatcgggatgggctccaggaccgtggggcgcttcagggtccggcttttctgaggttccaagcatgcttgtcctaagctcaggtccctgctggtgcctggaccacctcggtttaacaaaaagtccattctaaggtatggaggcaaatgtatgaggtcacctagaaggaaagacagggtagttagttggtgtcttcatttggtaaacatgggcagaatgtcctgtgtgcacacgggaagccatgcgggctttagagatgagaatgccgctgcacacaggtgcctttctcaagatcctccttcagcgctcaccacaaagacaggtggaatcgtcctcctacctcctccctgggcgcgggaggagctcattttcctacagtacttacttacttgtattaacttacttgtacagaaatggaggaatggaggtaacagaatccttcaacacaccatcgttgaaagaaaaacatacatcaaaggcatcagtgtccactgggtacgaacggtgatagaccaaaccccgcatgtgattggaagtacagggagagcacagggtttgaggagagagccagggacgccaagcgaagatggacagctggctctcgtcctggcaattctatgaaaccttgtgaccttggccagccacttagttatgggtcttcatgatggctttgggtgaaagcgccacagcttatggccttcttaccaggccctgcctacctgctaacttctgcgtggctcttctgtttcagccatgctgtgtatagagatgacagcagcttagaccagaattctagtgtttctacttcctgcttatggtcactctggcttctgtggtgccacgcaaacataacctcaggtctccttcaagagcatctgctggctgggcacggtgtgcctcatgcctgtaatcctagaacttcgggaggccgaggcggaaggatcacctgaggtcaggagttcaagaccagccaggccaacatggcaaaaccccctctctactaaaaatacaaaaactagccaagcatgatggtgggcgcctgtagtcccagtactggggacactgaggcaggagaatcgcttgaacccgggaggaggaggttgcagtgagctgagattatgccactgcactccagcctgggtgacagagcaagactcaaacaaaacaaaacaaaacaaaacaaaacaaacaaaaaacccaaaccaaaacaaaaaaaccaagagcatctgctgcaggaagggaggcatgtgttctctgggatgctgcaagccaatgacaagcgtgacagggcttttctcatggccgtccccgcccgatgcaggatctccctaacaggcatcctttgctcagggataccccatcagcctcactgcagccttctcagaagtgcaccgcagcctgacgtgcctccaaccaatccctccttcgccttctcctctcacaggtgtcggacctctgttatggtctccagactctccttgccacctcctgcttccttttgcttccttcttcacaagaatttccccaataaattccttgtgtgtctaatctgtcttgctaggcgcttctcaaaaacctgaactgacacagcttctttcaccatcagctactgaaaggtcaccctgacctctcattgccaaattctctggtttcctcttcgtcctcttcctacctgcattactatagcatttgatgccgttgatatttttgttgttggccctttcagctgccagggcactgtggtcttccagatctctgcctacatttctggccaccctttctcactttccttgactggatccttttctctgtctttcctctaaatacggagtgttcagtggcctgctctcaggcctctctcggaaggcttggctgctttcctcattgctttataaataacattcccatctatcttttccattttgctctttctcctgagccctagatgtgaattttaggtgctttgctaggcatttccacacgagtgtccatctggaattctgaaggccacagtctaccaattcagttaatgaaggccaaccccatcccctcccaatcccaaatactgcttctctcctgtgtgctccatcttgtgtaacattatcaccatccttccatccttgaaacctcagaggtttcactgacacctttctctccaggttaattctaccggcaaaatatctcttgactcttttttttttttttcttttttaaacaagaagagatagagtcttgctctgttgcccaggctagagtgcaatggtgcattcatggctcactgtagcctcaaactcctgggctcaagcaaaccttccacctcagcctccagagtagctagggctacagttacataccaccatgcctggctaattattattcttaaaatattctggagacacagggtcttgcttggtttcccaggctggtctcaaactcttgaactcaagtgatgctcctgcctcagcttctcaaagcactgggattacagacatgagccacctggccttgactccttctcattcccatcttcagggccctgtttcaaggctttaatatatcccatcacctccttgcaaagcatgagcacaattagggcccagccaccaggtccactttgcaaccaacactgcctgacttgagctggactgacgctgggtctgagtttctgctgttttggtacagacagtgtgccttatccagcccagtgcttcccactttttgaggaacaggcagacaaggggtatttgtgcagtacactgggatgaacccagggagctgtttctggccaccttgaggtctgaaggactcaccatcttggcacacctgtaactcgtgacataccaggtgcaaaactctgtctagagaatgggctggtggtgtgtggtcctggagcgagggcccagggtaaaggatgtgcagggagagagatatgatgatggtctgagctcaggagcagctgtgggatgtgagagagggaattaaattgtgagatatgaagggggtccaaggaaggtggcttcagagtcaatgacaagtgggagtggtgacagaggagaaggggttaggggtgactccttcccaggctctaagctcaggaaactgtgtggacagtgaaatcactaactgtgaaagggtgtataggggaaagatcgtactttgatgacaaaagatgaagggtttagtttcagacctgctgagtttgatgcagctggggacattcaagacaagatatctagtaggtatttttatcatagaaacgtagctctaggatgactcactgctcgttttctgagtctaaagtaactgaacattcttgtttcttttgcttcaaaatatcccctgctttccttatgttactgtatgctaacaataattaattgagccttcctcatccagcccctttggacccataggccccgaaggtgcaggctgaggggatctgagaccacctgagccaagtgagggctgccattagccagctgctctgctagcggggcaatgaaagtgatatgtgtttagacagtgtttaaagcctgaaccttaggaaacaccttcaagtttacccacagaaaaagaacaaccagcataacagaaggaaaggactattcaagagtataagagaactggcctgtaatccccgcccactttgggaggcctaggcaatggatcacctgaggtcaggtgttcgagaccagccaggccaaaatggggaaaccccgtctctactgaaaatagaaaaatcagctggacgtggtggtacacgcctgtaatcccagctactcaggaggctgaggcaggagaatcttttgaacctgcgcattggaggttgctgcacgattgcactctatcctgggcaacaaggatgaaactccatctcaaaaaaaaaaaaaaaaagtataagagaactaaaaataaatatggccaaatcaagccctaaaaatgcattttatacaatttaaatgagcatacaaattttcaaaatgttattacccgtcttgaaaatttttttccgcgaacaacaggagcaatgaccttatttttgggaaatgcagcaaatgatttctttgtcattgtgttattacattgttgcaccacttgggatttatgattcaaaactccatttagctttttcaggatatctttattctactaagtgatgatgagtagttatatgatttcactgggaatggcagcatgtaattcactaaatgaccccagcgacactggactgggctcactgaaattaaaggcattctaattcaacgttggcttcctactgtcaactggatccaagggaagctcagtaataaatacctagacaataaatgggccataacattttttttttttttgagatggagttttgctcttgtcgcccaggctggagtgcaactcggttcgccacaacctccacctcccggttcaagcgattctcccccctcagcctcctgagtagctgggattacaggcatgcaccaccacgcctggctaatttttgtatttttagtagagacagggtttctccatgttggtcaggctggtctcatattcctgacctcgggtgatccacccgcctcagcctcccaaagtgttgggattacaggcgtgagccaccgcacctggcccataacattcttataggaaggaattacataatttggcattcttgtaaaaagggttttggtaacttgatgcatctgaactttggcttagaaaaatataatggcatgaggcctacccattatagacactaatgtggagggttcaggaatctcttgccatatagaatagctttgttcctgaaagaatttgagtttttaaaactttatgaaacttgatggcattgaaaattactaatgttcgtttatggtagttattcttcagtcttctctaaccagggattatttgcaaaaaaagtgatgaaagcattaacagagctgtcattaagaaaaaattgaataattcttttgtaatgtgaacatccttttgtatgtgaatcaatacaccttaattgaccagtcttgcgatttgtagttttatacattcaatctcctgaaagtgattatgtctttattcctaagaatctgataaacaaattgttaattttattatttatttattttaaattttaaattatttttattcaatattatttttatcatgttgtttgtatatttgaggaaatgggacagacatttacctccagggttctttaaatatataggtcaagaatgcctcatgctctttctgagacccgactcaatcacgaacgcttgacatatttgtaatgtgttgcaacagatttggggataaatctctattttagtgactccccattgaatgcacagggcttattaaacctccacaaagtaatagcattgtggtcccggctggactgcagaatgcgcaggtcttagattggaaggaagaaacgtgtttgaaatcaaaagataggactcataatatctgcatcctgcctgcaggggctcccacttcagatgtagttatcaagagggctccagtcactgaaatggacagatgagaaataaaaatccttcctaatggaaacagctcagtgttacatctttacatgcaatgcctacatgtatttgtttattgcaggtctgacaagtatctctgaatatccaatatctctgattgatccagtttttcaggcaaagctctacaaagttgtgtgattctctaattagctcccttcaacaatgtgtattttctgattagcgtccaaagtagccctttcaactgtgtgcgtgctgcaaatgagttctctcaataattaatgcacttacagagaagagagcaccagagtagtcagcggtaagctctgttattacaggcacttatgttctttaaaaccccagcccatgtgctcatcaacaaagcctctgaggacctggattctctaattgtcctcctatatgcttaagatgcctacacatagcaagacaactcatgcagttattgatccagaaagagacacatgatgtgtgagactgtggtgaccatggggacattggcacagcattccccagtgccctgcctgccatctgcctgtgtcacatgggagaaaccagcccttggctttaattgtggtgatgaggaatagaggccaggataacattgcctgcatttatctgacaggtctagatctgggctcagtttccttatccataaaatgggagtaatagcagaatctagcatagagggctgtggtgaagagtaacttagataatgcatgtgaaagctttccctggattaaggaatctgtttccacagggagcagggccttcttgggtgtgtctggtactccccagctcacctgccccacagcttaccattcaggaccctctccagttctcccatgcagtgaaaagtagcagggatccagaagaagtccaaggatcctttgtgctttgaactccagggtcaccatattgggtcaccatgtcatgggtactcacctccactgggtgcaaatgccctcggcatccctgtgtgtaaatctatcattgccataaacactggcaaaggcaaatgcccagtcttagtacttgtttcagtaaaaccagctatgacaaaattcacttatatttttggcaatgatttccatactctatggtgtcacttcacttcctctgctttgcttccctcaacctttctccacatttccccccttccccttctccctccttctttcccttcctcctgtctctttatctctttctctcattccctccattctttcctttattttccttctaatatagtttggctgtgtccccacccaaatctcttcttgaattgtagctcccataattcccatgtgttgtaggagggacccagtgggaagtaattgaatcatggcagtggtttcccccatactgttctcatggtagtggatgagtctcacaaggtctgatggctttataaggggttgccccattcacttggctctcatttttctcttgcctgccaccatataagatgtgcctgtcaccttccgccatgattgtgaggcttccccagccacatggaactgtgagtccattaaatctcttctttataaattacccagtctcaggcaacatgaaaactaacttccttccttccttccttcttttccttgttttgtttcccttgtgctaaaacttctatccacgaaatcaaaggcatagaaaaggggtaaaaacatgaagcaggggagggacaaagaggtagctgagtgcaataagacagcaagcagggcatacacatcaagaaaagtgtggtgtgtgtgtgtgtgtgagagagagagagagaggagagagatatgggagggaaaatctaactggaagagcagcatactgaaaggggaagttgaggcatggagaaggaaaggactagcgctggtaggaggatccagctcatggtctgacggcaggaggaactgagcttgaactcacttccatgccctccttctgccctgctcacctacctgcccgcactgccggttccttcccagtgagctaaacccagttagtgtctccagcccaggcccagcatgaatacaaaggctcacagagtcctgcctgggcctttgggacagggtccccctgctgacttctttgggctgtaatggtggatttgcacaccatgaacccactgtgctctgccctgaggccaatgcccttcctgtcagagaccctaagtgagggtgagggatggagaaggtggagatggccaagcacagagaagggctctgggaaactgagttcagggactgagatgcaggaacataccagggtcaggggaggctgagatgaataaggctgggggggtgtgagggaggatggatgagagagaggggaagagacacacagagagagagagagggatcagagagatggaaacacacacagggaggcagaaagaaagaaacgtagcactctaacctgggcgatagagcgagactccgtctcaaaaaaaaaaaaaaaaaaaaagaaaagaaacatagctacgcaggtcggtagacagataaaaattagagacagagtcacaaatagagaagggaaaaggggaacatggtaaccatctgggacagtggtaaggagcagtggaggaagagggcaccagaaaggtgagtactatgagaataaatgtgtaccacccactttgaacggcccttgtggagctttaaagatgtgtgcaccatacaaggaccactggcccatccatcactggggcacccatttctcattcttttctcatcagcctcaccaaaacccagtgcagatcacaggctgcacccatcactgcctttctggagggaacccaggcagctgctttgacttccgccttgaggatgagacgctttacccattattgcagcattttgctttcttatttgacatcatgcttcatttctcatccttctgttgctgccctctggggaccttcagtgccattaatgtctccaaaagttctgattaaataggtcagcattgatttctctctctttctctaaccactttgcatactagtatcacaagctcctccttgcctctggtcctgaaatgtacagattccttctgcaggccccacatccatcagcagattcacactcagagcttgtccccctccactaacggtgcattagaaccatggttggcctgactgtgggaaaactgctgaactaaacctgcctccttttagctgaaacctaggaaagcaaaacttcctgaattttctcaatctattcagacacacgcaaggtttgaatgtatttcagttcttggaagaaggatggcaaaatcaatactgaaataacaagaatgaagcaattcagaaaatggatgtgcattccattaatccatcatcaaacaatggttcttgctatggttcttgctatctcccaggcaccacactaggggaaaatatctgaacactagatcagaggctctccactgagggtggctttgtccccaggggacatgtagcaaagtctggagacattttgattgtcataacacaggggagggtgacactattgatacctattggtcagaggccaggggtgctgctcaacatcatccaatgctcagaatagcccctgccacgaagaatgatctggcttcaaatactaacggtgctgctgttgagaaactctgttttagatgatcagaattcataaggccaagtgttccttatttcactttaattctacttataaagcattgaattcaaccaggataagcagttgtacccctcagcctcagaatactagtccacaaggagttacgacctcagttcttcatggaagaaaataagagatggtccaatggaactgtaatcagaaggcaaaacccccaggtctttctccattggcacccgctgaggcaggagctgattccagtggaaagagcagtagttacagagtgcagggcttggtgttgaaatcctgtctctgcctctgcttctgcctccaggtagttttgtgacccttttgagccttggtgctcttgcctttagacaaatgaatgaggcacaatacattctttttttttttcttatatctaaactttttattagcaacaagtaatatttaccaaaagtattgagttggatgtattttagcagtattttcttttctttttttcttttattattttaagttttagggtacatgtgcatattgtgcaggttagttacatatgtatacatgtgccatgctggtgtgctgcacccattaactagtcatctagcattaggtatatctcccagtgctatccctctcccctccccccaccccactacagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtgttccatggtgtatatgtgccacattttcttaatccaatcattgttggacatttgggttggttccaagtctttgctattgtgaataatgccgcaataaacatacgtgtgcatatgtctttatagcagcatgatttatattcctttgggtatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgttttttctcaggttggtcaaagatcagatagttgtagatatgcggcattatttctgagggctctgttctgttccattgatctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtaccttgatggggatggcactgaatctgtaaattaccttgggcagtatggccattttcacgatattgattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacagtggggttttctagatacacaatcatgtcatctgcaaacagggacaatttgacttcctcttttcctaattgaatacccttcatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtctgccagtattttattgaggatttttgcatcaatgttcatcaaggatattggtctaaaattatcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattgttgccacaatttcagatcctgttattggtctattcagagattcaacttcttcctggtttagtcttgggagagtgtatgtgtcgaggaatttatccatttcttctagattttctagtttatttgcgtagaggtgtttgtagtactctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttgcttcggttctactctgattttagttatttcttgccttctgctagcttttgaatgtgtttgctcttgcttttctagttcttttaattgtgatgttagggtgtcaattttggatctttcctgctttctcttgtgggcatttagtgctataaatttccctgtacacactgctttgaatgcgtcccagagattctggtatgttgtgtctttgttctcgttggtttcaaagaacatctttatttctggtttcatttcgttatgtacccagtagtcattcaggagcaggttgttcagtttccatgtagttgagcgattttgagtgagattcttaatcctgagatctagtttgattgacctgtggtctgagagacagtttgttataatttctgttcttttacatttgctgaggagagctttacttccaagtatgtggtcaattttggaataggtgtggtgtggtgctgaaaaaaatgtgtattctgttgatttggggtggagagttctgtagatgtctattaggtccacttgatgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggcttaaagtctgttttatccgagactaggattgcaacccctgcctttttttgttttccatttgcttggtagatcttcctccatccttttattttgagcctatgtgtgtctctgcacgtgagatgggtctcctgaatacagcacactgatgggtcttgactctttctttatccaatttgccagtctgtgtcttttaattggagcatttagtccatttacatgtaaagttaatattgttatgtgtgtatttgatcctgtcattatgatgttagctggttattttgctcgttagttgatgcagtttcttcctagtcttgatggtctctacattttggcatgattttgcagtggctggtaccggttgttcctttccatgtttagtgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgcagcctacagaggcaggcaggcaggcctccttgagctgtggtgggctccacccagttcgagcttccaggctgctttgtttacctaagcaagcctgggcaatggcgggcccccctcccccagcctggctgccaccttgcagtttgatctcagactgctctgctagcaatcagcgagactccatgggcgtaggaccctccaagccaggtgcgggatataatctcgtggtgcgccatgttttaagcccgtcagaaaagcacagtattcgggtgggagtgacccgattttccaggtgccgtccgtcacccctttctttgactaggaaagggaactccctgaccctttgtgcttcccgagtgaggcaatgcctcgctctgcttcggctcacgcacagtgtgcgcacccactgtctggcactccctagtgagatgaacccggtacctcagatggaaatgccgagatcacccgtcttctgcgtcgctcacgctgggagctgcagaccggagctgttcctattcgcacttattttccattcttgcccttagcaaatcaaaaagacatctcttcaacagataaaggggtgctctcccttgaaatgaggatagctatccacaaagcaggcagcattatctagctgtaattttaatgctacctgaattttgaatttgcctgtacaattacaagtcctaaaaatgcagcaaattattgtcttcttccataagggatgactattcccatctctacaaacagaaaacaaaattctctattcttttgagaaatagctgcaaagtttaacaattttttttcctctgggtcaaggtggcttccaattcttggtttcaggtagcattttgagccagttgcaaaccttcttggattactgcttcttcttcttatgatgtttatcctgtgccgtcaagagaagccattacatgaagctacttaattcagtttcaagtttcagacatgcaccctaacacagcctgccccactagtggtagggaaagcatcagcccctttggatctctgtgctcatgccctctgggccccagacacaaggttatgagtttcagccccttccttggggaatgcatttgaggttgttttttttttttttagtgggaaaaggccactgcctggtgccaacttgttaattcactaaattgccagtaattcgaaagagttactggattttaattttaggatccattcatcttgcatcactctctcctgagggtgtgagggtggagagtaggaggcgggccccaaggcatgcagagaggccaggagcccttacctgaagaaagagcctacctctgcacaggtcagcactattctgaccaaggctggccaccgtattctcagttgtcattttgaccatgctgttttccctctctgaagtctgggtatctgtcatgttggctctgaaatcaaaacaagacaccagcagtccaatcttcagagctaaataacccccacccccagcttcacttacctatatctccctcactgcctgaggacttggctcaggcagctggggtgccaagcctcggggcttgcatcttcctcctctgttctgcacatcactaaaactcagttttgaaatgtttatcataaatattatactaagggtctcctttcaaatgcaagtctctttgatgcctacacgtgtgcttgcgcacacacatgcgtgcacacatacacattcacacacaagtacacatgcatggacacatatatgttgacacacatgcacatgtacgtggatacataagcacatgctcccatgcatggatacacacaggcacacacacattctcactgcactgctctgcgttccacccttctagaggaaggcttgctccctccctctcagcctccctgctcctctgtctttttttgccatgcgtgtgttgagtggacactaaatgactggtcctgttttgggaactgaggatgcagtgattgatagacaagacccacagagatccccactgatcaagtaaacaaacaaatagtatcgttcccgactgtggtgagtgctgggtggagaagcaaatccaggaaggggataaaacgtgggaggggagtattttggaaagaatggcccggaaaggcctctcaggcaatgagacgtaaatgatgggatggaaggagccctgcaaagatccttctggtggtccagagagctgagcaaagataaaggccaggagataggaatgagcttggcgttcacaacagggatcaagagttccctctgaactacgacccttcaaacactcccatagaattttaggttaaaagaaccctggggccatccaacaaagcctccacatactgctgttcacgcccactcgatgtcgacctaaatattggcatgtgctaatcctgatttctgctggaaatccaggtctctctgaggagtatttgcaattttagcttcttaagggctcttatagaatttcagtgtcttcttagtaactctccctcagactcagaaagtgacagtaggacctgttctgaggggttctcaagcttagaactctaagccctttgcctgaaataaaagcttagcatgtatgtacatggggtcttctgcagccactaccctgcaaccatcctcctgccactgtgttcaagaggccatcccctgtacctctgaccttgtccggtggtctggctggttcactgtacttgctgcagttgctaagctggtgtttgtgtcctcttgttccagaacatgtattccctgtgttctgattctcttgtctgacttctgagccccttaaaaggctcactgtttttcttgggtagcttattggggttcagttctaatcattgcgaaatcctgggctgtgccagttcctcgagaggtggaaagtgatgggggaggcatgtaccttagagaacagtgatgtgggggtagaggcctctttgtccctgctgagtgaccagaaggaagctcccagattccagctctacagatgacaagaaagaaggctgcccaggctaactgaacgttcactgcatctcagacagacccggttaaaacacaaatatacgacactcgtgtattgaatccctactgattgaatatctcctgagtaaaaagacactgggtattaccctaacacataaaagggttaatatcttaaattaacactcctcacagtctcattcatttatcagaatagtgtgtatcaaagactgcaggcaatgggttctgaagacatgagacaggcaaatcttgagaaggtcaagaaataatacaaagcccagctcatagaagatggtcagtcaccacctacacacacaaacacgcacacacatacacagcccagtgaggccttgtgagaagctaaagccacacgaaggcccagggagcatacagaaaggtaagaagacagcaaagaccatcgtcttccaatgtggcctcctgtacactctgctggcaccagggcctaaggcatcctgtatcccaaaccagaaatgggagacaagccatcatttccagtaagagtcaaccttcctctgtttaacccccttccatggcttcctgctgctctcacagtagagacttactagcgtctgaggggtcagccttgtcttccttgccttgacccctggtctccagcctccaaccttgcccctagtctccagccttcaactttctggcctcctacaactccacaaatataccttccctctgtctggaattctctcatttccagcctaactcagctccttctgtgggatgattcaagatgcacattgttgtagaaacagctctgtcagcttcatggcagaacaaggccaagcccccagctagggttctgcttcaggtggtccccaatgtgtggttccttgtggctgttgtgtgggaactgtatccatctttggatctcatggatcgttccatagtgggtgctccaaaaccactgctaagttctgtgcttgcctaaaggccagggaagattttccaatccgtcttttattcagatctactttatttgagaagaatcataagcctcaacaaagtcaaagccctacttttatacctcggtgtagtttttaaagttcaccagcaagcagaaggatcacaatattgatgagctcttaaaaaatgcatgagggcccctgagtacaagccaagaattgtaatcgagtccctgcacatgggcctctgatatcaatctcacattatttatttagggtttttcctgcttgccgtttgggagtgaagattcatttaccaagagagattcttttactagttttcattaccatgctgcaacattaatattaaactcaaaaagtgttagatctcgtctgtctctggtatgggtggactctatgctcccctttgggaaccagctctttgacactatagtgttgttgcaagtctggtctctgtgttttttattgaaattgctggaactcaaggaaatcatcttttgcttcttacttttgcatcaatatccagctctatccaggcatagatctcaaaccttgttagaaattgatgaaagttcctttttatgtgtccgcagaggagattgaagccccaaaaactgtgattcacattcattcccacaaatttgggaaagcatcggcatgtttacagcctccaactaacaaagcattgcagaggaggaggaagaaggctaccccaaactgctttggaatatctggcccccagaaatgcatttcatttgttccacccttatccattaattcccaatacagatgtatgtaaccagtttcagtggtgagatacctcagagtataagaagggctcttttaggcttcaaggtgcctttagaaagtattgtgcctgggggggaggagccaagatggccgaataggaacagctcccgtctacagctcccagcctgagcgacgcagaagacgggtgatttcggcatttccatctgaggtaccgggttcatctcactagggagtgccagacagtgggcgcaggtcagtgggtgtgcacaccatgcgcgagccgaagcagggcgaggcattgcatcactcgggaagcacaggggtcagggagttccctttcctagtcaaagaaaggggtgacggacggcacctggaaaatcgggtcactcccacccgaatactgcgcttttctgacgagcttaaaacacggcgcaccacgagactatatcccgcacctggcttggagggtcccacacccactgagtcttgctgattgctagcacagcagtctgagatcaaactgcaaggcggcagtgaggctgggggaggggggccccccattgcccaggcttgcttagataaacaaagcagccaggaagctcgaactgggtggagcccaccacagctcaaggaggcctgcctgcctgcctctgtaggctccacctctaggggcagggcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggttgggttacccacaaaggaaagcctatcagactaagagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggccggccctaaaagagctcctaaaggaagcactaaacatggaaaggaacaaccagtaccagtcactgcaaaaacatgccaaattgtaaagactgtcgaggctaggaagaaactgcatcaactaacgagcaaaataaccagctaacatcataatgacaggatcaaatacacacataacaatattaactttacatgtaaatggactaaatgctccaattaaaagacacagtctggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcagataaaacagacttcaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatacacatttttttcagcaccacaccacacgtattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaagctagaaataaagatgttctttgaaaccaacgagaacaaagacacaacataccagaatctctgggacgcattcaaagcagtgtatagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaagaaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaaccctcaataaaatactggcagaccgaatccagcagcacatcaaaaagcttatccaccatgatcaagtgggcttcatccctgggatgcaaggctggttcaatatacacatatcaataaatgtaatccagcatataaacagagccaaagacaaaaaccacatgattatctgcatagatgcagaaagggcctttgacaaaattcaacaacccttcatgctaaaaactcttaataaattaggtattgatgggacgtatttcaaaataataagagctatctatgacaaacccacagccaatatcatactgaatgggcaaaaactggaagcattcccttgaaaactggcacaagacagggatgccctctctcaccactcctattcaacatagtgttggaagttctggccagggcaattaggcaggagaaggaaataaagggtattcaagtaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaattaatatcgtgaaaatggccatactgcccaaggtaatttacagattcaatgccatccccatcaagctaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagaacaatggaacagaacagagccctcagaaataatgctgcatatctacaactatctgatctttgaccaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataagcatgggtaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgtggcattattcacaatagcaaagacttggaaccaacccaaatgtccaacaatgatagactggattaagaaaatgtggcacatatacaccatggaacactatgcagccattaaaaatgatgagttcatgtcctttgtagggacatggatgaaattggaaatcatcattctcagtaaactatcgcaagaacaaaaaaccaaacgccgcatattctcactcataggtgggaattgaacaatgagatcacatggacacaggaaggggaacatcacactctggggactgtagtggggtggggggaggggggagggatagcactgggagatatacctaatgctagatgaccagttagtgggtgcagcgcaccagaatggcacatgtatacatatgtaactaacctgcacaatatgcacatgtaccctgaaacttaaagtataataataaagaaaagaaaagaaaaagaatatgaactaagaaaaactaaagtctaacaggggaaacgtgtcagaaaaaaataccaatgtaggtttttgaatatgtgaaggaaaaactgattaaattatgcagatgaaataaaaatcaaaaaaaaaaagaatggaaaataagtcactttgattaaagctactgaaagttggagtagatttaaatgtccttttgtatttatttgactataatttctattaattgaaatattttaaccaatttaaccagttggttttgttgtcacaagcatgatatattcattcatacagtaaggtttatgaagcatctactaatgtgccagacacagtctggccatatatgtgtatattataaacacacacaggagatatatatatttatgtatagagagagagttttaagtatgtagtattgagtattcaatactattaattcatttaaaaataattcttgcatgataactacttggctatcaggtatctgctagaccttgagaaggaagtatgaagataactaagacatatttcctatttttctgaagccacagtctggccaaattcatgtaacttgatggcaatttgcagagaatttcaaagtctggggatcataactatttgtactgaagacagaaaaaataaaaagggaaagagaaaaaaaggaccatcagaaaagaagctctaaagttgaggaggaagaaattgagagatttggaagactataaacagaaacagacatgacgaatatcatctagcgtgaagagggcatatagggaaagaatgtgatgtaaaagcacagctctaggagctgctaattgtatcacaagctctagttagcagaatagtaaactgcaaccttgtattttgtgcccaatgttgaatttagttgaattataaaggagcgacggaaaggtttccaaaggctgaaatattttctaaagcatatcagatgttcagtaataatgcagtcatctagggtagacaaaacaaagtttgtggacatttgaacttgcattgatttaagagattattcaaacctatatttataaaatcattttactctgaatagtctatgaagacaatagtaacttagctatgatcttccattgctctaatgggtccaggtcacaatatcatgagcaaaggtcaaatttttaagaaacaatccaacaatatgagcagcgtgccatcaaaaacaagcttcaaccctgtaattatgtaaaggcctgcacaaataggacagtcttttaacctagaagctcattctgtgccctaaatcacacacaaagggaaaatgacggcatgctatctcaggtggaaacataaagtacttaactgggtgacacacaattgaggtgggtacctgctaggacttcagtggtcactggagaaaaataaaagcaagaaggaagaggaggtcagcagtacagctggagtcacagtggggattctagcaacccagtgccagaaacaatggctaacatggctgagtgcctcctctgctgaccccttcacctgtataatgctatgtgcatctaacagaagcccagtacacagtcaccaacgccattcccattttacagatgcaggaactgaagctgagaacgcctatacaacatgcccacaggcttatggtcttctctccagtcctcctcaccttcaggctgaagagctgcagaaagtcatggcatttatcctgcatttttctccatttgccttgcaaataaatgccaacaacacgaaaaaaaaaaaatagttgaaataaaaacacccacaaataacagcttgtcttttcccctaaggaggtagacagaatgaaaataaaggaagccatcattctttattggatgctggcatgaatcttgagctggtatggaagattatttgctggataaactattcttattttatatatttttatgcatttataaagctcatttcagctaggccttgtcccataaaacccaagggaattgtagtaattcaaaagtgaagatactttttgaaatggaactagaacagtggtgtagaaaatgggtaaaatgagaaacaaaactggattcaataagattggatagatcagtctgtgaaggaaagtctacaggcaactatttcagggtgaaaaagaaaaagtggttcttcagatgagaactacacttggctgccataggttggattccacctaaagatgggttttatttgccctgtacaatggtttacaaatatccaagccaacactaaaaagctgtgaatttccatataaaaccaagttttccggcttctcttaaaacacaagtccatactaagaccccatttccacttgcgatcagttggcagggccttgctagagtcttttcttttagacagtagtgaaccctgaaatggcccatgtccgcctcgctcctttgaccctgttctctagcctctgcattctattatctgccatgccttgctgacctcaaaatttgcagctttcacaacccggacgattcacaggtgttcaagttgaagaccaaactgctggctgacttaatgttagccagttaccatcaccttgtgtaattcagtgaggccaagtcccaaacactgactatatagtaagacctctcccctttcagaagccctcagtgtggcagttttaaaatacagccctcacatttttgacagtcttctcatcaagcagtgggggcctctttctctggaatcagggtttcttgggctctgtgactgcttgcccaatagaatatgacagaaatgatagctgtgtcagtttccaggcccaacctaaggaaactggctatttccacagactgtatcttggaccatttgctgctagaacccagccaccatgctgtgaggaagctaaagcaccttgtggagaggccagcacagggagaacacagccaggtcggtgagccactttggaagtggatccccagccccaggagagcctctgcagcatggtaccctcactaggtcccgcccaaatttcagattcataaacaaagtaagtgactgctgtagttttaatccagtgaactttgggatggtttgttatgcagccatccataaacagagcacccatttggtctgaacactgagaagggctttcacagcagatgagggaggaccaggaaggtgcacttccctaagcgacggcccccaggtggccttgctcacctacctggccgatgtgcctttggaactgccatattcattactcttcctccatcctgaggtttggggggagatgcagtgaacctgcagattcccgattcggaaggggtgctggaggtcagactgtccgtgtactcatttgtccctgccgtcaactgctccgatgacgtgtctgatatgaagcactccgtgatggtgaacttggcgtgcctcagttgctcttccatcttggcgtgttcgtaggccctggccagttcttcgtaagtggaggaggcactttctgtggagaccatgctgcttcttgctcgatctacaccaggaaagagaaaaacaagacggacgactcaccatcagaagtctgaaccaacggcatggcccttcctggcttggggctgttttcttccagatcatggtgggacctggtaggagttctggctccttggcggaggctcctgccttaggcactctgaggccagcttcacaagtctcagcagatccggttaagggaagctttgttgcaaccaaattgctgtagtcagatgtcccagcttgggacatttccataaataaataacgccttccctttaaaaaaaatcctgcttttagtgaaaacagtaggagccaggcagcagccccctctctgctccaacctgcaaatggatctatgccctagagactctttaattggcatgaatgatttgagctgcagttcagcttctggggcctcagctcaggaaggaagatgtgatgatatttagaaataaagatgtcatgttgcacggaaattggccacaagccagaatggcccccgacccctgggatgcgtcttctgttgtgattaccctttatggggactagaaaaccatcaggacaaaaactggtgcccacatgcctttgagctgggccacgccatcttggtcagggagatgtctgcgtttcaaatgcactaaaaagttttagggtctcctctgtgtggaactctgagactcttctaagagaaatcacagccttaaaaataaattcacatggcgatgatcctcctctggaacactgtttttgaagtatatcatcaagaacaaaagaaaaatgagtattaaaatttcctacagctattagattcagatgtaatttcttttcaaaatttaagagggggtggtgggcaacccggtgctattcttagggcctgtcttctctctgaagtgaaaacttggtggttgatggcatagactggatgacttaccttataaccaacccctgtttaattgtcaaacggatcagcctgtgttccctatagagggtgctatgacctcatcatgtaacttcaagtgctgtgtcttaatcttggagatggtaatgggtcagacgccctcagagtgtaatcagcaattactgcaatcacgggggtgaaaatttaaaaatgtctctatttctcccagtggggtaggaactaaatggagaaataagcttgggtctaagattcaggacacctgcagaatagatgcagtttggctctgttttgccctgtgtggagtaaaggctgtgcagttgtattagtaactgttagataaaccgcgtaacaatttgaaagtgaccttcaaaagaacataagtaagagggaggaagccctctctcccctccccaaggagcccatgaagctcaaggtgcgggggccgtgctggtccccagggacggaggaggcagcgtcagggcctacctgtgtcttgcgaggggctgacgctgtaactgtcgctctctttgtctactgatcctgcagccctgggtgttggcagcctccagtctgtggtgagggtgtgtgctgagatggtggggtggggtcggttgagggtccactggctggcatagcggtttctcgctgtgggcccagccttggcattcctcctggtggtgggatctgtgaagagccaagaatcatgtctgcctttgtctgcaggagtgtggtcagctgagagcaagcgtagaggtcagtgccacccacccagcactgccgactcgcccacgccctccaggaaaacttccttgacttctcctgtgcagaggatactttccctttcctttatggcttgaaaccttcatctgatacttacgtgtttaatcagccctgcagggaaaagaacaccctacttggattcagaagttacatatttgagtcttgctcttggcctttaataatgttatgacccttctaacattaaaagctagaaatggaatgaggggagactgacaacaattacaggacaaaacaagaaaatttcaaacagtgatgaagattataaagaaaatgaaaccaattactgtgctagagaatgacttgagagaggtactttggttacgatgtttgcaactgcaattaaatggatgatagtacaaaaaataatgttatgacccgatgcacatcatttaaacttcctgggcatcgtcatattctgtaaaacaaggaagctcagcccagtgtgttctaacatgacctcctttctacatccttaggtgttgttatgcgtgaatcacgtccccccaaaagacatgttcatgtcctaacccccaggacctcagaatgtgtgatctggtttggaaataaggtcatcacagatgaaattagctaagacaaggtcatattggaatagggttggcccttaatccactgtgactggtgtccttttaagaagaggacacagacacaggaggggagagggccatgggatgatgcaggtggagactggagtgctacagctgcaagcaaatacatttctgtgctgtgaagccacccatttggtggtactacgttaaaacagctctaggaaattaatacagatgttgcctgtatttttgtttctcatattactactcattgttttaatgatgactgttttattcattaagttgaaagctcctaaagcagagggaccatatttttatgtcccaactctccttaaggccttgcctatgatagcacatctcttcaatagaattgtcctaactttaacagagacaacttgggttatttaatatggagaacaaagggttaagctggtgccagatgggtttcattttctctaaatctggaaccaaaggcagcaagtctatggggtggacggagttcttagctcaaccctttggtgaggtaagaagaaggatgttccaccagcagagactgtcaggtaccagaatgggctacaacatcgcctcttctggaattctgtggaaaatgagagaggttcagttacctggaatgatttttctggggctccagcctggagacagcttaaggtcctagatgggtcttttctacctttgaattctctgcttctcaaagagcagtttgatacagttatatttcagtatggtctggccacttctaaacccagcagactgtattcactgttgggctctcacgaagtttcaaaggagcaaaactgacagggccggcctgtaatgttattgcaccgatttatttatgtgctttcatgagcctggcagtgtctccagggcaggggcaatggtatccctctgtggatccattcatagagcctacaataatccctgacatacagagttttctgaaggaattcatagacctagggtcactttatgaaggcaatggaagctcagagagaagtgacatagctgttacgtgataaaactataacccaaaccttctgccttttcagttcagataacgcctgttacttgaccacatatggccaaatcctgagtgtctaagtttcctagtgctgtgtctacatgaccttggcttgcttataattccatgttggaatgtgaaaggctaacactgggaaggtgcaatgactttgtttttaaacgggagatttcctcactgcaagtttctagttaattcgactttgaatctaatctatcattctgtgtcgctggagaggtgcgttaagatggcagccaaagagatagattttaagatctcctaaatcatcagaatactcaatcttggtaaatattctctggggcattgattttaagacacatttcatcccttacttgcacaattccacggaagacttcattagattttttttgtccttgatgagaatgtaaatgagttatgttggagctctacacaaccaggtatgaatgataattgggtttcttcaccgaaatgctaggaaagaggccctcaaaaagacagaaaaacattatgatggggaagaggctaaatgtcttccaggcactatcgacttgataagtggagcttaaataagtgaagcttgttatttaaatgctaatgagtcttttccagaaaattacccagtcccttacataagttttgaaaattctcatttttattcttctttaagtttcttgcaactacaactgttgtagctcattctgagcaggtttacttctggcatggaagttggggggtggttggggggtatagtttgctagtcccacttcaaggatacagtcatttcctccaatcccccaaaccttgaccctcatttcttctgcttgagctcactctccaatggtggggcaaagatcttcactgtcatagcccctttcctcattgagatcaccctacttggaaaattccatgggaaagtcgcacatgcagccttgattcaaagcctggtctcttttcaagttaattttgttcataatctctttttttctagatgaggacagttttactggtggcctgataatgttgaaaatttaggtcatgatattagtttccttaaaccacagccctcagttctgtactgcgctaggcaggcatcctagggtcaaaattgcctcagtatgtagaatactggggtatttgacacatttattttttaataatttggtttttggagccattgttttgtacctgaactgaactctgctgtatgataatgactaagatagcagctaaaatataatttttacttggattccacaggaagccttttttgtgtaacttactagctcatctactgagcaaataaacgctgggatttactgctccttcatggaaagtattttgttaggctcccagcattctaatataaataaaactcggtgattaagcttcatgcctgctcagcagcccatgagttggagggcacaggatataaatagctcatggcctttcaacatggggtttgaaccctaattaagcttctgcccattgaatcagattattttaattatcctgagtttgggatgagagaggattttgtagataatataataggttacagaacatgtcatgcgtactgtgatcatggtattaatctgctttcatctgtgccattggtttccatatcttgcagttgtggaggtccagctttacataacgaatttactagttgtctcagagagaggatgaaactgggagatctgaacactccctcatgtaactaaaaaatatttatctagcacttattacatcctggaccactggatgcacctcacccaccccaggtatttccctcagggccactgctagtcccatcctgggtaacagagggcattttttctttcaaagtctcagcaataaagattcaagtccatgttgtaagctcttgtcattgaatgtgcgtacatgtgaagtctattctttagtctctacatattctatatgtagtatctctacctaaaggccatgtagaatgactgagagtgagagctttggaattaggctgcctgggctggaagttcatattcactactccctggctgtgtcgctggccaagtgaccttgtcagacagacctgactaatcccctagtctctgagactaggtgatgtcatcacccacgttaagagctgtcctgaagtttaaatgagattaatgtgcccaagtgctccgggcacatggcacaggcacagctggccgtgcccatgattcctatgcagcaaacatgactcaatgtcttttcttttccattcccattgttctgatctcagaacttgatggctgattggtatttatccactacatgcctgtgtcagacactgtggctggtatggggatgaggacatggatagagtcctagttttccagtgtattataatccacaggaaagacagagaagtaatcagtgcagcagaaccagccaagggatgtgttttcactactgacagagataaatagcaaattgttatgatttcttccatcctcataagaatctgttgcaaccctctggcaaactaataaaatgcctagaaacataacttctacaatgcagtcattctggtatgcaagcaacatgttttagatgcttttcttaaaaataaagaattcttgcaatgacaacacagtcctaacatacaaaatagaatcacgatgtgttctctagctgagaaaatagagaatacaaatgattctctgcaagtatgccaaactgtggtgagaagaaccggctccatggaattcacagaggtataaacacctgggcagaggtgagaagctctggtgcaagaagctagtgggggactgtgcttcagaaagttcatgggtttcagactcttgaacccactgtggggccagtcacctaccatttctaactctaaataaaacacggagtgttgtcagtccctcacactgtggtttttgaggaagatttaatgaaaaaaatgatccagcagatcttttactaatacagagggttctgcaaatgctaaattaatacgctcaatttggagagtgaggggggaaccagagactgatgcatgcatttgagtagatttgcttgatgttggtaaacatcatttagtgaaattcagcacaaaggacagaaacattgttctataagctatagtgtttccctgtgatcatcaggctaagccccagggacagcatctcagcactctcagaatgaaatgcacctgccaggcactggcttaggggaccctgaaagatgaggacagctgtttctctgtctcaccttttccctgcctttcactgtgctccagtgccacttccatcctcatcatgcggggaaccttgggagcttttccctgctgccccctctgctcctgctgtgactctgatcttgtttcatgtcttcccctcactggaagtcctcctgaatgacttggacccaagagagcccctcccactgctccacacgcccgctgactcaccatggcttcattctctttctgtctaggacttactgagaaatgaaaactactttagttccatgtctaatgtctgccccctgactaggatgaaatgaatgtctttttgcatcttactcatggtgtatctccatcatacagcactgagccatatacgtaaagtgaaacctgaataaatacttttgagtgctgaatgaacgcattaacattcccagccctgcttccaactttatagccatgagatacacacacgtccctcccatgtgcgtcctgcctggcactcgctgaccactggtttacagtatctgctgtgactccggttcatgtctctgttgatattttacatgccaacaaatcaacttccccattattctggggctgaccatgaagctggaaggttgccagtgcttttgttttgggctgctgcttctcctgtcttaactatttatgactagctttatgcattctcggctgctagctgaccattgacagggaagcagaaatgcatgttgctttttacctggcaggaagaactgatgtgccggaggggtcctgccctgctgcgttacatgcaggaaacatttctaacccttggggcagtgtttctcaatgtggggtccaaacggccagcatcagaatcacccagggtgtctgttaccatgcggattcctaggccagaatctctgggtggaggcctggaattgatatttaaataggcaccaggtgattctgatgcatgtaaaggtggagaacgagacccagggcatctgctctgttgtctcttttgcctgctcttctgccaccgtttccaacagaatgctgaagccaatgctgcatcactctaaaaatctaatcctttcaatatctgtaactttttctgatttagcagcaaaaaagtggctcttaaacccattggagcagtgtcttggagtagcagcaagccacaccaggcagttcacaagggagaagccaacggctgaagagatgtcaaagcccttgaatcttttttttttttggagacagagtctcgctctgtcgtccaggctggagtgcagtggcgtgatctcagctcactgcaagctctgcctcccaggttcacgccattctcctgcctcggccttctgagtagctgggactacaggtgcccgccaccaggccggctaatttttcttatttttagtagagacgaggtttcaccatgttagccaggatggtctcaatctcctgacctcgtgatccgaccgcctcggcctcccaaagtgctgggattgagccactgcgcccagtctggatcattttttaagagcaaggctctggcacacacccctttgcaaagctaattcccactcatatcccgtttatgtcttcagaatgtattaatgtgatcaaagaagaaaggcggtaagaagattagacaaaaggaagaggtaaaagacttctttagaatgtagaatattcttgaaaacattttttaaatgaatttcaatgcctgctgaaactgttttctgtatattacaatgttatttcgtaggcaatgggtttacttcataaagctcactgcatttcgcaaatgcttcccaagctaggatttatgaagaatagcttttaacattataatagttatttttctaataataacacactattctaagaatgtaaatttttgcaaagaaattgattagagatttgaaagctagacgtcaaagtttccaaaatgataataatcaggacatcaatttctcagtctttaaagagatttaggaacgattccaattatgaagaaataagagtatctaattaataagctctagatacatattaggggattcaccttcattgcagtaattaatttccatatattatggatgcaaatattaataacaaaatccaacataatcttcacattaactagaattataatttttctcaaacagtgtgttcaggggcaaaagcataagctttggggatagatgggtctgtttctgaatcttggttttactacttatgtgtgcaactttatactgtttgcataatttatctgaggctgcagttttctcatctgcagaatagaggctatgatacctgcttcacgagtaggtatcttacaggattgttgcaaagataacgtgcatgacatcatcgttctatcccaatactggcatacagcagatacacactaaagtagattacttttttccttttctgtgttgcttaaattaaaaaaataaatacatgtacctgaaatttctagcactttttatagtaaccaatactaacagtaattcaactgacataataatagccaagatccatcaataacagctcattatcccaattagggatgttattatacccatttgtttctcaggcataggtatgaaaagccacacattttcatttgagagagaaagaacattactatgttttcagcattgttaacacccacacattttaagcattgttgaccactcactcgttcccggccgagcgtctgaaacatccactaagggcccagtggcctgagacaccgattggtaatggaccgtgtgagtgaccgtcagggacttctgcttagctgcctctccaaagtcagcatccgtcaacagaaccgtggagcgatcatctacaggatggcaggaacacagaaagccaaacacgtttatctcccttccaaccactccctggccttttctctcctgaggcacttgtgttattgttaatgacaaccacaataatagccccatctaaagtgacaaaaatgattgaaaattcaagcactgaattagcattactctagagtgctaggaatagaagcttcttcctaggggttggctttgggagcaatgagctaagaagaaccatgactatgcagagaaggagctctcttttctctttgggcttggcttttcattaagctaacattgatttgaactctggatttatgtgtttgtcaaaagcttctctgagacatcatctgcgatgccagccccctcaccagtgatgaggctgtcaatgaagacaggtccctttggctgctgggaagctctgtttgcaggactagaaaatcgccactacagttctctctactgaggtttgctctcattctgaacttggctaatgtttggaggggaaataaaagagaagaaaacatgccagtcttcagagcttattgattgctctattttaaaggactcaaggtatgttccttttcttcccacctcctgtaagctttaagcactctagaacatccattaactgacttctcctacatgattcacttgtcagacttcccaagtcctactgccgtgggcacttgaaggtgagcgaggcaggagcctgggtttggatgggttctgggcatcttagtgcttggagcaggagctgctgtttgagctgggtcattatttggtgggccaggattctcattactaccttgtgatatgtttcatactttttaaaaagcttttttactccaagggagactttggctaggatatacagatttttcataaattttcaaagattgcagcccaggatgctgttgctaagagtttatcagtcagcagggaccatactgcagccctgccctgacactgcaacagggatgcgaaagtcgtaaacaacacagctcgacttctgtgcccaaaaaaggctctgaacagaatgaaccttacaaaatccaattactcagtctctggcaggaaaggaaagcctctcaaagttagaataaaatttcctggcagagaaatagaggaaaggctgccaagatgtctgtgagtatcccagcgcatggtgcggtgaggttggcaccacagcaggcgcctgggcttggcttggaggtccggccccgtggcggtcactcgactcctcaaagagggtggctcttccacagagacagcttcctacaactggacccagcacgagaggctccgtgtctacatttgtttttcattaatgatgggatatgtcacagtttctagcaggcaggcccttttagatcacaccagatgatctgcggggctaggttacacacttttcatggaaaattttgggcgcctgtctgatcatgaggttaaccattcattctagctggaaattaatgtcactgtaatattggattcttgtggtcagagcccagagcattttgaagcaccacagttccacttcccagtaattagaaaatgccatcgacccattgtcaggcatcacaaggaggtcaagggctcttgctgatacatgatcctgcatggactgggatggatctctggcgaacggtcatatttacaaatggaaatgactggcaggcttcctctggtgttaagccccccagtgaccagctcttggaaggccatagaccactcatggcatctgcctagctatctattttcatagccatatgtaggattattgtctagtgagacgcatttagcaaatattgtaacgtgttatataaccatggtgacctccacaaactatgtaacctctctgtgtctcagttacaaaagaaacttttcctatgttggctggaagggttaaattaaataatgcatataaatggcttataaaattatatggtcaaaggaattacattctaatttttgaaattttttcaaaggaaattttcagttttaatgcccaatctactgggtgaaacaaaagagattccaggtataccttcccctttcccaaaaaaagataatcaaaagcaaaacatagtagcttatcccttgtcctgatacaagcaagctaataaaatcttgtgtactttagggcaggtagtgccacctcacatacatggtttaactgaagtgtttcactgaagttagctgatcaagagccactttgcacttgaccaatctttaagtgctgctatgcctggaccaaatgtgacttcagccaggagaacccaggccttagaatttaggagccattaggtcaagatgtctccagtggtgggtggggcagcagaagggtgatggttgatggagcaggtgttctgcccacctggtctcttaccactgccttcccggcaggaggcagctgggctatgtgctgagagtcaggcagtttatccagaccacaagaaagggttgtcctgggactcatgccagcaaacaccttccaaaacaaacatagccaggtttgaaaagaggcagcctcggagcctgcctcagggtgtttccatgggcactcaaaagcttggataacttctggttgagggtttcttggaagcagcctgttggtgtggaagcaggtggcctgctgctgtgctagctgtcattggagacagacagcatggcggtgagtgtggccaggtggggaacctggttctgcgcctgtctctgtgaccttggaaagctacacagacctctctacatcttggttacaaaagcaagacttctttcatatgttggttgaaaggttaaattaagtaatgcacacgaagtgcttataaaaactatgtgacatttacagaattctcaatacatgttagctattcttctcattattactggaaaggaaatataaggtatttcactccggaataaatagaataatcgaggcaggcagtgtggggtaatggacttcaggtggaaagaggctgggaagagtgaagatacctgggttctggttgaacaagccagaaaacctcagggtggctgttctgaaaccctaaaactagggccctggtgtttttcccaaagtgctgctggggaaacagctgcaggatgtttctggggcactggtgtgggggaagataccctgtacaaagacatgtgtttgtttaagtgttaagtacagtttaaaagttttatttaatgaaggcttgcattatcagagttgatgaggggggcacggagtggattttcaacctggggctttagagtgcaggccttctggattgatgtgtagtcgattacagatgtttattccttggagtggcatccgtagcctcccctggaaagatcccaaatggatcagagctgagggatttctgtcccaaatgcctggaactgactggcatattggcatatatggtggtatatataagtcaaattttctgcacatttgctggtactgattcttcttcacaagaacaattctctaccttctagctttggtactcacgtagccttcaagacgctctcctgtctaatatttcccacatcctggggtttggattgagaaggcatggctgtggcagccactttgtgtaaagtggcaaatagggcagcttaccaatggtctccatcgtgtctctctcttcaatcaaaagctgagccctgggtatgtcgatgtgcattcgcagggtctgctgttgcttgcttaacgtatctgaagtccgggtattcttactgggaataaaatggggtaatgcattaacaaatccagttcagtgttaacattctaccaacatgcacctgtataccaacttagtttattgtctaaatatacaaataccttgtgaggaggggaacagaaaacgtacatactatgaaaacgtttccttcattcaaatgttatttatttattaatattaaatttcagctggctggagagtttcagaaaatacaaattgtcaatagagattggctctatatctaccaatagaatctttagaaagttctcatttcttgtgtaaatgctaaatgaaacaaatgaaaagcaattaaaaaccaacagcattttcatttgtcagatgtgagatattccagtgatggtgaggaataaagcaccagatattccaaagatggtgagggaaaaagcacgtgcaccagctgtttgtcggatgggagttttactaatggatttgtatttatatctggtgtcattttatttttgttctagaagcaaatcacaaaccttgttagcttccctgacgttagttttcctaactgatagtacattttagaatggaaaaaaagcaattactatcataatttaatctcaaaatttgtgtatcagaagattactcttagagtgagctgttctctaaaagtaaatgaaaataagtagtaaaactgcatggtagaatcggattcagttatagcctgcagttaaaaaaaaaactccacgttgcacaaaaatctaaaaaagtcaataaagactttaattagcaatccacattagaagggtggttgttcagtctttacagaataataagactttactagatgttcaaatagtatttactgaagcatcctctaagaagcagcagtcacttggataatccaatcaatggcataatctatggcatccatcaatccagctcaattgttgttaacactggttttgagaaagatttctggagcctagttaactcaataatggtttacctctgtgttacttttagtggagaccaaaataggaatactcaatgctacattttaaatgctttcccctctaaccgagccatttaccccgagtcccagggctgtgcctccaccgatccttccttgttaatgaggactcatccactcttaaaccaagtggtggacagaactttaattatcccaaagtgaaggtcactcaagtacccccttagatgtttgcctgatgagatccatgtatactcctcgtttgagtaaaagcaaattatcccatgaaaaagacaacttctgaaaggtgcaacattcctacttaggacttgatcttgaaccagattgcttgctctgcagataaggaactgggctatgtacctacatcatgctaattatgcagagcccaaattcaaacgttttgtcctgacttttcacatggtctccaagctctttcaaattactgacttaactaacttgtcattcgttgattttgttaaaaagagagtaatgaaaaaattcaaataatcaaataaaaggaggagcattttggttacttggggggctgcatttacggcatgcttagacaagctatatttccacaaaaacatatggggaactactcctctgtgaatatcccaaagatctgtttagaaacctcactagggacttgagcttgtccttgcaccaaaaatagaagtgtgagctagttccttctgctcttcatgaatagttatgaggcagtcagcggctgctctattaaatagcgatgaacaccaagtgcaggctatacttaaacaacaataaggggtctgctaccagattgccacaggaagcaggctaaataatggctgtgaaccactgcgactggctggcaccaagatttagaacttgattcaactctgcgaaccaggacaaccaaggctggaggtaaattcttcctcctcagaagactataagaaaacggcccaacaagccttgagattcagaagctaattgtttttagagacagggtcttgctctgtcgcccaggctggagtgcagtgatgcaatcacagttcactgcagtcttttttttttttttttttttgagatggactcttgctctgttgcccaggctggagtgcagtggcgcgatctcagctcactgcaagctccgcctcccaggttcacaccattctccttcctcagcctcccgagtagctgggactacaggtgcccaccaccatgtctggcttttttgtatttttagtagagaccgggtttcgccctgttagccagaatggtctcaatctcctgacctcgtgatccacccgcctcagcctcccaaagtgctgggattacaggtgtgagccactgcgcctggccggactcacagttcttctttctctttgcacttggctgttcccgttgtttagaacacacttcccctgctacccccaaaacccacatactggctcccttgttgcaaggctggactcagatgccatcatctttccagtggagccaggctggccctgcgatggggacgtcttctgtgtcctgtccccattctctgtttaattttgtctgcttggcacttattactctctagcatatacttagttgatttatcttatccattatctgcctctctcactggaaaatatgctccaccagggttttcttcacctgctctgtttcctgtgtctccctagaacttagaacagtatatggccaaagtaggtgctcaataaatatctgtgaagtaaatcctcacattgatttattttgagggcacaacgtgagctgagtgagatgtccccaagactttgttttgaggcaataatatccttctcattctaaaaggtcactggattccaactaagttatttcattacttaatatttgctgtcacttttgacaatctattgttacatttatatttatcactctgtgttctgttaacctcaaaaatgataacaattggtcattagaatggcagcaaaccttaaaaaagtgatttgaacaaacctcatttgcaacctggaaaaacagtccaaatgttttcactgtggaagcaaaaattgcatcttttttgcatggcataggatcatgctaaacatattagttattattgagctataatcttcaaccatccatttatttgccatctggttgtttgaataaaatgagaagaagaggagagcagagacggtttcatagggcagagaatttcccagcttagccaatcaattatttgcagccactgccactcttcaaagtcttaatagtccatcatcctcccaaatatgacacagaacattccttaaatgtacaatgactattggactattaggagcatagctcattataacactagggtagagattttttattatgtgcacaaaaatatgaacatcaaaaaagctgaactaatttgaacctttttctgcttacacccaactcactcgctaatgctgattcctggaccttaaacattatatgttagctctctacagtatacagttatctctttggagcaaacacctcttagaaggctgttttttaaaaataaaaatcttacataaaaatataaaaggacaatctttctgtctgggtgtgagggatgcagtctctcttctctggggtgatgtgcatgggtgaaacaggtggatatctaggagcatgaagcccagcaatgggtgatgctgccaggccaggaatccctggggacctagactgagtgggtatgttctgctgtccaatctgccttcctggcctggccctcagctaatctccctgaaatacgcagatacttcttggtagaaaatggttgaaaaataaatgttacatccatttagaacacagaatgtggagtgataaagctagaaacaatgttgaattttttattttatttttattttttaggtaaggaaaacaaagcggtaaaatgacctactaagatctgaaaaccagcttatggccacatggggcctagagcacagacttgtggttcgtattctcactgtaccaggctgccagttcctttgacttctagagaaaacagcaacacagaccaggggtagctgttcagtatctttctctctgccagtggacatgatttgtctggaccccctgggccatgtccaaatatggttgattctaaattgaccagttaggtaatgaggtttttgtttgcttggcccattcacctgccgaacttagattgaaccaacctttcatgggtaaaagctttgcttttacttctaaattaatcccatacaaatccacctattggaggagcttgaaaattctcttccttttcaatcactttgaccatttgaaggaaaaccactgtaactatcataagtggttgtgattactggctttactcttcctaattcatgctggtaactggcaataggaagaccataattaattcctcctcttatcaacagatggtcttgcaaccacagcaactgccctattcatagaggatgcttgctaatgtctttctcagaggctagggagaaggagtaggaatgtactctagaatatgaggagaagagaaaaagcaaatcatcctaattgagcaaatgttgaacatgtcagaaaatatagcccgcagtttcacagcctctggacaaaggcatgatttacagtttgggagtagataggggagggggccagggtaggttgtgcagagcacagttgaggggaggagaagctctctggagggctgaaggagccctgctcagtgtacggactggtgaagcaggcccggggtggggtaggggtgggggctgcggtggtgagcaaactcacgccattctaaagggctactgtgcctacctccaggcaccattatcacctccgcggtgctagtatggccagggcattttcaagagaaatcagaaagccaaattttatgtgaaatctcctcattttaaatgtcatcaactaattcatatttttaaagtctacctttgacaatttcttttattaggtagatcagttattacaagtcatgtgactctgacttctttgttttccagcttctttgtgttaagcagatctttgttttatcagatctgcttaacacaagtgcatgtgtgtttggatgtgttccctgtgacccataaatgtcacataaacaaaaagcacgggctgaaggcatctcatgcaatttctgtaatcttctcctggaaatgtgatgaagtaccccttatgaaggagatactgtacagggaatttgcatctttgcttttcctctgagctccagatttctgctaccagttgtctatctgacatttcctctggatgccttaaaaataatcccaaattcaacatgacccaaataggtcttttcattcccatcaatacctcctcccaacctaccttccaaaaaaatcaaaagtccatagcctgcctctatcttcctaatcttggcagatggcaccaacattcatcagatcagtcacaacaaatgtattttagagttatccttccgtggtggctcatgcctgtaatcccagcattttgggaggctgaggcgggagaattgcctcaggtcaggagttcgagaccagcctggccaacatggtgaaactctgtctctactaaaaatacaaaaatcagccaggcatggtggcgggcgcctgtaatcgtggctcctcgggaggctgaggcaggaaaatcgcttgaacctctgaggcggaggttgcagtgagccaagaccgcaccattgcactccagcctgggcgacaagagcaaaactctgtcccaaaaaaaaaaaaaaaagaaaaaggaaaagacttatccttcatatcattgttttacctacgattcacattgttttgaaatacggtatggccaaacaaaatgtctgtaggatggaatctgtgtgccaatggcattctactactgccttcggtcttcaaagatattagtgatatggaacatgggaagtttttaaataacaaagagtactaattttatatgtatagatggaggaggaagtcacaggcaaatgtgttggtgatgggagtgggaagaggtcctagatccaccctctctctcccacgtaaatcatcctaaactggcaatgttgagttcactatcggagtccttgacattttccctacttatttcctagactctgattttcctttttcacttttcatgtaatcattgcaatatgaaaggcctaaaatgcaaatatcagggtgaggtaacacatcaggcaattaatccatacgtgtaaatgcttcatatcagagtgttctagtatttacagagtaaaaaggttggacagcacaagaaaactgaacatttgaagagggggactgggtggaaaatagagtttggggacgtgaaagtaacacacttgtcacagctttgccaatcacaagcctgtggacgtgtgaaaggaaagctgtgaaggatgcatttctgtcttccacagttgtgaacattctcgtactcattcaataaccactcttcattcatcccctccacggttatgaatggggcaactactgtgctggctactcctaacacgaggatgaactatgaaggctgtgacttccaggaccagaatagacagtgaacagacagtggtaagaggagctgaagggtgccctggtggagggtgctgatggagacacagagcctttgaagagcatggggcatagcacattccttttgtgcttttcttttaacttggattattctgttagaaagaaggcttgacctcaccagtagtaaatttagatgaaggcaaaactaaagctacttcctctttacgtgcttctgttcccaggctaatgggaagccttctattggttgtgtccagccaacaagacaactacctgtggcatgtctacaaatacatcattttcatctacaccttcagctaggcattacatggatattttggaatgtataggaaattacagttttttctaaaaagaaaagacattatcaatttcagactgccattattaaaaaaatagaaatcatcaaggcaagttggaaattgttctttcaaacatgatatctggggtgctaggtcttgttcttacctcatgagcatttcagctaaactctttgcatctggggaaagaaagttaacattagtacatggtaaataactcattaacattcacttaggcatttatgacaaatactctacagtcagatcagaacagtcattttgaaacacaatcatatacccagctcactactaatgacctagagtttcatggagtccttatttcttctaaatgggacttttaaaatgtattttattaattacaaaaatatcaacataactatcctatgattataacattctcagacatctactaaatgttttattccaacctacagtcacttctaggaaatccaattttattttcagtagtcagaaaattaacattttgagggtatatcatttacgttgaacaaacccatgctttttgttatcaaaatatcagaagtaagtggcattattacagagctctgagttccttgggttgaccaaagaatcgtataaatgaaatataaatgttcctggaaacttagatgtttattttgaattcagaaattaaaaaaactttattttttttttctctgagcacattgtttaccaagaccgggttaccactcttgacagaaggaatcctgactaaaagtgtaggaaaaaaaaaatccctttttttggtggtgttattttgaaattcccgtttcctttaaaatataatttattctttttacacatttggtcctggcaaaaatgaatgtttccttacttagagcacaaaaaccttctttttgtttttatttcattgctctctaaaaagtcttgatgctaagtatactgttcaatgaacagaactttccggaaatggactcagctgacagtgtgaccagctctgcagtgaaagtatacgtatgtgggagcatttccatctcatgcctttgggggctgacaattaaacgtagtcagtttctgcacagtgggcagcatgctatttctgaaagacgtggacagtcacagaatgaccacgtagaggctgtccttgccatgagccaagcttagttcgttaagttggccagtcccaatggtaaccccaagatggggcctggttttgtgcacagatgggttcagcctgggcaatgaaacagggcccatatactccacccacacagcaaagaaaagaaatcaaaataggattggatttcccagttcatgtctttatatttatctgcaaagacacagtaaatataatgaatttcctctttccctgaatgatttaacacttacaaagtatatatatatatatatgtgcttatatatacttcatgtatgtatatatatatacatacacacacacacatatatatacacatacatataatgccagaagcctggacttaattagctccaatgaactaccaagcagtggctggtacaatactctaaaaagggggaaacaaattcaaggagtaaacatcccacttcagttcacacttgaaagagttctcagcctcaattgtcttctgatcaactgctttcctcattctgcccgccacaataatctctccttttcctattctcggtcagtcatcacagctctctcctatgagctgttcatggcaatgtactaaggaattgcggagtccagcagggagaaaagagctccccacaatgactgccatgccgacagcagacctctcttggctgccacgtgcaggcatcctccccaaggctaaggtctttcacaggtctagatgccaagggttgaccgtttgggtcaacccttccctaaacctaacactgaccccaccttaaaggagcatgggacgtggggagctttgccatgaatgggcagtgtgctccatgcagagaattcacatgcatcggaattatgagcccatttgagaagtaaagtctaggtcaatttgactggacagagaagttgccaggatggtggtctggtgcacagtctagacattaaagagctaaggagatgtgactttgtattactgacctgaaagcttctacctgggccaaagggagagaggaaaaaggagggcagaggtgggtggtggatgggtgtgggtgctgtgaactagcatccaccaggcaatccagaatgctctgaatgtggaggtgggggcctgggacttgttgaaagcttcttagtccttagtccaagtgagaggctctgggcattagagaagagagccagggttatgtgggtaacattataatgtgaagatagaggaaatctgtacgaatcagagtcctaccaggtgtacagtgggacaaggaggagttgcagggagtccaggaaaagggcaagatttgggatatgcagagctggatgtagtaacatgagtgacaggaatggactagaacaacatggaagcagcaatcttgggagagacttgtctagtttcaatatcgggggacattaggtgaggctgttcagaggcaaatttggaatcaaatttggaaagatgccagggctgagatgagggtctgggtgtttttcatatccccatagagagagtgcaaaaagaagatggcaaaatctcatctgggacacacttttgttgagggtgagaagagagtctgagacaagccaagaaaaaaatttaaagtcccggaatcacagaatcttaagagcaataaagacttttcagattggccacctaatgaatgttggaatccctttcacaatgtcttacacagacgtacacatattctctgtctgcatgaatccagagctggggccactgccactccacggttggggtcggtgctcctgctgcacacctagtgtccttcctctcctcccagtactctcctgccttccaggtctgcaggtctctcccagccagcatgtccccaggggaacctttgttttttctcttctcagtcctaatctcacttattagtcagcatccttactgctggtgtgcccaacactgatacccacactgcaggaagggtgaagactggaatccatcttactgagtgatacctgtgctttgaaaccttcaaagggacctcactgcaacagccctcattagcacagagaacccaccttccgtgctggtccaagctgtcatccggctccgctgccgctcacttgtaacctccaacctctctctgagtttcctgcacttgccactttctgcagagagcccaagactttgctagtgcaaagccctccatcgtccccaccgccccatgcagacgcaacttgctccgtgtaccctcccatgcccagtaggcaggggtgaagcttcggttccctccgcttccctggacctctgccttatatctcagacagcccttcccagctcatactgtgcccacctgttttcgggttgtctttctcttggcccttttgggcacagtcctgtccctgatccatagtgaagctgcacaaagatttcctgaggacacatttaattgtgagagacatcttccttttcttgtgcagaaattccttgatgtaattttaacctgaagtcatttgccagctgttcagatatttccatgtagctgcatttcccttgcttggcctcagctttctcttttctgggttacattctctaattttctcagccactcctcatacggaatgatttctaggtaattccctacttgggaatctcttctttgaaaggtttgtgatttttttatttctctataaaatgaggctgagaaagacgctggtaattcttgatcttctagcacactagggagagcacaatgctcattatacgtgttgcaaatgaatttttttttacaacttctatagaagacttcacaattattcctattaaactgtatcttcttgcttccagcctttcaaaatctcttaaaatgtggatttgtccctctaatacattagcttccccaccaggatgtatgtggcctccaagattggattagcctgcccatgctttcagctacatcctggtgtacccttattaatcagccctgtcaaaatgcaaatggagtttgtctgggcccctggtggtcccttcccttccctgattgctcacaaaacatcctttctataacctcaactaacttatttcagtctataatgtccagaattaatctattgttgttgaaaatgggtccagggtctagatgctctttgacttacgattacctcctgatgaacccatcatcaattgaaaatataattaagtcaaaaatgcatttaatatgcctgacctaccaaacatcagggcttagcctagcctatcttcaacgtgctcagaacatttaccctaccctacagttgggcaaaactatctaacacagagcttattttataataaggtgttgagtatctcatgtaaaaataatggatcacatatcactaacccagacaaagatcaaaattcaaaatacagtttctactgaatgcatatcatttttgcaccattgcaaagtcaaaaactcctaagttgaaccatagtaagtcagggaccatctgcataatcattttctaacacctctaatttacatttgattgttcaaaggttatccagaaagatcttggggttatgtctggaaaaattttgttcagaaccctaaaatgttatccttcagaatcatgggactggaaccccatgacagcttccctaattttttaagtggtggagatctttcctttcagtgaaacagcacagcatttattctgtctgcattaggctgcttacgctttggaacttgtgtaatagttctttgtaaacattgtctgcaaaaagcaacatctccacctccacataatggctaatacagagtatgttttgaaaaaaaataaatccttttaaactatcagggtgctgattattttcataagcatcctgagtttctcccttcccctcccctcccctcccctcattccctccctcccctcattccctccctccctccctccctccctccctcccttccttccttccttctttttataattcctggtccacgttttctgattcaaatagcatttctcctggtacacatcaagcaaagcagatgctgagcagctctcctgtctacctgccatctgttaatatgagaacattgttcacagccttgttcttcttgcccaaacacagctaaacagcccttgcattgcctgtcacattttttcccacacatttcagatcagcctgagattcagacttcgcgacatcttttctaaagccgcttgctactcccacacttccatccttggctctgggctcctcccttatctgttgggctgggaaatgatggagaaatgataccaggataatctagtgatattaaaatgtggaaggaaggaatttcaaaagacaacatttgctaacactctgaatgctgcaaagagggctaaaaaatgatggctgaaaggataatttggagatcagagaataactggtcatctgtcttcaggagaacagttacatttgggtggcgagtggaaggggactgtgggaatttgggagtaattgagaggtagtgtagctgaggacagaatactctcaagtattcagtggagaaaagaatcagagagacagtaggatgaagatatgcaagctagaaggaatatgtatatgtgcctctctctgtatataatatatacatatttaaaatataattaggggaaggctgaagggtagtgaatatcgaaatacaaaatcaatagaccaagtatttttgatgggcaaacataaaattatatagtagctattgatactgtgttaatacatcttctaattccaggtataattgataaacctttagagcttacttaatattgatgagacaacctgtttcttacttgaatattcaaaatcctgcagaagtttcatggcaagaggagtagggtagggagattgatctgaactctcttctagctctgcctggactcatatgtgattctggataattctatagctggccttcagttttcacgtcagaaaatggggtatgatggctggacgcagtggctcatgcctataatcccagcactttgggaggctgaggcaggcggatcacctgaggttgtgagttcgagaccagcctgaccaacttggagaaaccccgtctctactaaaaatacaaaattagccgggcatggtggtgcatgcccacaatcccagctacttgggaggctgaggcaggagagtcgcttgaacccaggaggtggaggttgtggtgagctgagatcataccattgcactccagcctgggcaaaaagagcaaaactctgtctcagaaaaaaaaaaaaaagaaaaagaaaagaaagaaaattggggcatcataatgggcagttcatactcaaccattttgcatggctattgagagactaaggcaggatggtgtatagtgaagtactatggagaagaaagaggagcgaaacaatgggaagcattagtagcctgtggattagtacatggttagatcgagttttgggaaatggcacctctggttggatgaggaggctcccagcttggtcttgcccagttcctgtgttctgtttatagaccacagcttgcatcctggggttgtgcctggcatgaaggtgcacatcagcaaggcagagcatgacacagcatggcgtgggagagtgcccaccatggccccaggcactgcagctgtgcaaagcttgagaggctgaactgcctcacattttgcacactcaaatgcttctttaaaaaagagaaatcttgtttatagccacatggctacattttcatatctgaagttctagttacgtaaaatggaagacgcttaggttaatacttctactgggcagtcacttgcagatatccacaaaaaaactttctgagggtggcagattttgaccttatattaccatccatcaaaaggttttatttgcagcctctccctcaacagtccctgcctttctgtggaattgaaatagtctcataaagtagctatttttgcaagggctataaacctgcatttatgtttttataagatcccaaataggacttccaatcatcacaatgctcagatgaaagctaatttgaaaactgtggcagacatatattaaaaaaagaaggccatatatactggtaatctgaaaaaactgcatgcacagacacagacaaaataggacacccaggcaaggcagagctccagggcccggctgagacccacaatcccctcctgactacccactccctggctcccctccactggtagccctcgactccccctcacccccatgctcttttgcttcccgctgtcagatgcagagagccttttctattcagtttgccataacaagtttgatgttttaagagaataatttcattaagaaaccaagacagaaagaaagagagaggaagagaaagagagagggagagagagaaaaaaggagagagaaggggaaaggaaggaaggaaggtagggaaggagggagggagggagggagtgaaggagggagggagggagggaaggagagagaaggaaggaaggatagaaggaaagaaggaaggtagggaaggagggagggagggaaggagggagggaaggagagaaaagcaaggaaggaaggaaaagaaaagaaaagaaaagaaaaagaaagagaaagaaagacaaagagaaagaaagaaagaaaacacaaagcacagaactaaagagtttcagagtacaggcttctaatgccatcttagccacacttggtaacgaaagctctagggtgcatgtgtgctactcatgcattaacaatgtgggcttcccacattcagggtggctttatgcattagtgctggggcatctattgaaactttgagtctatctcaagtctgagtgtcactgggttcctggatgcacattcctgctttaggttagtaaagttcaagttaccttttggttttccaaatgaggggagctttgggctcatttgcagagcagataaatgtcctgttagtactcagaaaataacaatgatttctcataacctaccccttaatctgcctgcatagcaccatgaacccagatcctctctgggaacagtctcttccggaattgatcagttttgtaacaatccatttcaaagcatgtttaaaataataaacacatttccattcaagagaagcaagacactctgccacaaaagcatggtcaaatgtgacatcactcactgatttttatctttagcttatttgaagtcctgcaggttgacccacactaactggtgccaacagaagcttgtgccttcttgcgtaaatgcgtaccaaaggaggaggcttttagaaatattggagttgattacttgacacgggatcacattttataaggttagggctgctgggatctcaggcccaaccagtgactcactctataaccttgcacttcaaaggatctagaagttcaagaaaaaccagggcatcattaaaagcaaaatgcggctcctgaactcctggataaggttatagatttaaaaaaaaatgtgggcacttgcaggcaatttagagtttaggaggtcgccatgctctaaaattagtaaagtactcaggaagagagaatataggttgacgacactgctagagtcccattttctttctttctttctaaaattttacataaaataacattatattatattcatctaactaggttacttgtctatacagtaaaacatactcagcttataaacatttttgctgtttctagcaattgaaaaatgtgatcaatttcaaccatataaaattgatcccacctaatcactctaaaaacatccactggggatccctataatatttttctataattcaaatctccttatttccatttttgatcctgatagatggttgctcacgcaacactgacatgttactagaaatgttgtccttaattttgacaatcaaaatattctgtctgtagagtctgtaaatatatttgaacttattctcccagaggcacagagtctgtaccttatgtgggttcgcttgttattgggtgattcgactaatgcactccggatatttaatagacaggcacctattcctttaaactctgcagctgcaatttccctccatgagtgagttgaaaatactttgtatcattaatgaacatttcagggccctgcagggctaagaaacaaacgtctttctggggcaatgcctgacctttcatcgattcccctttaccaccctcacctctggcgctgtccttttatggcagtgctttgcacagttacggagatgagtctgccccttgcaagccttgacccactgccactacaatgtcacctttatagttctgagtcttagaaatctcttctctctctaggacctggctaaactcttgtgatcaaatagaaatggtcaaccagcaaatgttaccactagtttaaaaaaaggttccatcttgcacctggtagataatctacagtggtttgtcaaactgaatttattgcagtgtgtctacattaaaacttgccattcagaagtggtgtgaaattgggtacccaatccttggcatcctgaccgccctcctgtcagattcttttttttttttttgagacagagtctcgctctgtcacccaggctggagtgcagtggcgggatctcggctcactgcaagctccgcctcccaggttcaagcgattctcctgcctcagcctcccaagtagttgggactacaggcgcccgccaccacccccggctaattttttttgtatttttagtagagacggggtttcaccatgttagccaggatggtctcgatctcctgacctcgtgatccgcccaccttggcctcccaaagtgctaggattacaggtgtgagccaccgcacccggcctctcctgtcagattcttgatttgagagaaccctttattagccatgtacaaaatgccgaactgcagatacctttgtgccatggcaagctacttttctgaaatcctttgctccttaacatctcttagtaatactccctctttccctcagcacttactttcttcctactgaaacctttgtgttggatttaccttttccccagaacatagaaatcaaaactatttccggagaatgaaaggccatgttctctgaggtgatagactgctgtctttaccaaaaccaactgcaaaacactagtgtctggaagcagggaggccaacaataaaaatgccagccccaggatgttttctggagatagcccttgtacagcaacaattaaattacaaggaactactaagaatacaaatacagggtgcatgggtcatcatttcaacccaaaggcctcactcagtaagagcccacagcacctttaactggaggtgctctcagcgagaggaaatgcacagctggggtgctcaagttcgaaggtgagtaggaaaaataaaatagtagctgagaaggatggagagcaataggagtcagggaaaagaagaaaaagtgaatttggcgagggtgtagaccgatgagaagcattacctagatgcttaactcttgtgattaaatcaaaatcattaataagaaatatttactattggtttttagaaacatcatacagacaatgtgcagccttctaaatgcaagtagttagacatagttgtctaatggtaacaaggaaagacacccttggtatctcataataattctcctaaagtccaggccactgtgaacaagggttatgaaaacatcctttttgtgttttagtgatgaactgaatggaattcaacatggtccacattatatggaacttctcaccataatgggctgtattatacgcttgtagttctgttttacttagcactgaagtagcctcccttttcctctccacttgggattaatccgtccttctttttcactgatgcggtctttctttgaagccctatttctgtattcatgacatgttttgtctttcactggtagctgcttatgggcctacctcctaccttaaacctagagttcagaaagctctttcttctcatctttgtgtattaagcacctagcattcactcaagtaatgtctgcaaaattaaaagataattggttcgcacgattgcgaaagaacatttcaaggagactgatggctgacctgaattattgggctgcaggagatttacatggacagattcttaattgtacagatgaagtacaatgtacttcagaattgtaatttgttggcagagcaaaagcaagttgatagtgaaatgtaccagaattccataaaaagcagtgctttggtgctttggataagtgaagacaggtgaaaatattaccatgttctctgctctaagtggattatggtcaaattaagtatttacagaagaggtcaacgttttctaaatgtatcagtaaagtttgggatatgttttgaggagagagtgcttccagatttgtactttgaacataactttgaaacacacataggatgctgcatagcagtatcccacactgcactgatattaaaatgaaaatcccttgtaatacacgttaccgaaaaagtggcttagttaaacaccctcactggtaaagggcaaaggacctgggaacacgtctgcacagtttcatatttgaaataactccctgtcctcacattgcagagcaagggcaagtaagggctcttggccagaagctgagaacagcctcatcacagaacgacacggggctggacattataatcatggtgtctgttcacaatggagctcatctggcctggcttctccagccttcattatgtttttgctacattagagtgaaactcttacactgggcttcagctcccgtttctaatttgggatggcatgtgtcctctgcctcacaatgcttcaccagtatcctaagccctcaatttccacttccagtcagtcaagtaattctcattcccagagcaaatctgatagatcttttcatagaaagccacaattggtggctttgctggacccactgaaaatttaagagactagagttaaaaaattaattttccttgcataccaacagctaggatttaggggacaggttggctttcacctgatttctgaccgagataggaacattcttattgctcttccctgaggctctgcagtctcgctgaaggaatgtcagagaaccaggcagtggagggacctgggttaaagagggaagagtcactcccttttgaggtttgttctccagctggcatctctcccattggctgcagagcagcaggggacacgcgtaggtggacagctgggcctggacctacctcgcagcctctttagcctctgctcccgccgcctcctccgcacaaccagcaggagcacaaacagcagcaagacccccaccaggatacaggagatggtcaccagcatcttgagcccctcgttggtcgtcagcccttcttcgttttggacaactgacttaatgagtggaggaattgtacctgaaagcagggccacggtgttagatggctattaatgaagacggcatggcggagcttttagggatgacaggttataaaaatcgcgctgtgtgatccaagggtgttggaggtgatgagaaatgaaaagaactctgtctctaggccctggctaactttttttcttatttatttccctccctctgcctgaacttccaacttattctatagtgcacgtttgaaaaggacttcattttgcaatgcactacagtgtgcaggcacttgaaagcatgaggcccaggcttggtgctgacaaaagccacatgcatctacccagaattaagtgttcccttgactgtcacccacagtacaattgatagagactattcgaaaaaattgcacatcaaagaatgaacaaaaggttgggcaaatggacagaagcgcgtgtgcagggagagggtcctagatacactggcataaagaaactcaaatcccttgtgattaggtaatttgctggcttttatcgcaggtgtaagaccaaatctacttcaacagctgtggtttgagggtacaagagctacagacagcttttcaaaggggacccaactaggtttctaaaggagcctacttttgatcaggcatggttaaatagtgctacaaaatctagattatttcgagtaataaggaaacactgaaggaagatgaactctgagctatcttaagctgccttctatccagatgctcagtaccgtgggtgcagagatctaaacacaggcatccactttttatgaggtatatattttgctaccctccattatataagatgctccacgccactgcactttccatgtacaacaagggccagaaagtcagcacttcaggaaaagagaatgcaaaaataatataatttctccctcagcaaaacggtctttatcctgcatttagtaagcagagcagggataatggaatcctcgttcctctgtgatctctgctaaagctgagaagagtgttctcccaactttaaagtgtttttgtggaagcccaagtctccaaatgcttagaaattcaggaaagaggcacttacaggatgcccatgaagaggggtctgcaaaaccaagacaacactaggtcaagcagaaacattcggctaaggaaatggcagaagaaagagtgagatcattaaatggaggactctgaaacctgagtggtatgaatgtaggctgccaatcttggctttctcaagataacaaagttcttcaggcagatgtgacaatagaggctatccattcatgagactggtccaaagaaatctgtaatctctctcaaggaaaatataaatatgcagccatatttcttagtgtaataaagtgatttcatatttccaaaacgtaaaggtagcttgcagcatttttcaaaatttgggatcttggataaagtgagaaaattatatcttttcttagaagacaaacatttaaaatccgcagaacactttgtgaattagaatcacagtttcaaattctacacatgagtagtttctaattaaatcattagctgtgagcatatcatcagtgtgcacatttaagctgggtgcccaggcatctgcacatattatagagaagctgggaaccagagtgtgaatattgcaagataatgatctaaagtaaaaaagatacttactactcaaatgtgtgctggttaacagaggattttggtgcacccttaaatgctaagtaaagtgtctggtaagtgtcaaagttctttattttgtaagatcaaataattcaaccatattacagggagaggccagcttggaagtgctcctctgcctctgggtgatgctttgtgatggggacacctttgaatgaagtcactgaagagtgagggctataaaattagaaagaggcagcccatgaaaagcatcagcccttgaagagaaaagttgtcgtctgggagggcataggctattctggggccataggacagagcccgtgcagaggccagggaccccggctagcgtaaccaacactagaagagctttctacaagctcaaggtcttcctacagccctgagacccaggccagaagtgccaggaagaccctggactctggcagagaaggatgttgtggaaaaatgaccttggacaggagatttggggtaggtctgctctgtgtgccaaagcaagaagagccagccctgggccatccggacattataggagaaattggtccgatgaaaatcccaggcaatgtcacctcattagctcctggtggtcatttctgtgggtccttaggttcacagccactcttcttaggatggcataaactgtgctccaaggagctacctgctggagctttaataaagcggcctcccaaatgcacaaagtaaagaaagaatcactctcctagagagcaatgctgatgcttttcatgggctgcctctgtctaattttacagccctcagttatgagtgacttcattgaaaggcatcccctcacaaagcatcacccacaggtagaggagcacttccaacgtggtcttggcttggctgtcaataaagggtttgggtgtttcttggttaactcattcaacactgtggtctagcctgaccaacaggcagtgaatagaaggctctgaggagagttgcactggagttccaactcatcctgatgcattgctgccgtttttaccttgcaattagagcacctaactcaatccttgctgttcccctagtgagaaatgagcatcagcccgctgctgctgggactttctaaagttcccctactaagttgcagtcgaggactcgctcctttcagcttcactgggcttagcatttgttcagttagcaataaatggcccttgataccagaaaaaatgagtgagattttaaaccatttatttttggttaactaatgtcaagagacacctcacctagtttttggaaagtaaatgcaagtggcaagtgtgtgtgagtttgtgtgtgtgcacgtgttcatggattcctattattatcctatttccatcagtggccctgctcctgcccagagactaacataagctcctttaccatggaaaattgtttttgcacatgcagtttagggtgtaatgagtgcaaaaaagaaagttgttatgtggattgggatgaggtggggaaaggggtgggagacaacaaaagcaatgttagctcatagacatcaacacaagcacagaaccacagggtcaagagtccttcagccctaagagaaatcactcctgccccatgactccccagtgagactccctatggccctgagtctcttatttctggacacacagtgatggtcatctggatataacgaactagggagccccagacagagtccattgaatcccgaaagcctaatgggctccgtgggcactggtcaaactatggcaaagatgatgttcgatgggaaaggggcagggcccacgtgcacatcccccaagacacaagcaggagagccacaaagccagccagcttactgccatcgtagttcagcgtagcgaagttggcctgcttctccgcgcagcccgcactgttgcacacccgcatctgcagctcataccaggtggcttcctgcaggtcatacaggatgtaggacttggagagagaggtcctctgagctgtggtccaaactgtggtcccaaagggcctgtactctagtgtgaaggaggtgatggggcagccgccatcattccagccaatgaggttcagcctcacgcgtgtggtgttgatgctggcaaacagctcctgctcctttgagaactggggctctgggggagaaggcacatggaggtcagctcacaggacacatggggaggccatcagcatcttcacgcatttccctcggactgcttcctccagcgaggccaggagctcagtccaagtctggctcacaggccactggcaacttgtcccctgttaatagagactttatggaccaacaggctttctccaactgtaatgacctgggtgtgtgacagaaaattgcatgggtggaggttattttggggtatcttagagttccctaaagaacaataggatgttcacatatgggtttccttctgtggtttgcggggcagtgtgctgggcactttttccatcctcatgtgatgaacctgattcaagagaagacagagttggatttgggaagcaccaacagattttcctccacaactaaacacttggtcttggtgcccagggacctaaaggatatatttctgcataaatcaatccccgatcatttgacctcttaccacttgttacccaaaactgtggcaccaggcacaaataatacccttgctatctcattactcgctctcctgccatctgaccccaccccacctggtaggactcctatgggagggaagcctgcaaagacatctcctcaccttcttcctatgcccacatagagctgcatcatccctccttccttctggagttcctgggacaaaacctctttctctgaatatgatttctttgggattcatctccttgaaagtccacattttagattaaaaaaaaaacaaacgcaatttaccccatcattttccctctgaaaagcggtggctatgtggcaatgtggaaatgataggaaggtgggagcaagggtggctaagggagaagggcgcctccaaacggctgagagggcaagcgccacgcttcatggctgcccagccttggcacctcacattcacaccaacgcccttgattttcaaactgacattcttctttttaactgcaaatgaaacaataaaagagaggaccagaacactctggaaggtccagctgtccctctcattatgccgtggcactgctgaagccatgtgaggaatgacaaagttcaaacacataaacgtaaaacatgatggatcttttatgattccaatctcctcttctggccgggaaaagaaaggatattaagaagcgatgagaaggcatacctaccttttcctaaggtctttgcttctatgatttcacttatgcgccctgggcccactccattttgggctgtcagtgtgaacttataccaagtcccacatttgagattttccaagcgataggaacgttcgctggggctgattggaaaactcccccactgctcactattgtcctcggagtactgcagtatgtatcctgcagagaatgagaaagattcacatgagcactgtgtttgctttctatgggaagtggactgatgcttgcattttgtgtgggtaatagaacgagcattctcagaactgaagaatcttcagaaggaacattttcgctctttctgattccaggaaatgtaacccagcctgggagaagcaccatgatgtattgattagtgagtcatttgggccacaccagacattatcactgtgaagtattgctgttttctgctcattctcttctaaaagccatattgagcagcagggaatacttaagttgccaaatatctgtccctcagatcatacatgcctgaatccttgagtgaagacataggctgaagctgttatttttgcaagacactcgaatctctgggaaagggatacattatcaatgggagtagagatttcttcaactgcctcactcctcatgtactcctggtctcacagttcacagacactaggagaaacagctccaagtcttgcagccatcccactattctgacagtaacctggcttctctttggtttgaaaaattcctccaacaattcattcccccacatgagcactacctctacttttacaactagtaaggatgactgtccactctagagcactcactccatgccaagccctgtcctaagccctttgcttacagtatttctgcaaccctatggaacagtgacgactctcccacagaacacgtgggacactgaagtccagagcagttaagcggtgagtcccaagtgctgaaaggaggatgcagatcctgcagtcagcctgaagcccatgttcttcacccctgtgaatgctgaaatattcttcctgttaactccttcagccctgttatctgcagccatgttccttctccaccctggctagctggcctggaacatggtgtgtttgcaacaacgggttggtaccttctattcctgtcctgtggagctccattttaataaaaataaagcattttttttccctgcacactacagtgtctcctaaacccaaatgggcaggtttgctgatttccacaccccttacatggcgatcactcatctctgatgcctccttctgaggtcattgtcagtatctcccctactcctttcagccttccctcaccactggccttctgtggccatagggtccctcctccttcctgagcctttgtgttcctcatctgacctccataaagctccttcagtacctgacaggtgatacctgtgcacctgctcccagccacatcccagcctgtattccagccgccctacacattgtagggactctgctttcctcccactttccaccctcgaagccacctcaaaaaactcctctaatccttggtgataggcctgtatagttccctgtcccctgctatcatcctcagtgccatcagtgtccatcagtgtgggcacacaacttacgacacctcctgatgatggcaatggctttggccactactgtgtttcaggaatgctgggttacctttgtcttggaaactctccctcactaaaactggcttcatctggaagaccttgtgctctgacacacccttcttgttctacctctcccatgctctcacacttgtagaatccaagcctcatttcatttgagcctaaaacctagggtccctcgagcccatccctaggtgccccctatttttttcctataagaaggttctctagtcagcctggaacctttggtaggccatttcaacaaggagcctagtttctctcactcttcagacttctggcaatgcttatgttactggtaatctgtgatccacttttcttcccagctgtccagaatcatttagaaaagtcattaggccaggtgtggtggctcaggactgtaatcccagcacgttgggaagccaaggcgggtagatcactaagtcaggagattgagaccatcctggctaacatggtgaaaccccatctctactaaaagtacaaaaaatcagtcggacgtggtgacacgtgcctgtagtcccagctacgtgggaggctgaggcaggagaatcacttgaacccgggaggcagaggttgcagtgagccgagatcgtgccactgcactccggcctgggcgacagagtgagactccgtctcaacaaaacaaaacaaaaaagaaagtcattagacagtgataattgtgactcgtacaatttgtgctgtgcatctgcagctgggtccttgcaagcttcttggcaatgactcggttcatctattaatgactctctgtgcattccacaaggcagctattacaaacctatcccatgctcctcaaatccacagacacatcctcaccacgattttaaaaaaatcacctcactttttctttcctaaaagaaaaaaaaaaaaaaaagatcttcccttcacccattggagtgctgataaatgtttaacaactggttcttggagaggagaaaaaaggctctgatttgtagcatttctgatttccatggtgagggaatgttcttagggtggctgtggccactgagcatgaagctgggaagggatgtggcacctcactctcggagctggaaggagctgctccagcacactactgatgtcactctgaaatgctcctgacttcctgtttacttcccagccttctttctctctcagaagaaaggatgttctctgccttaggaagtctaagcccctattctctctccccggccctgggacctcctttatggtacaggccctctttcctgtgtatcttctgtctctagcttaactccacccacactagaacgaccatgctcactccttccatataaacctcatttaggccgggcgtggtggctcacgcctgtaatcccagtactttgagaggccgaggtgagcggatcacctgaggtcagaagttcgagaccagcctggccaacatggcaaaaccccgtctctagtaaaaatacaaaaactaactgggagcagtggtgtgtgtctctaatcccagctacttgggaggttgaggcagaagaatcacttcaactcgacaggcggaggttgcagtgagctgagatagtgccactgcactccagcctgggtgacagagtgagactccatctcaaaacaacaaaacaaaacaaaatcttgtttatacacctcaactatgaactaattgcaaaggttttgtgcaaatagattgttttacatctacactttaggtcctctgtcttttattactttctaagtcaggacagtacccatggttacataaatgaatgactttgtgttgacaaaataaaaaagaaacagtgtttagaatctcaaaaaagagatatccaaatttcttttttctttctttcttgcaactgttgatatttcactcttaaatgagcatccttggatgaatgatttgaatttcaacaaatatcctaaaaataaatgtatggtttctttcttaggtaatggagggattgtttatatgacgtatttttgggggagaataaagtaacacataccagtcatttgctgaagatgtgtcacttattggcatgtggatcacacaactaatcaactattgtggacaatctatatcttattacctctgatagagctgcccccgttgtctccagggagccaagaaagggtgatggaggaagacgtggtcttggagactgtaagccgaggctgatctggtggaactggagaggaaacagtttttagaaaacaagaattagtttttcacatctttaactttcctgaacagtcatttaccaactcatttttaacagccatttattaaataagtgtttcagtttgccaaaatatacaattcacttctgtcaaaatgtctatttagttgatatcctgggctaaagagatagaacggagtgaatctattatttaaaaaaaaattcagccacatttctacttggattcatatctaactcatttcctcaccagttccttgactgtctgagttatttatcactaattgaaatcttctttaaacttactaaggatacatgcctcattttactatgaatttcagccatgaaatttaagtgaaaaagataaatggcatccacttagcagttccgttcttctcaggatggaaaaggggaaggaggaaaaatagctagtgggaaaaagaattgcaaaaatcttcactttctaagctattgctccaagatgcaacacacacacacacacacacacacacacacacacacacacacacacacacacacagaaaatcaaaagcaggcctttgaactgcagaatatgaactggtctctcttacaaggcttgtagaatacatactggtaagtaagtctggatgggttctgagggcagaaacactaaagaaattcagaatcaggttatccaaatcatatagaaagcttcatataaaattcccttctcttttcctctgagagaagcctaatatattgacctatctcttcagagtcataatatagtgcctgtcttccaaaattccctggaattctcctgacttcaattaatttgaaattcaagatcaattttgcagcatttttagaaatatagttcttttcctttccttccatcccaccgagaacagtattgattttatttttacttgctgtaatctattaatgtgacaacacctaaatccaaagaagcacacactttgatttttctactaataaaatattgctgtgcatacaaatctgaactcaatcacttattgattgggatttacacaaaattttaacatgacaatcttttgaagttgtgcacattttgtgtatgatatcaagaaaaatacttagtattaaatacatagctaaatactacagcgatctacttagagctccagttactttcattttttaaaatacattgcatataaaaattgagttaattagcatacaaaaaagaccacaattcagacttgttttttgtttgtgttttctgggatacacttacatatatgtagagtaaacagtgcaattaatggaaattattaagaaggacttttttagacatgtacacataaagaaaaaagagactaggctttctgtatgcaaagatgttttgtatctcagtatttctgaggttgtgaatgctttgtattttctttgatttgtttaattatattttgcaaaatgaacatgtgttttctttttctgtaatatggaaacagaagttagctctttataagggctgattttaaaatttgttcagtgctactttttgcatagaaagcatacatgtaaaagatatcattaaaaagagtcctcaaatgttgtaccttgtacttgtaagtttaaaataatttcatcagatccccagttgttattggcaatgcagctgtaatagccggagtcttctgctttcaccgtgcgaataatgaagcttccgttgctaaagatgctcctccgcccatcaatcgttactagactgggtgtcccgttactgcctcacaggaagaaaaatgcacagattaaagaaattacaatccaaattagctgaggttggggaaaaacagaaagactctgtgaagcaaaccacacatttggaagcttcatatttcttgcattatgaaagaactaaatatgattacataatgaaaacaatcaatagctgtgtagctgaagttttcctttgtaaaaaatgttacgttgaagatgagatctgtgtcaagggcccagattctggctcaagtcagtggactcctcatctgtgccagagactgatgggtccctctttactccactctgtgggcactggagatatcctcattttggcaattctgggaatttcttctgtaggcagaagtgccagtttgaacaaatcatacaggggaaactaaaccttgggatcatttttagattcacttaaagtcacaattattcatgattttgacatgaaaaatgacatgtgatatctcaagagggtgatgagtttaccctagtataaaaagaactgcgtggccatcataaccactgctccggtggcagattgtccagtcctttggggtcattcccacaacaggcagaatgccaacttgaccttgggagctacatatttcatttggatgaaccaactttaaatgtatgagaaaagtggtcactaaaccaaaccattatttctacagtttggtcactacaccaagccattatttctacagtttatgccttctaagtgcttttgcttgaaaataggcattcttctgaatccattagatcacatttctatgctcataaatgaattttcgacccttaacttatatcctaatttcttctcctgaatagagatatagcactttaaaaagttatatggacagaccatatctcactcactctctccctctatcttggctcctattatttaaataattactatggagtatggagaaccagattttaaattagcaaagtcctaatgtactccatttcttaaagttctttctcagggtatttgagttatggttagttcactatctttaaagaagaagagataggtgttaaatctcacaatagccttggctgcattcatctcagttacatggacaatttacctgagagggtgcagcaaacttccacaataattgagttggttcaactactttccttgcaagcattctctcatgaactagaaggctctgaattaacagagggttgatacaataaatcagaccctttcagtgctaaagctgagattccttctctgccctcatctcagaagaattggtaggtttccttgagttttcactaatataaataaacacaaaattaggagaccactagacacaacctgagtatgtcagatgtaatctcttagagtctcactgaaggcatacattgggttactggttacctgtctttcatccatttgactgcaggagaagggtccccaacagccttacaaggcaagacaatgtctttcatccatggagtagtcactgtcccactgaaggtcaggattcgtgcaggagctgaggaaccaaacaaagtggaatcctgattactccacagacgtgtctacacagaggccaacatgacctactcaataagggcaatacctaaaaatggatgtgaagccaattcacattacaactgtcaacactactctctggtacccgggttatgaggaattgtcattgtaagaacacacaactagcagaaaattcccattgtagcattcttttcttctattgactaaacatgaggagtccaaattaaatatctagggcttcataagccaagcagctccaagctgtgttttctatgagcccaattatttctcaaagcactttaggaagcaatttacctcaacacaaaaactgctcattaaaatatactttaatatcagagaaagtagacaatacaaaacacaaaggccccaaagacgggaaggagtaaaactggaacaagttctacttaacaatttcccgactgtattatagcaagttgatctttaggacacacattaaggagaatgaacattttcagagtggcctctcttgaagaacaaccatttgcttggaacagtgattcagatgcccaaacaggagcatctgccaggggcatctggtactggtgcagccccaaggtagcagaagtcccagaagacagtcagaaaaagcccagggtgaacttgccttgaagtccagtgtggccagcaatgagaggttctagtgctacctccatcagtgagtcacaaaagctgacagggacaccacacacaagtcttccagaggaaaacaatctgctcagtctttgccatacattgggacattactttctggggtgtaaacaggagcccggggcttctcctgtcctttgttttagccagtatgcttcagacactgtcatggagctggggacatagaggaaacaggtgcccctacaggagctcaccctcgatggatgcacagaccggaaaccataggtggaaggcagccttgaactgattcagagcccataaaaatgggacaaatgtgagacccctgcaccatttctgggttgagggtttgcattggcaaaggaagatgaggagaaggctcccccagggaagctctagaatccctggaagggcagagtacccagagccaagtcattatgcagccatcctagtatagaatacccacattagtcactaggatctaccagaccaaatcatacatttttgcctctgggcactgtgggcaagagtagagagaaaaagaaaatgccagagggcttagaagctggaccttgttttttgttgcagcaaaacccatgtttcaagcaatttccctggactgagatgaagtattctaaggcagggcccatttcatcagtcattgacatttctgattttgcatcatgataacaaaaaggtcctgattaggcagcatcagatttcctgcattggtagcttttggcattttctttttcacacacttcagacagttctttagagagtagagaatgtcctcagcagtaaaaggcgggtggctagagaaattcagctagagttaggggctttccagctttataacagtcacccactttaagaaatatgttttacatcaaactccagaagctacacatgcattgggatgttgtgtatgtgcaaacaaagttgcatgaataaagacttcactgtatgtgatgcattctgatattttctgtcttttttaaaccctagtttagtctagtctagttgatttgactctgttccactctattccattgttgttctttaacattctgggcataacccctcaaattaactccaggacttatgaatgcttttccattagcaatttaaaaaatacaagctagagctacttcatcttcaagcccaacaacccccatgctatcgctcaatgcccattttgcccattttagacggctgaaatttaaagggtctctagccagaaatgtatgactgggcaactcaacacactagacctggggcagccaagagaatcccctagaatctttgtttaaaatgcaggttcccaccacagccttgtggattcagcagctctttcctgtacttggggcatctgccttttgacaagcatcccaggtgattctgatgagaaactgaacccctctgcaacctggtgtcccctctgattcgggtcccgtttgttctcagccatggggccaggctctctgtgccttcgtgtcctggaccccttcctaggaggggcttcccccaggaccagtgccatggccccattctgccactccctccataaaagcagtggtcctcctcttcttcaactgtatctgaattttggaccctgctacctgtcgctagactgctgctggtctgccttgacttcccaacaactacagaataacctgtctcaatctcctctgctgtggacatccccatccctctaggatgggcctttcagccttcatggtttgccagtgtctgggcttctgggtgggggctgcccaactgactgtctgctccatcctgaggcactccctagcttatcccctttccagaaaacctacctacagcaatcctaaccctgagtcaacctcccttaagcatgaaaagttgaacatttctggaaaaaaaatccacgcaatagagcatttggagattgaccaccatttaggatcatcaacctcaattgaactgtcagcactccctgctggtcttactgtttctttagtaaatgtcctccccattccctgcaacgatggcttcctgctgtccctcctcttctcacacttctgggcttccctccactatccccaaattgcctaatgcttcagagacaccatccaggaaccctgcatttccagccaccaaatctgtgaacctactggcatttcctcctctaaacctcagtgctgtggtcgtgggctctttcttatgtattgttgatttctcgtttctccctctctactgggatcttcccgttaccacataaacatgctctgatggcaggcctcatgaaaaataatgaacccagagcctttcctcgaatgagagcctccctccccctcccagcttcttctcttggttgtcacttcttccaggtgatgtgtgttgaaggaatgttctgcccagtcagcctgcccctcacctcctacccactttctcacctgactcaggctcatttctgcatgcccctccacacccactgatgctgctcacaggaaggtcaccacgatcttccgtgtggccactgaggggcattttcgcctggttttgcctgactttccagcagcagcagcctcacctgaccactccctccttttgcaagcatctgttttgaatccacagcctaacaccctcctggctctgctgcctctctggcttttccccttttcctttgcctgctcccactccctttgagagtccgtcctgcaccttcatctctcctccatctctcagccaatctcattcccatcccaggtgtaagcgatatccagacgctgacccgcctgaatttctgcctcctgccagatgtctcttgagagccaggacatgcctcagtgcacagatgcctctgagtgaatggctcttcgtcaccttggattgaacccctccaaatgtctgtacctcctctcactggcttcaaaatccacttcttccatggtcttcttcatcaagaaatcgtgcctccacttatgctaactcatgtgagaatttgggtgttcattcttgctatctccttctccaccctcctccatttctgcctctctgcagtccattcaggacagagagaccaggtggtcttaaaaagcacacccgccattagttgtaagaaaggcatttaattaggatgtctataaaaagggaaactaggtgtgaggtaaatggcaactctctgtactatcatcacaatttttctgtaaatctaaaactgttctaaaaaataaggtttatcacacacacacacatgcacacagagagaaagagagatcatgtgcctcccttgcttaaaaccctacaccatctccttatttctcttgcggcaaaatctgaaatccctaacacagtgttgaaaacccagcatgatcaggtccctgtcttccttcccagcgtctctgggaccactgttccttccccggccccagcagggtccagtgtcctggacctcccacctgctaaatctttctctgcaggagcttctgactgctcacttcttctctcttcacataaccgcctttgcttgtgctcagggaccaagtgtgtcctccatctgacactccaggtgaggtcctctcacactatttctttatagcacttactacagtttgtctctatgcatatacttttgtgatgctttgtttactgactgtattagtctgttctcatgctgctaataaaggcatgcctgagactgggtaatttataaaggaaaggggtttaatggactcacagtgccacatggctggggaggcctcacaattatggcagaaggtgaatgaggagcatagggcatgtattacatggcggcaggcaagagagcatgtgtggtggaactcccctttacaaaaccatcagatctcgtgagacttactcactgtcatgagaacagcacaggaaagacctgctcccatgactcaattacctcccactgggtccgtcccatgacacttggaaattatgggagctacaatccaagatgagacttgggtggggacacagacaaaccatatcactgactggctccccaccaaactgtaagcttcagggggtcagggagtgaacacatctcttaaaccatctcaaaagactcctctgggctctccaaaccctgttttcttttccctggtgggtccatgcctttattctagacaataggatattagtaaaaataatgtatacacttccgtatctggctcatgaaaacctctcatcaaaccctccatactcccttcttcccccatctatttagctgtaaatgaggagaaatccagggttgtaaatcataaggtggaaggggcctggatgcctgaatcaccatgtggaacaggccacccaagagagccctgaccaaaaatacctctgttggactatattattatgtgaagccactgagatttagggaacatttatttcagcagtcagcctcccttgaccaaatcctctgtgtccccagcatagaccctgacatacaacaggcactcaaaatgacttattaaatgactggaggacattgaatttccccaggcaagacctgcttctgtgagagttttcaattgttcccccactgagtaagtcataccccactgcactagccaggcctttctggctgtgtctagagatagaactttgaaagcacaaaggaaaggaagaaacattattgctaatcctatgtgttttgttgcagtgtttttttgtttgtttgtttttgttgtttttttggtaaatcccacagctcagtccttatgtccaacattttccttggtaatcatcattttctcattctcagggagtggctggatatcatgaccaaagagtgtaatacataaagtaagtcccccagtttatttcccttaccaacttacttattttctatctgtatttgagctcaaaatgtgacacccctcttttttcccctcactgctttattctgcctatttcttaactatctcattaaaaagcacatttttcagagaattcttggaggtaaaattggaatcttggaatgttcattcttgtctttcaggctatcagagaacatattagtaataagttgccactgttctataactcaaaattaggggcaactcctgctggcctggaattgtgtcgtaaggaaattgacttattatgaatgctaatttagggggttcctggaaacactggatggccgtgattaccagaagagcaagaataccccgtgcctgcgtgtgctttttaaggaccagtttaacgtacaaatgtgaagatattatattcactttaaggaactttttattctttggtgactcctacttcctgctgttacttaaagtctttgcttatagcattctgtcaacagatagtgaatgattttcaaatatttttaagcttgcaaattccatagactataaaatagacatttctcattaagaagtgtgatacctgattttgctgaaagtagaacatccttgggaaaatgccgtgtaatgattttcagctactccaaggaatgaatgagggctcctttcctaattttcatagacacttccattgtaaggccactcattctcagctttgtgtttacctccagggaattacttttccatgggacagaagctcagagcttgttagccacaaccctgtttcttgagctaaaatgtgatattctggtttatttgatttttaggaaagtgtaagttttatttcaggtaaaatagagacttaaaaacagtcaagttacaacaggaaatgaggtccttatagccactgcctaccttttgctagtggctcgactgtgatgatttcactgctgttgcctcttccggctgaagtaacagccaccacccagacgctgtactgacgattcctactcaggttgggaattctgtaggaaaacgagtcgggagaggcctcaaactcgctgatcacctgtaaaaagagacataagtgttcccacattcaaagaagcatgtggcaaaaatggatttcccgaaggaatggtcatgaacatattaaatatcataacaaaaaaactcaactcactctcctctaaaaggctggctttgcaatataaaatgtaactggtaagtttaagtgacccaccatctacatttttctctgcagcagctttgatggccaccaataaataatttacccctttacattacaggccacagcacttctgtatttggctgagatggagtaacaagaaccagatttaccctcccacctgaaacaactgaggaacacacaccatccataaaacaatggttctaaaagcattgcacatcaggtaataaatgacagtgatctctgaaagatgggaaacgaatgaagaaaaccccacaatcgcagagattttgcaatttgtagggcagtgtaaattttatttctgataaaatagagagctccacctcctcaactcgggaggttggcagcctttccaagctaaggaggcagagctgagagcctgaaggaagctagagttcacaaggaagagcactggaaagagagctacacacaaaggacaagctctggagattgaagagggtcctacttgggtattcagctgagcagatccatggatgcatgtgaggaaactacccaaggccagggaaagacacctgaaagaattggaggtcacggtgcctaatgctcacacagggatgggagtagtggctgttctcaccagttgggttggaaaacatcaagattcctcgagcattgggtatagtgcataagggtcttaccacaaaggggaaataattagccccaggctgaataccactccagtctttcctaattattcttaaaggcaagacttagagagaacaaattattcctaaataacttaactacatccaagaataaaggtcaagaatatttatagaatttatagaaattgaagcatgtagtactccaaaaggtgaagttcacaaagtttaacacctactaaaatatttccacaaacaaatagcccaaatatgtgtcacctgatgactggataaacataatatgtcacagcgataccatggagtctgtattagtccattttcatgctgctgataaagacatacccgagactaggtaatttataaataaaaagaggtttaatggattcacagttccacatggctggggaggcctcacgatcacggcagaaggtgaaaggcatgtcttacatggtggcaggcaagaaagaatgaggccaagcaaaaggggttcccccttgtaaaaccattatatctcaggagacttattcactacgaggagaacagtacagaggaaactgccctcatgattcaattatctcccaccaggtctctcccacaacacatgggaattatgggagctatataattaaagatgagatttggctggggacatggagccaagccatatcagagtgttatgagataatagaaaggaatgaagtactgataaatgctataacttggataaatcttgaaaacattatgctaagtgaaaggagccaattataagaaaccacacatttgtgattctcttcatttaaaatgttcagaataggcagatcgatggcaacatagattagtggttgtcaggggcagggtaggggaaggggaaaattgggaatgactgctaatgggcgtgcagtttcttttcagggtgatgaaaatgttctaaaattagatagtggtaagggttgcataactctgtgaatatactaagagccactgaattgttgaagttaaaagtgaatgacatctcaataaagctgtcataaaaatttccaggaaaacataattcataagaagaaatcaatcaatcaaaattcacccataattggcacagacattagatttatgcaaacaagggcaataaagtagttataattgtattatagcggtattataactgtatatgttcaaaaatttaagtagatatgatacaaaaagacctaaattaaactcaaaatgaaactataatgcatgaaataaaaaatacattgaacttgattagcagcagcgtagatattgcagaaaaactgattagtgaacttaaaggtgtggaaggaaaataaatattggggcccccaaatcactaagctaaagggaaaagtcaagctgggaactgcttagggcaaacctgcctcccattctattcaaagttatccctctgctcactgagatagatgcatatctgatggcctcctttagaaggctaatcagaaactcaaaagaatgtaaccatttgtctcttatctacctaggacctagaagccccctcctcacgagccccctccccactttgagttgtcccgcctttgcttcaagttgtcctgccttttcagatggaaccaatgttaaaaaattggttgatgtctcatgtctcgctaaaatgcataaaaccaagctgtgctcggaccaccttgagcacatactgtcaggacctcctaaggctgtgtcatgggcacgcatcctcactttggcaaaataaactgcctaaattgactgagacctgtctcagatatttgaggttcacaacacatattaataaatgatacatagaaaagagaataaaaaagttaacagggcattagtgagctatggaaaaatatcaggctgcctaacatgcacatagtggagttcctaaaggaggggagagagacaggaccaaaaaaaggttgtaaaaatagtggttgaaaaatttccaaatttgatgaaaactgtagcccgcagagccaagatactcagtgaattctagccacaagaatattaaaaaaaaaaactgtaccaaggagcatcataatcaaactactcaagagttttagtttcagtgctagagagaaaatcttaaaagtagccagagaaagtaaatgttgtgtaaaggggaacaaagataagcatggcagccaatttcatttgaaaaacaatcaaggtaagaagacagtggaatgatttctttcaagtactgaaagaaaaaaatcaacctagaattctatattcaacaaatataattcaaaatgaaagtgaataaagacttttttcagatacataagaagctgaaagaattaatcaccagtagacccacattacaagaaatgttaaagaaagtccttccagcagaaggaaaataataccagatagacagagacataaatgtacacaaataagtagaaaaaggaggtaattatacagatacatatatatggtatttcttatttaaatattattaaaatatggttgatagttaaaaacaataccaatgtaatgtgggtatataatataaataaaagtaaaatgtttaacaatagcacaaatgttgggaggaaaaaatggaagtatatgattgtaagtttcttatactatatgcaaagtgtgtaataccgcttgaaagtacactaagatgttaaaagtatatgctgtgaattgtaaggaaactgctgaaattacaaaatatagcataaaataaagctaatgaactaataagataaataaaatggaattacaaaaaaaaccccaaagaagtcagagaaagactgacaagggcaacaagtagcacaacagcagcagaactcaaatagcaaatagcactacacagagttaaacataaacatagtaataataattttaagtataaatgatctaaatatattaaaggcaaagattgtcagacctgatataaaagcaatatccgactatatgctgcttacaagaaatgtacttgaaataggccaggtgcggtggctcacgcctgtaatcccagcactgtgggaggccgaggcaggtggatcacgaggtcaggagattaagaccatcctagccaacgtggtgaaaccctgtctctactaaaaacacaaaaaattagccgggcgtagtggtgggtccctgtagtcccagctactctggaggctgaggcaggagaatggcatgaacccaggaggcggagcttgcagtgagccaagattgtgccactgcactccagcctgggtgacagagtgagactctgtctcaaaaaaaaaaaaaaaaagaaagaaagaaagaaagaaagaaagaaagaaagaaagaaagaaagaaagaaagaaagaaatgtacttgaaatataaaaacacaaataggttaaaaataaaggaacttaagtgatatcctatgataacactaatcaaaaaaatatggaatggctatagtaatatcagacaaaatagatttaaaagcaaaggatattaccagtaataaagacagaaatttcataacgataatggggtcagttcatcaagagaacataacaattctaaacatttattcacctaatattcacctattattcaaagatatgaagcttggttattaggtgaataaacgtttaggatttattattacatgaaacaaaactaatggaacttcaaggagacatagacctagataggtcagaattgttccttaaaaagccatgtgaagtaggtggagctggatccattttatagatcaggaaactgaggttcagagaaagtaagtgattcactgatgtcacaagaccagacaactgcagaacaatggctccagctcagggcctctggtcccaagtctggtgctatttcctcacactttatgctgtcaattagaagtgaccaaaacaagaaggacttacttttactcttgttagcttttcaataaaccttacatgcctcagcaggctgcataagttacaataccagtcatgcaattaaacaggggatttaaatcttcactatatctcttaattgtcatacaacctcatgcttcctcaacaaaacataatgtcagataattacttattgtcaaaactttaatttgtgggtacacagtgtcagatgatttggagagactcttgcatggattccctagatacatcactataatctagcatgcacgtgcatgtgtatgcactcatttacacctcacctccacccccctcccactacaacactccagtcacgtcttagagtattatgggaaaattagtccctctagaagttcagagggaatttggcctgtttcctgataaaccaaagagacaatcctgagactgtatgtacttgcattgtgtgattctccaaggctatgtcattgccaaattaattttacaaagcttaatgatgtgcaaattctaacaattactcttactgaacattaagcatcaggaaagcattaagatatatttataaaataaagatctttttctgtgtagacaacatagcttttagttaaaactccatacttatcctgttgacaaggtaaaattcgttcttgattacctccaaaacacacactttaatttttgcctgtaacataatgcatggctaaaatcaacaataaaatatgactttttatgcaacaagatttgtttcatcatttatatagaagactaatcaagaattgaagtaaaaaaggtatattcatagaaacttccttaatttctccgtaggttaggatgaaaaataataacgtcaagctgttagtggctcctattggttatttgggtaagttagttacactgatgtcaccaccctttgatgccactgtgtattcctctgaggactgccataattaggcacaattttcctggtcttagtagaagggcaagcagaaagttgataactgaacaatttaaaccatcagagttgatttattttctttggaatatatgtaactggatattaaagttgactcttcctgttctctggaagttttagcgatgatcttaaagcgtgagaatgctcctaaagatgccagtgccttctttcctaacaagagctgtgaggccacctgggcaggacttgctggttctcatgttttgccagtcatccatttccaggctccaaaagaggctggggcaggaataaggattttctgttgagagaggtctgtgagtattccctcttatgggtggaagagggctttgagctctagggaatctctcggagaacttggagtctgaaggacacagagcttggtaagtgagccacacctgagaaggctaatggcgaaccacagtggcagaggttagccctgctcacaacaggagaggaggctgggctggactggccacgcctcctagagtgaagcagggtaaggatgcctactggttgaccctagaggacagagcaagcctggatgtcttgagagagagaaccataggcatgaaatgcctccaacagagggatgcagtgtaaattatatagtatttattgtaaacagaatcattagctatggatggtgcataactcaatcattattaaccattttaacagtaggtaggagaaaaaagaaaaaaagagcaaaatgggaagaaaataaccagaagttctctcagtgtagtggagccaatctagttgattaaatcctttttaatgctcagccaaaaatgcttgttctgaaaagaagggatgataaatatcatctccttttgaaatatttccctccatattttattaagttaggatagcatggactatatttatatttcattaattttctttttattggataccagattttccaacacaacaatccaatagtgtgtaaactgacttgctaatttctacatgcatattttattacgtagcactctcttccaaatatagagaatgttcaatgagaagggatcactttgatttccagatttcgcctgatatatcagctgggttgctatttcagagactctgaatcttttttttttttttttttaaagaaacaaagcaaagcttcgctatcaaggacaacagataaacactgcggtataaagaagggcaaactcacaatggagtttcttagggattaatgaaccaaatgtggcaaaaggagaaatctgtggggaagcaacagagacacttttcttaatatttaaatatttcattttcttcaggtagactttgaactctccagtctcatcttctttagagttaagacagacgtgtcagtcatcctagattttgttatgcctaaagtgtgaattaattttgagtggactacagtaattgtgctaaccatttgtttgaagagaagacataagagttcctttgtgacctgtggaaatacagaaacagccaacattacgaagttgccgccaggcatggacttgagggatcccatcccccatgtccctgaaccagaatgccagggattcccttccatggcttatttttaatcctgctctgtctatgcccagcttgaggaagtggatgggacatttgtggactggggttgccaattattttgcatctgtcatatattcctcttggctagctgaggaaaaagcctgttatttctcatctaaaatgtgtttaaacatgtaggctctatccaagttgagaagcaagccaacatttattattaattaatcacttctcaattgaaaggctctaagtggctgccaagttactgatttcttggtccaccagataacatggtggcatgagaagaacagggctctctctggctcagcggtccccagcctttttggcatcagggacagatttcgtggaagacagttttttttttcacagatggatggacgtggtaggatgggatggtcttgggatgaaactgtttcacctcagatcatcaggcattagttggattcccataagaagcatgcagtataggtccctagtattagtccgtagcccgggggttggggaatcctgctctaccgatgtcatgtaacaggggcaatccacagtgttcttaggggaagatttgggtatttggtctgaggacacacacataaaatgtaaaatatgcatgttgcttatgtaatgaaccatctcaaatactattcttacagtgggctggtcatggtttttactgtgggaggtggtgggggggggtccaggcagacactgctgccttcaaagtatggaggtctgtggataagggatgttggcgagagttataggaccccatgagccagacatagaagcttgttggactatcgttctctcctttgggctgtgggaagaaaatctaggcaaaagttcttagcttcatgcctcgtaataggaagggcttgtaaataattactgagtttcaattaatggtcatttactgagttcagttgcagtgtgtagattataaggcaagttcctgcccccggggagcaagaagtgaccacagcttggcaaacagattaatttaaaatgaggcaccatagaagtctgaccaattcctactaaaatttagatataaactcgtttgaacctttctctaaaaccaaccctgtcatagttgaagacatggatgaatatttataagatgcctaaaaaataaatggaaacttcatatatttgttttaaaaaatatttatagcaaggttttacaagacttctgacatgtttgcctccccaaagccgtatccagagtggaaaatacagtaaatgggataaatcttgtgacacccaagccagagcgttcacatttcaagcgttttgtctttgtatgttactgctttaggtctgctgggtagagtcgtgggttcctaaggaactaaatgtgcacagtttactcttccagtcaaaagagtgtaagggttgtgaggaagttagttttctcctagtgcttcagggtcaactcatggaaagcctgggaacagcgtcttctagacctgccttcattccacaattattgttgccttgtggtgttgatataatatttttcttttcatgtgtaagatgcttttgaccagtaaataagatataattagccacagtgaggcactttaaacactctttggtcatgtctataaaactagacgtttacccaataattgccaaattcatttccgaacccctcacattacttagcttgtagctgcacttgtaagaccttgcagagccttctctagtcctctcaatcaggggctaagtctgccctttgtctttcatagcctttgcctttattccactgtgggttatggtcttgcatgtgcttactgcatctccccaggggtcaggctccccgacccatccctctactccttttactcacccatccctctactcactctgcagggaacctggttcagagcattgcttagagctgggactcaatgaccagtaactggaatacactgaagaaattcttgttgtactaggtgagtttagtaatgacctagaaatgatttgagtacgataggaaataatgaggataaaatgactacaaagccataggctgttcatgtcaaactattcagcctgtctgatataaaaggaattctacttttaaaaatttcaattaactttttaatgaaaaactaattctataaggaaatgtgatgttttaaaaagctctgatagctaattgttaacatgcaattaaaaaaacttgaaggctgtgatttcatagatagaatgtccacagcagtgaaaaaaaaactcccccaagcaataaacaaaattgatagctcttttaattatagggtaagggaacttttagaatgcttaacatcttcttgtttagtggcaaagaaatggcctggattccattaagaattagcagttcactgcattaatttaagatttttaaaattcttatgtataatatattttgatctaatttccattttatttcacagttcccatctataaaagaagatgtcatggcagaaagatcttcctaaaggcataggttgagaggccaacattggtagaaatgggataacagccaggcaattctggtagtttcctctgcctttcactgagattactgtagataccattacatatatgactatatatatgactatatatagactatgtatataactatatacatagactattggctacttttaaaaagcctttcaaatataaaatattttatatatgaccatatatatatatatgactatagataccattatatatatgtctatatatatgactatatgtagactatatatataattatatacatagactattggctacttttaaaaagcctttcaaatataaaatattttatttttggccttccaaatataaaagttattgctataatgttttgcaactatattaaagttgatatccagagaaggcatgagaaaaactagtttcttgatgtaattgtttagaattagaagcaccatccaattagcccaggtggcattacagatacttatgttaacaggctctttccaaccgatataatctccctttgctacaatttttcctcatccccttttcattgtcataccacctgccatgaaaattatctatctgtcaaagttacattattaatttaacttgattgctgtcacctattcaacaaattctgtacaaaaaaactaatttgttatcatatagtttctcacatacaagaaattaatgagaaacacaattcttagtaataaaaataatatatgcagaatttacaaaattgaaaaaaatagctctttccactagtgttaattgaaaaatgatttaaagccaatttatttccttaaatagtacaatatgtctgtgtcaggccaagtcaaaaagataagatgttttcaaagctgcaatcttccaaaagctccaaaagctaattgataaaaagggcattttagcaaaactttggagacagtaaaaagatcagaggttaagagggtgggatgaataggaggagcacagagggttttcagggcagtgaaacttctgcatgatgctataatggtggatccatgtcatcaaacatttgtccaaacctataaaatgtacaaccccaagagtaagtcttacataaactatgaacactggctaataatgatgtgtcaatgtaggttccaccattgttacaaatgcaccactttattgggggatgtcgatagtgggggaggctgtgcagtaggggcaggggcatttggaaaatctctgtaccttcttctcaatttttctgtgaacctaaaactgcttaaaaaataaagtcaagttttttaaaggcattttagcctgtggataatcagaaagctctacgcagcaatggggaagtacattcagggtggcatacactaagctacctagtctgaatgaatgctacctcaaagctagaatgcttagtgacaggttatctgacaaatcaggcaggcagtcttatgagactgagcttcaaaagagatttccagggcctctttctgtatgaaaattttaggggagtatatgcttaagttttctttgctctataaattacatgattgggctcagaattttaaaggccaagatttctaccttgagtataggccatctgcattttaccagttatagcaattgaatgatttcacataatgcctagtggacaaacaaccactgagaacaatatgagaagaaaactgaaatatagcttcaacagaaagattgagtagttattggcttgttcactgtgtgatatgggttggctgtgtccccacccaaatctcatcttgaattgtagttcccacaatccccatgtgccgtgggagggaccccgtgggaggtaactgaatcatgggtgtggttaccctcatgctgttcttgtgacagtgagtgagttctcatgagacctggctttataaggggcatttcccgccttggttctgcacttcctcttgctgctgccacgtgaagaaggacatgtttgtgtccccttccaccatgattgtaagtttcctaaggcctccccagccatgctgaactgtaagtcaattaaacctctttcctttgtaagtcactcaatcttgagtatgtctttattagcagtgtgagaacagacactgtgaataggataacagggaaaaaagaccactattaaatgataaacttataaaaaacaacatcgacttcccttccactttcttaaagaatagaagtcaaataaataggcaaaaattgcacacaaaaaactgagaagatttagaaccacattccatatctattgagataatcatgtagtttttgtctttacttctgtttatgtgatgaatcacatttattgattgagtatgttgaaccaaccttgcatcctgggaataaagcctacttgatcatggtggataagtgtattagcccatttttatactgctatgaagaaataccagagactgtgtaatttataaagaaaaagaagtttaatggactcacagttccacatggctggggaggctttaaaatcatggcagaaggcgaaggaggagcaaaggcatgttttacatggtggcagacaagagagggtgtgcaggggaactgctctttataaaaccatcagaactcatgagacttattcactatcatgagaacagcacaggaaaatccgcccccatgattcaattaccttccaccgggtctttcccatgacacatggagaaaatgtgaggtacaattcaagaagagatttgagtggagacacagccaaactatatcaataagctttttgatgtattgctggattcagtttttcagtattttgttgagatttctgcattgatgttcatcaaggatattctcctgaagttttcttttttgtcatatctctgccagatttgggtatcaggatgatgctggcctcatagaacgagttaggaaggagtcccccctcctagattttttggaatagtttcaataggaatggtaccagctcttctttgtatatcttgtagaattcagccatgaatccatctaatcttgggcttttttcatttggtaggctacttattcctgcctcaacttcagaactcattattggtatgttcggggattcaatttcttcctatttcagtcttgggagagtgtatgtgttcaggaatttatccatttcttctaggttttctagtttatgtgcatagaggtgttcataatattctctgatggttgtttgtatttctgtggggccagtggtaacatcccacttatttattctgattgtacttgtttgaatcttgtcactttttttctttattatcctagctagtggtctatctattttattttttttttcaaaaaactagctcctggatttgttgatccattgaatggtttttcatgtctctatctccttctgttcagctctgattttgattatttcttgtcttttgctagctttgggatttgtttgttcttgattctctagttcttctagctgtgatgttaggttgttaacttgagacctttctaactttttgacgtgggcatttagtactataaatttctctcttaacactgccttagcagtgtctcagagattctggtacattgtatctttgttcttattagtttcaaagaacttcttgatttctgtcttaatttcattatttacccccaaagtcattcaggagcaggtcattcaatttccatgtaatttgtatagttttaagtgaatttcttagtattgattttgaatatgattgtgctgtggtctgagagactgttacgacttcagttcttttgcatttgctgaggagtgttttacttctgattaatatgatcaattttacagtaagtgtcatgtagcaatgagaagaatgtatattctgttgtttgggggtggagagttctgtaaatatctttcagatccatttgagttctgtagatatttatcaaatccatctaattcaggacctgagctcaggtcctgaatatctttgttaattttttgtctcaatgatctgtctaatattgtcagtggggtgttaaagtctcccactgttattgggtgggagtctaagtctctttgatggtctctaagaacttgctttatgaacctgggtgctcccgtgttggatgtatatatatttaggatagttagatcttcttgaattgaaccctttaccattatgtaaaatataggatgatgtaaacttaggacagttagatctttgtcttttttgttctttgttggtttaaagtctgttttgtcagaaactaggattgcaacccctgcttttttctgtttttgatttgcttactggattttcctccatccctttattttgagccaatgtgattatctcaaatagatgcagaaaaggcttttggtaaaatccaacatccattcatgttaaaaactctcaataaactagttattgaaggaacacacctcaaagtattatgacccatatatgacaaacccacagccaacatcatactgaatgggcaaaagctggaagtattccccttgaaaactggcacaagacaaggatgccctctctcaccactcctactcaacacagtattggaagttctggccagggcaatcaggcaagagaaagaaataaaaggcattcaaacaggaagagaggaagtcaaactatccctatttgtagatggcatgattccatatctagaaaatgccatcatctcagcccaaaagcttcttaagctgataaacaacttcagtaaagtctcaggatagtgcgaaaatcactagcattcctatcctctaacaacagtcaagctgagagccaaatcaggaataaactcccattcacaactgccacaaaaagaataaagtaccttggaatgaagctaactaggatggtgagagatccctacaaggagaactacaaactactgctcaaagaaatcagagatgacacaaacaaatggaaaaacatttcatgctcatgaataggaagaatcaatatctgaaaatggctatactacccacgcaacttatagattcatgctattctcattaaactaccattaagattcttcacagaactagaaaaaactattttaaaaattcagttggaaccaaaaagagcccaaacagccaaggcaatcctaagcaaaaagaacaaagctagaagcatcatgctactggacttcaaactatactacagggctacagtaaccaaaacagcatggttctggtacaagaacagacacatagaccaatggaacagaataaagaacccagaaataagactgcacatctacaactatctaatcttcaacaaacctgacaaaaacaagcaatggggaaaggactccctattcaataaatggtgctgggataactagctagccatatgcagaagattgaagctggctcccttccttacacgatatacaaaaatcaactcaagatggattaaaaaatgtaaatgtaaaacctaaagctaaaaacactctggaagacagcctaggcaatactattcaggacataggcatgggcaaagatttcatgatgaagacaccaaaagcaattcgcaacaacaacaaaaatggacaaatgggatcaagtaaatgaaagagcttctgtgcagcaaaagaaattatcaacagagtaaacagctgacagaatgggagaaaatttttgcaaactatgcatctgacaaaggtctaatattcagcctttataagaaacgtaaacaaatttacaagaaaaaaataaacaatccgataaaacgtgggcagaggacatgaatagacacttttcaaaagagaacctacatgcagccaacaagcataggaaaagctcaacatcactgatcattagagaaatgcaaatcagtggtgtggagccaagatggcggaataggaacagctccagtctacagctcccagtgtgagcgacgcagaagatgggtgatttctgcatttccaactgaggtaccgggttcatctcactggggagtgtcggacagtggacgcaggacagcgggtgcagcgcaccgagcatgaggcaaagcagggcgaggcatcgcctcacccaggaagcacaagggttcaggggattccctttcctagttaaagaaaggggtgacagacggcacctggaaaatcgggtcactcccaccctaatactgcacttttccgatggtcttagcaaacggcacaccaggagattatatcctgtgccttgcttggagggtcctatgcccacagagcctcactcattgctagcacagcagtctgagatcaaactgcaaggtggcagtgaagctgggggaggggcgcccaccattgcggaggcttgagtaggtaaacaaagtggccgggaagctcaaactgggtggagcccaccgcagctcaaggaggcctgcctgcctctgtagactccacctctgggggcagggcatagccaaacaaaaggcagcagaaacctctgaacacttaaatgtcactgtctgacagctttgaagagagtagtggttcccctagcatgcagctggagatctgagaacagacagactgcctcctcaagtgggtccctgacccccgagtagcctaactgggaggcacccaccagtggggcagactgacacctcacacggccaggtactcctctgagacaaaatttccacaggaaagatcaggcagcaacatttgctgttcaccaatatccactgttctgcagcctccgctgctgatacccaggcaaacagggtctggagaggacctccagcaaactccaacagaccttcacctgagggtcctgactgtcagaaggaaaactaacaaacagaaaggacatccacaccaaaaccccatctgtacgtcaccatcatcaaagaccaaaggtagataaaaccacaaagatggggaaaaaacagagcagaagaactggaaactctaaaaatcagaatgcctctcctcctccaaaggaacgtagctcctcaccagcaacagaacaaagctggatggaagatgattttgatgagttgagagaagaaggcttcagatgatcaaacgactcagagctaaaggaggaagtttgaacccatggcaaagaagttaaaaaccttgaaaaaaattagacgaatggctaactagaataaccaatgcagagaagtccttaaaggacctgatggagctgaaaaccacagcatgagaactacgtgacgaatgcacaagcctcagtagctgattcaatcaactggaagaaagggtatcagtgatggaagatcaaatgaatgaaatgaagtgagaagagaagtttagagaaaaaagaataaaaagaaatgaacaaagcctccaagaaatatgggactatgtgaaaagaccaaatctacatctgattggtgtgcctgaaagtgacagagagaatggaaccaagttggaaaacactctgcaggatattatccaggagaatttccccaatctagcaaggcaggccaacattcaaattcaggaaatacagagaacaccataaagatactccttgagaagagcaactccaagacacataattgtcagattcaccaaagttgaaatgaaggaaaaaatgttaagggcagccagagagaaaggttgggttacccacaaaggaaagcctatcagactaagagctgatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggccggccctaaaagagctcctaaaggaagcactaaacatggaaaggaacaaccagtaccagtcactgcaaaaacatgccaaattgtaaagactgtcgaggctaggaagaaactgcatcaactaacgagcaaaataaccagctaacatcatgatgacaggatcaaattcacacataacaatattaactttacatgtaaatggactaaatgctccaattaaaagacactgactggcaaattggataaagagtcaagacccatcagtgtgctgtattcaggaaacccatctcacatgcagagacacatataggctcaaaataaagggttggaggaagatctaccaagcaaatagaaaacaaaaaaaggcaggggttgcaatcccagtctctgataaaacagacttgaaaccaacaaagatcaaaagagacaaagaaggccattacataatggtaaagggatcaattcaacaagaagagctaactatcctaaatatatatgcacccaatacaggagcactcagattcataaagcaagtccttagagacctacaaagagacttagactcccacacaataataatgggagactttaacaccctactgtcaacattagacagatcaacgagacagaaagttaacaaggatatccaggaagtgaactcagctctgcaccaagcggacctaatagacatctacagaactctccaccccaaatcaacagaatacacatttttttcagcaccacaccacacgtattccaaaattgaccacatacttggaagtaaagctctcctcagcaaatgtaaaagaacagaaattataacaaactgtctctcagaccacaggtcaatcaaactagaactcaggattaagaatctcactcaaaatcgcttaactacatggaaactgaacaacctgctcctgaatgactactgggtacataacgaaatgaaggcagaaataaagatgttccttgaaaccaatgagaacaaagacacaacataccagaatctctgggacacatttaagacagtatgtagaaggaaatttatagcactaaatgcccacaagagaaagcaggaaagatctaaaattgacaccctaacatcacaattaaaagaactagagaagcaagagcaaacacattcaaaagctagcagaaggcaagaaatagctaagatcagagcagaactgaatgaaatagagaaacaaaaaacccttgaaaaaatcaatgaatccaggaggtggttttttgaaaagatcaacaaaattgatagaccgctagcaagactaataaagaagaaaagagagaagaatcaaatacacccaatacaaatgataaaggggatatcaccaccaatcccacagaaatacaaactaccatcagagaatactatacacacctctatgcaaataaactagaaaatctagaagaaatggtaaaattccttgacaaatacaccctcccaagactaaaccagaaagaagttgaatctctgaatagaccaataagaggctctgaaattgaggtaataattaatagcttaccaaccaaaaaaagtccaggaccagatggattcacagccaaattctaccagaggtacaaggaggagctggtaccattccttctgaaactattccaatcaatagaaaaagaggaaatcctccctaactcattttatgaggccagcatcatcctgataccaaagcctggcagagacacaacaaaaaaagggaattttagacctatatccctgatgaacatcgatgcaaaaatcctcagtaaaatactggcaaaccgaataagcacttcaaaaagcttatccaccatgatcaagtgggcttcatccctgggatgcaaggctggttcagcatacgcaaatcaataaacgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagaactatctatgacaaacccacagccaatatcatactgaatgggcaaaaactggaagcattcccttgaaaactggcacaagacagggatgccctctctcaccactcctattcaacatagtgttggaagttctggccagggcattcaggcaggagaaggaaataaagggtattcaagtaggaaaagaggaagtcaaattgtccctgtttgcagatgacatgattgtatatctagaaaaccccatcgtctcagcccaaaatctccttaagctgataagcaatttcagcaaagtctcaggatacaaaatcaatgtgcaaaaatcacaagcattcttatataccaataacagacaaacagagagccaaatcatgactgaactcccatttacaactgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatattgtgaaaatggccatactgcccaaggtaatttatagattcaatgccatccccatcaagctaccaatgactttcttcatagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataatgctccatatctacaactatctgatctttgacaaacctgagaaaaacaagcaatggggaaaggattccctatttaatatatggtgctgggaaaactggctagccatatgtagaaagctgaaactggatcccttccttacaccttatacaaaaattaattcaagatggattaaagacttaaatgttagatctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagagactaccatcagcgtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatacgaacagacacttctcaaaagaagacatttatgcagccaaaagacacatgacaaaatgctcatcatcactggctgttagagaaatgcaaatcaaaaccacaatgagataccatctcacaccagttagaatggctatcattaaaaagtcaggaaacaacaggtgttggagaggatgtggagaaataggaacacttttacactgttggtgggactgtaaactagttcaaccattgtggaagtcagtgtggcgattccttggggatctagaactagaaataccatttgacccagccatcctattactgggtatatacccaaaggattataaaacatgctgctataaagacacatgcacacgtatgtttactgtggcactattcacaatagcaaagacttggaaccaacctaaatgtccagcaatgatagactggattaagaaaatgtggcacatatacaccacggaacactatgcagccataaaaaaggatgagttcatgtcctttgtagggacatggaagaagctggaaaccatcattctgagcaaactatcgcaaggagaaaaaaccaaacgccgcaagttctcactcataggtgggaattgaacaatgagaacacatggacacaggaaggggaacatcacacactggagcctgttgtggggtgcggggacgggggaggaatagcattaggagatatacctaatgttaaatgactagttaatgggtgcagcacaccaacatggcacatgtatacatatgtaacaaacctgcacgttgtgcacatgtaccctaaaacttacagtataataataaaaaaaaagaaatgcaaatcaaaaccacgatgagatatcatctcacaccaggcagaatgactattattagaaagccaaaaaataacagatgctggtgaggttgtggagaaaaagggatgctcatacactgttgatgggagtataaattagttcaggcattgtggaagacagtgtggcaactcctcaaagacctaatgacagaaataccatttgacctggcaatcccattactgggtatatacccaaaggaatagaaatcattatgttataaagacacatgcacacatatattcattgcagctctattcacaatagcaaagatgtgaaatcaatctaaatgcccatcaatgatagactagataaagaaaatgtgataaatatacaccatagaatactatgcagccatgaaaaagaacaagatcatgtcctttgcagagatggatggagctggatgccattattcttagcaaactaacatggaaatagaaaaacaaataccacatgttctcacttgtatgtggtagctaaattatgagaacatacacacacatagaggggaacaacacacaacacaacaacaacacacacctttcagagggtggagggtgagaggagggggaggatcaggaaaaactactaatgggtattaggattaatacttgggtgatgaaataatctgtaaaacaaacttttgtgacacaagtttacctatataagaaatctgcacgttacccctgaacttaaaagtgaaaaaataacgaactgcattccattagaactagccgtgaaataaaaagatatttccaagaaagcttcaggaatagacttcccaagaaattttataaaaccagaattgattttcacatgtctgggatatttagatgtagccttgcctcaaagaaacccttcgaggttttttccagccgtatgattccatgacaggatgctggggctacagtaatccttggttgatccaagaacatagagagcctagcatctgcctgccatgtagaagcactgcacaaaggtctcatgtatatgattcattacatgtgcgtaaatggaatacaattgtctatttttaggccaacttgtggtatctccataattttcagattttccattattaaaaaaaaaaaaagagagagattcgaccgggcgcggtggctcacgcctgtaatcccagcactttgggaggccgaggcgggcggatcatgaggtcaggagatcgagaccatcctggctaacacagtgaaacctcatctctactaaaaatacaaaacattagccaggcatggtggcgggcgcctgtagtcccagctacttgggaggccgaggcaggagaatagcatgaacccgggaggcagagtttgcagtgagccgagatcgcaccattgcactccagcctgggtgacagagtgagactctgtctcaaaaaaaaaaaaaaaaaaaaaaaaaaagattcatccttaagtcatttaaataaaatgatggaagaatgatttctatgtaagtgatttaaaagcacaggcacttgatccaaatccttctgggatacaaagcatcccaaagtacataacacaatttcttgccttattaagctacagcttcattacacaatttaacctcttttagatgactcacagtcatcatctataaaatttaattcaacacacatttgaggaacatccactatttcagcacaataccaggtttgccagtctatgcccatgtctaacaataacgcaagagattgtggttatgtcaaagtgaggttgaaagtcagtgctgggagtactggggcaggatggaactgggatcccagggaaggcaggtaagcatgaggacaaagagctcagcccgctgtgggttgcagatcccatcttcctttgctaacctgcgtgaccctggccagattgcagagtcttcatttcagtatcactgagtgaagataacaatcataacacctcctgcgtaaggtagtcaccagaattaactgatgcaaaacagtatttttaaaaatgtgagtcataggaggaatttaatggaacatgacaatcactttaaaaacaaaatgaaatagaatagaaaaaaagtcaaatggaacagaaaatatcggagggcatcacgtgtagtaaatgtaagtttgtggtgtgcgagtactttcgtggcgtgattataacttatattttctatcgtgggtcaccatagggcaagttcaaaaaccataggtataaagcttttggcactcggtgcctaatgtgtagccagtgataaaaagtggtgaaataaaaatacagcatttaagttgagctttaaacaataaacatttttaccaaagaggatggaatggaaaaggtaagaaaaacccaatacgtgtacacacacacacacacacacacatacacacacgtgcacaaatgcagacacatatgagacatggtattacttagatattggatggaagaaggtttttagaatatgaaactagacaggagatgcagctggattgtggaaatctatctaggtcatattgagaattttgaatgtctttaggtaaaaactgcgaagtcatccaataaatttgcactaggaaataacatgctcagattcagaattggaaaaaggaattgtgacagggatgtggacaacagactgggagttgagcctggcagtgggaaggcttctgacttggttttgattctccaggggaggacctgaagcaaggcaatggcattgggtgtgaaaggaaggagattaagaagacattgcattgggaggccgaggcaggccgatcacttgaggtcagaagtttgagagcagcctggccaacatggtgaaaaccccatctccactaaaaccacagaaattagcctggtggggtggcgggtgcctgtaatcccagctactcaggaggctgaggcaggagaatcgtttgaacctgggaggtggaggttgcagtgagccgagattgcgccactgcactatagcctggcgacagagtgaaactccgtctcaaaacaaacaaacaacaaaaaagacattgcagagagctcttgtgacatgatgtcactttgctcatttatttcctctgatcatattaccctttcctgcctctgattcatcaggtaaaattcttctcttcctgcaagccagggctagctatgtgttccaagcaaccatctctggccgtatgtttgagtgacacccagtccgcgctcctgcactgtgctgtgcacatcattgctgtgtcctctgtcacatcacacagaagggtgacattgtctagtgtttcctgccttccctggaacttctgggtatgggtttggagcgtacgtcatggtccctttgtggttaagacatggaccagaatcttatgacagattctggctcgtgatttgtgcttggagcgtttacctgcctatgtcagcgcctcagagatttctttctctttgtcatgaaacctgcctgggtccttcctggagtgaagatagcatggcatgtactaccacatactcacaatgagcatgatcgtgaaagaaaaataaaaccattggttgttgtatggttgttgtaaatcactgaggtttcaggcctgtttgtgatgccccctaactcagcatctcttgattgatgtgattcagaacctggctcagagcttggtgtaagagtagtgctctatgtttatttgtggtaaaaatgaataaatgattaggagaggaactataggtagcttgaaggcttctggtcagaaggcagcagattttgttagatcgtaagctaaatcagaacacaggaaaagagggagacacaagtataaatgtgtttgtgggcacattgaatgcgaagtactggagaggtcttcctgagtacgcagatggtggtaagctggaaatataggactgacggttctctaagattgtcaggatagagataaaaaatgcgaactctttaatttcagatgatagttacattataagaacagattcaatgatccacagagatagtgaagaatattaagagataaaggaagaatattgggaaatgcctacatttaagggtgggaagcagagggacaagaagcaacaaagaataaaaaacatgataatggaagctaagagaaggaggattttaaaagcaaattgctatctagtagcgtcactatatgctacagtgacatgaaatagggagggtactgggagggaggaacgacgttttaatacagccaggaggtccgtgttccgtgtgagagaggaagaatgaacacagcgatgagtatcattgtagatacagatgagcacgttagatgctgctttccagattccacgttataccacttttccactccttgagattcctgcacatttctggttctcggaagtcccctttcgctctcagcctgactatggctttatttgatgcagtctgtggctgattgggaggcaaacacacacctgttgcctggggtgggaagctgtctggacctggtgagttactttgcctcccagaagacttgtttaattctaagttatgggctacaatgtggagaacttaattgcccaggtcttctgggtaagaagagtagtggtgtattctcactgattaactcagcaacatttattgagcacctactatgtacaggaactgaataacattatcatctgaagctggaataaccaatgtgaatcacagctcagagatattttatgccttctgatttttagttttcattaatgagaagtctgtgcttcctaattttacatttctaagctccgcaaatgagattagcattgtgaaacagacaatgtctatatcataatgcttatttaatgtgtatatagtaaaagcagtctgtttgtgaaagtttttcagactgcttttatgtagacgggagcgttggggaggaaatgaagcttggctgttttcttcctgggaccttaaaagggttatctcacgtctttggattttcattgcttataatagattgtttgatcattcaaaccactatatattaaaattaatagccagaatccacaaattatgtggatgaggctctgaatcaaatgacttttgagattttgcagtttgaatctctgattggggagtttaatatctcattgcactgttggacccccgagggaaagttcatgttcagtccacatcatctttagacaacctgtttgtagattcattctcagttaccctaacttgtcatctggccacatgcaagtttcaaattctaatgtctttttctaagctaaactgagagagcaccatgaaataaatgcctatcagcagacattatatgtcacatattagagaaaaaagcttgtctattttaacagggttctttcccaagaaggggagatgaatttgggatcttgagagaaaatgacatcagcgaggaggttagctgagggactcttataaaagggaccaaattacaaggcatattgtgtcctgatttatccccctatgttctacatttaactatgaaatcatttcaaagaaaaaaaaattcagatttatgagcaaggaaaatatctagagctcatactgtcctctggtggtcattcgcacacatagccagaaatgcaaatgccttggaaaacttgacagcatctagtttaccgactgaaagtcaaattgcagaaactgatgaaaacaaaacaaaacaaaaaaacaccctctttcctgtactttaaagtttcttgatcatttcatatttaaaacagaataatggatactatttacaagtattcacctctgaagagaaataattgtctctgagcttgactctcactgatactatttgatgtaaaaaataggtctcgtgctcttaaatgatggttgagatagatagacaggaaggtggatatggagagggaactgtttttagttcacttcacttcaattaagatgctctggggttctgggacctccttgtaacactttctaggtattatctcctggaagaacacaggcacctgcccatcatatttctatgtctctagtctttttaatatggtcaaaaggcaacacagagataccctgataaaaatctcagctgttatttcccacctttttctggtgggtttgctctcattactgtcttttttttttttttttttttttttttgagacagagtcttgctctgttgcccaggctggagtgcagtggtgacattttggctcacggcaacctccacctcccaggttcaagagtttctcctgcctcagctcctcccaagtacctgagattacaggcatgtaccaccacacctggctaatttttgtattttttgtagaggcggagtttcatacgttggccaggctggtctcaaactcctggcctcaagtgatcctcctgccttggcttcccaaagtgctgggattacaggcgtgagccaccgtgccttgctggccctcattactgtcccttttgagagtgtgttgttaagatcctgggcaggtcaaatcccattgttctgtgggtgaagagacaggagaaatcctggggaaatgcgtttctaccccatctaacaacacctgtgtgactttgttttcaggataggatgttttttcttccttttctattgtatgtaattcttaggccaggaggacagagccaaatacagcctgtatcatccacaaataggggctttctcagtaagcatcagtcactaaggactcatttcaagtaagccaggtagggatttttagtgcagagataaagataagatgattgagaagacaaaacgagaggaagctgctggtctttctataccctgctaggtgctttctagcctgttagagtcaaaagagcaaccgtgaatcccatagcaaagagatcaatgaatgaatgagtgaatactaatacagatgcaattcaagttctagtggaaaatgagtatactttatttcagcaataatttttgtctctctttggtgaatacgggacatgtcagtgataagcagaaaagcagaagccaccctgggcattgagggcacaatggctcagctttttttcagtgtctacgctgctctccatctctgggctttgatagtaggattcagtaagtgaggattaacagcatattgaaaaccacataagaagcccagaaaaatgttgtggagtctaactctgactatttacgtttacatattgacttcaagggcagagtactgccatgaatgcataagcagtagagaacacaccttgctttttcagcaacagacggaacttcatgggccaagcaagcccacacactctcacacactcactgttggggtacaccaggcctcaggggcacctgtggactctgagcttgggcaaacatatcaccttgattaaaagattaatccataaatttgtttgggaatatttttcagccctaacaaggaaggagattccatcgcatgctacaacatggatgaaccttgaggatatcatgtcaagtgaaacgagctggtcactaaatgacaaatgctatatcattccacatgcatgaggtccctagaggagtcaaatccagagacagaaagtagaatggtgggtgccatgggctggtgggagggaggatagggaattcgtgtttaatggggacagagtttcggttttgtagagttctggagatggatggtggtgatggcttcacaacaacgtgaaggtatgtaatactgatgaactcaataatcaaagtggtcaagagggtaagttttacgttatgtgtattttaccagaaaggaaacaaaaccagtgtgtatattcactcaacaaacgcttagtgaatgactacatgtgtcaagttctatgctgggagctggagatacaaagatggaagagacatggcacctgctgcagaaaatgtcataatgtttccatgaagacatcgtcaattttggtgggtcattttaatgttttcttttctttaaaatttccctttttgatatgttttggtgtggtctcagaagcagtctaactttataatgattattcagcaggaataatatgaacgataacaaaaaccacactttgaaatagtaaataacttttagttccttcacaatgaaccaggctgactgctgtaactgtaagggtaatagatcttcattaaagtccctcatttctagcacaatagggttttgcctgctattcttttccctgtgagagatggaggagggaaagaagggagggatagggtgggagggaaggaaggagggagggaaggagggagggagggagaagggagggagggaaggcgtgaagtgcttatcatgatgagtccaacagtaaaatcaataggtgttgtccactgactatcaattaaggcacaatcaaggcctctgggttttgattttgatcaggctgctggcagtttagtgggaactcaccaaataaacaataattccagacaattgtcccccttgtcatgattcaggagcgtattttcaaatgaggtgtaaatgaggactttgttttgtatgtggagacagcaggggcaaaacaaaaccactggaaagacccaggtaggtgggaaacaaaggaacgaaactgtccagtgcgagcacctgcagctcgtccctggcagacgcttgaaaggcacttggttatttaccaacttactgtgggataggggtgggagcagaatacagtgtactttcggatgatgccgttcagcttgagagggggaagccaggacacaaagaccatggaggctgaggccgccgctgccttcacacccgcgggaggacctggaactggaagagccgtgtgtttagtcacaaggtggggcctcaacttgggcttgcggacccacgcttcccaacatgaccccactccgcacttactgttcagctctttcaggatgagcgttatgggttccgctgtgtccccccaaatgcatatgttgaagtcctaacccccaggaccacagaatgacactgtaattggaggtagggtctttacagaggtaatcaagttaaaatgagtttgttagggtggtccctaatccagtacttctggtgtccttataaaaagggccagtttggacacagagacagacatgtatagagggaagatgatgtgaagacacagggagaagagggcatctataagccaaggagagaagcccaggacagatgcttgtctcaaagctcttaaagagaaccagccctgcagacaccttgattttggacttctggcctccagaactcagagacagcaaataaattcctaatgttggagtctgtggtcctttgtagctctaggacctaatacagtcagttctagtccctcttgtcctggggagtcttcccaacccatttcagcccctggcaacttcctgcctctggataactggagaattaacttctggatcagtctcatttctgctgcagtttttggctttgaatgtactggggatgaaccttttggatcctgaatttgagaagcatgagggtgaactacctcagccatcagagaccccaccctccctcaccctagtcattttgtaatggcaccactttgggctcaggagaggtatggaaatattgttgatgaatagggattattgggtcaaagattcacagtatccatgtaagacaaactctcctctgtaaaccagctaagaaggcagaacatggtggcagcaatactaagcatgatttgggagtgagattgaaggcatgtcccactcctcttgttcttttattttccaggttgaagaggtgagggcgggtgagatggccaagacaagaagatgccaaaatgtcaaaggtgccagtgaggaaggcatcagagctcttgctttgtttctcattaacctcactgtccatatggagggcaaccacattgatggagacattgaaattcaaaccaatagaagtcccttgcaagcccctggagaaatctgtgagtcttttactgctttgatggcaatgcaactgctcagtaaattgttttggagttgaatgtgcttctcataatcgtcaccttgactcttctaagtctgcataacaaaaccaagagctctggtgagaactaacttgggttggacatagtcaccatttgaaaatataaaatcttggtaatccatttttggcaagtcttgctaacagtggaaggtctagaaaaggtaacacacataaatgatagatcctgggttaaaaaatcccttgagaacaaacctctatcaggtgagggtaatgtctaagacatccacaacctagttcagagctgccagggttcctcctgaacaacaagggcagagtgaacgtttcctggggattttaatcctagtagacaccccagcttagccaacactctcagtcctttccataaagcccctggttggtgttcaccacagtgaacattcttgctggacagcttctctttaggaggccaagtagtttagcaccaaccagttgaatggctgctgaagaggagtcagttgtatttgtttccaacctgtttgtgacaattgtacgtgtcatgggtagtactgtaagttaattaattacgtaaaccaatgaaattcaagtgcaagagaaagctgtttctatgacagttaatgggactactttggaaagccttccttagaggtaagttagaaaagaaattaaaaagagaaagaaatgaaggagggaagaacaaaaggaatgaaggagggaaggaaggaagaaaggaaagagggaagaaaaaagaaaggaaggaaggaaggagggaaggaagaagggaagacaaaaggaaagaaggataaaaaagaaaagaaagaagaaaagaaggaaagaagaaaggaaagaaagaagaaggccgatctatgtttggtcaggaccactgagaagaatgggacatgtggatttgtcccaatttgcaaacagatcgttggtaaatggtcacatgctcttacttgagacaccagttgaaaaatgcagatgctacacattaaatgcagttcatggagtaaaagatggcacagagctccaatcttttcacccaaaacttcaagaagtgatcctaagtcatgtgattagagaatgattagggaataaatacatatttatatgttttaagttaaaatgcaacatttcaggtacttcctggccactgcaaagtttggtgattccttgttttaagtgatgatttccgtgagcatgcctgtgtcacagccgatcaagggacttttactgcaccatctaaactcgcagttggctcctcctgcatggatttatgatctatcttacacagtctttccttgtatggttactagaactttgtacaataaaataacaacatagataagttgaagaacacggcattttggaaggttttctggatgactgagctaatcttttcagagctagaacttaacattttagttctggtttggacaacatcataaagcttaaaggtgtgggccctggagcctcactgctggtttcatgcggctctagcacttagttccacgtcctggacaagctgattaacttctctaataatctttagttccctcatttataaatctacaataataactgtgctggcttatgtttttactgttagaattataagagataattcatgtaaatcatttatttattgttctctgtacagtaagcaccaaataagttctagctatcatctctaataaccatccttatgtccttggattatatgtcactaaatgatactagcctttactttgtgactcagtggtgaatgacaaacaccagacactgagagttgcagaagacagagatggcataggatggagtaaaaaacggtatatgtctgtctgggacatattttcttgaaacattcttagtgaccacattccattttggtaatctgagtttttcttatgaaggtcaaaacaaacttgggaagttttcatgaattcctgggcatcatagagaggagttctgcatttaagtttaattgattgcagtaaagaatgtggccttcagagaatcctctcttctacattcctccaatgcacctggacatcccttctgagctgcagatgcttctgtgtctcatgtgtccaattggctgagatgtttcacacgggcaccttagaccgacatagtcacaacagcactcaccatcttctatccaaacctgtgcttctcttgccccatctcaggaaatggccccatcatcttctcagttgcaagaaccaggacctggaattctcttcctgctgtcacttgatgggccctttggaggtccacatggacaggacaggtcagcagttgggctctccccctgatctgatggtgctccccaacactgagctctgtttcagttccctgaacgtggtttgcttctcccaccccgggcccttgggatgccatgatccagggccttgggatgcctctgtctggagtttttcccaccctctgccttcttcctggcaactcttactcatctctcaggttctagcacacgtcatttcctccaggaagtcttccctgatcaccagcttaggtcaggtcagggctcccatgtctctgttgagactcttcttcatcattgcacttgacacagtccactcaggggtgatctatcaacgtctgtctcccccactagcttgcaaaccccaccatgcccatcctgtttctctgcatctttagttcctgggccagtatctggaacatactagatcctcaatacagattttccaagagtggaaaaatgatttcattcgtgtctgtgtggtaggcaggattctacaatgggtccccaagatccttaccttctagtgtatgtgcctgggtgattccttccccttgaatgggtgtggcatctgttactatgatggacagattcctcccatgggcaggttgtgccatgtggcaaaggtgaagggcttgttcaggtatcattgaggttctaatcacttgactttcagttaatgaaaaggaaagtttcctgggtgggctgggtttaatcagatgcgccccttagaagaggagatggaggtcagagacaaaagaggtcagagggattggaagccatgtgagactttcctattggtcctgaagaaggaagctaccatgctgtagggggtgtgacagggagtaacaggcagcctctggaagctggtgactccagcctcataaccaaacaaaaaaaaaaaaaaaaaaagatcccatatcctgtgagcctgggagaccttgacctcagatgagggcacaggcccagctcacaccgtgattcatctgtcggaccctcagcaggggactcagctcaaccagacctggatgcctgacccttagaaacgatgagataagacatttgtattgttttaacgtgttaaggttgtagcaatctgttccacagcatagaaaataaatacaagtgggtaagccctcctgtaacataccttaatgtaaaaataccacaatcatttttctgaaacagtattgccttgttttgaagtatgaatatcggacaaaagtctgactaaacacccacacagacaccgcagtcagcttcattttttttcaccatcatttttctggtcttagtaaacagccacaggcaggtgtgtgtgtgacttgtgcatgcacaaacatgcatgtacatatgtggtacaccatggtagccagatccttctgaacccacaacttttcagtggcttttcctgagccatgccgtgccgtgcagatgctacgatcctggagggacatgtcacattcacagctgtcatcccaccaagcatgcacatatgtcccttttctcttcccatgtccataagactctagtatttttggcctttcctctcactagagcaagagtgttcattctttaaatgtttgactgatcctttaaccaaatcatcatgtggaaacccagcacataacacaagtggaagtggggtggctcttgaagctggggtcagggagagaatggagtctcccactgggcctcttgcttaccactgggcactgctgaggcccacctagtttgaggtaagaacctagtttgggatccactgcagtggagggagtgtggaaagccacatggtagaatctcttctaggacatcttgtctgtcgtgttgctggtatacctgccactgcacatggcacactaccataggctatagagcactggaatcttgagcagtgtggattggcagtacttcccagtgtctactgaggggcagcaccactggtggctatgcaaacatagcatgcaatctaccccctttcaggtctactgaggtgtggtcacatagtcaccccagcacacgtcacaggcacacactatccacaccttcacaagtatgtatggctcaaagtatgggtggtcagaagattcagaggtatccagatgtcagcttatttttttgcttcctcttagctctactttcagatctcctcccaatgagattgctaattgatggtggggagggagtagagatcacatattacacctgctgctggccctctcacatgtaccttcagagttaggtgcattagtgatgtgttcagtaaatatttgaacttaactatctctattgatacatatgcaaagtttactcttgtgtaaagggatcaaggctgaaactagcttttgccttcagagtgaaaacagcaattggaagattaatagattgcattttgtttgtgttctctttccttacggcttgactcgtattatagtattggcaaataaaatggcatcaggatttcacaactgtttttagaagtcaggtttagttgctgttgtgctcaaaaacagaaaagccagatcaccaagtcgtccttcgtgtttctgcagcaataatggggtacaagttctcactgatagagcagtcctggaaagagaacgtgaactgtgagcagtagtcacagaccccaaaaaatatgtccatgcacctgagtctatatttatggataaaagatgatatccatggccctgagactctgactacaggcatgagaatatgtccatgtacctgagactctatttacggatgagagatgatatccatggccctgaggctccgaccacagacatgagaatatgtccatgcaccggagactatagttatggataagagactatgtccatggccctgagattatgaccacagacatgagaatgtgtccatggaactgtgaatatgactatgagcccaagaatctttagatagtggtagagaaactacctgtagagaacaagcacagacttgtcctctaaacaaatatttctattgcaaataatcccttgcaaaagtacaattttgcctttattagggttaagtttctctttttagtatgaccagtgacctaataacacagtttaagcctccaggctccctagattaggaagactggtacaggacgtgtgtctggcatagacaactgaatcggatgctcgctgttaatgtagctatctttcttcgcttgcaagaacgttgataaacgctgaaacttcaacctgagcctaaaatagtatcttattgagaaagaactgagcaaatgttggtaattattattttactggaaatctatctgtatttttacacaatttaattgaaattgtaagtgtaatccaaacttcaaaattacaaagctttctcattgaagtataaatacgatctgtaatcaatttgactgggcatttgttctctgaattgtcctttgtcccttcttccaatcagataaataaaatagcatttaattctgtaaactgctgaaatgcctaattatattaggtattgagtctacaaaagtggttgacacaattcttcaccgtttctaaattattgaatttttcatgtgaacctgggagatgaagtgatattattctagttcttctcttcttccacccaatcttcactccacctcttttttctttttgagacagagtctcgatccgtcacccaggctggagtgcagttgcacgatctcagctcactgcagcctctgccacctgggttcaagtgattctcctgcctcagcctcccgagtagctgggattagaggtgcccaccaccacacctggctaattttgcatttttagtagagacagggtttcaccatgttggccaggctggtctcgaactcctggcctcaagcgatccaccactccacttctttttgaaaatgcagacttatcctaaagaaatattgacactcagttctgcatagtccttgtcccataccaccagcaaaagtgggattcatggcatcttccttggggtaactggggtacccaaggcagggttttcgatagtcaatcccagctccatacactatcagcactggagacaaaagcaaagcataattgattgacaaattagaccttgggccttggggtcaagttttgagacagaactccatgattcttaaaactccaatattaattaaaaattgatctaaaattgtgagttaataaggatctgtgaagagccttcccttcttattggatttctgtacattcttccaaaaatgcagatgcaaaacattttgtggatgatcaatttgctctttaaataataattccagtgacatttgcattattgcctagcaatgtaaaaaggagtatttcacccctactctgaaggagtggagagcaaataatcaaatattgagggtcaggaagcatcccactctgtggcaagcaggtgttttcagacaccacttcagctctcatacactggttctgtgcagtctgatggctacagcagattgtccctgaggacaatccagttcagagacacttaggtaaggtgcccaaagacccacgggcagcaggtgacagagccagcatttgcacagctgtttgtctgttacatttttaaaaaattaacttatggctgccttcactcaggacttagctttctagatatctctattgatgtgtgacttcctaatggcattacatttgaaccttagattccctaaataatccaatttcttagagcagaactggctgacacctgcacattccctggaaggactacctgtgcattttagaaaaaaactaaagcaaatgaggattagtttgggtgtagacattacaatgtgagaagggctacagaggcagcaaaaacaccaggtgagagtggatgcctggggctgctcggaggagcaaggcctggcttgccaaggtgagagcagagagtgacgtggaagatggcaggctcagaataacagggagtcattgtcaggggcagaaaggctgaagagaagagcgtatcatggcccctgagcaggtgttctttgcttccatcagagcagatatgggatggaataacagcatttttgatactctagtagtgggggagatagcatagacatcaaacctgcccatacacaggaggtgaccagcaatggccaacagctttcccgcccctgtactgcttggggaacagagtcccggcaagaagacaaaagttgcagagacaatccagcacagcatttagatctgctaatgtctcatctcaatgtatacttctgtgctggaatattttgggaaggttctatgtgggcatcaatttgacatcagttgctccttcctttattaaggtggaggctacttttctcactaccacggtagtatttatcagaacttatctgttccttaaacaggcttggccaaggcccctcagagtttcccttaaaataatacagaacctttgttgtatggtttttgtacgtttgggtaatagtcacaacccaatccaaattgtaaggaacagcaagaattattgttgtagaacaaaatgagcagcaatttaaatttttactaaatcaccatgaattcttgcaagaattaaaaaaaattaacatgaagttctcaaattaaggacttattctaaagtgattcagctggcaaagaataatagaacttcagtctgtacataattttcaagaagtggaaggatggatttaatcagagtttacactaatagctgaatagctactaaaattattctaacaagatacaaaacatgtatgacaagtattacagctctaggataaaatgagtttctatttacaataatacttggccaaaaaaaacaaaaaacaaaaaaaaagaaaagaaagaagaaaaaatatagaggaagaagaagcaatggattagacacatcaagcaaaggcaagagaggaagttaatggtctgaattgcactgggatattttgggagggcagcaaaggtttgcactgagaatagcctgatgaactgcagggtaaaggcaagtgagctctctgtgacccagcccttccagcaactgctgggacccaccgcccacccgtctctcaccatcctctttggtccgggtgaagatctgctcactcctgaccccgtctcctgcgcgggtgaaggccagcacctggatgctgtagttggtgtacttttccagcccgtccagctccagtgaaggctgtgtggtggtgatgtttttaatctcacccagctctggaggacaagaacaagaaaacaaaatcccacttctgagcccatttctgctcgtttttccgcactgtccccactgactgtccctgtgccatgccatcacccgtccagccatcatctggacacgagaattctcaaagggactgtgcacagtcatcctgtgagctcatggtgtcacgtggccctttggaaaagaacattcacaccaaactgctccagaacacaaggcagaacgttggtctggaaaacgaagtaattcgctccaagttaagtgttatcaacccaaggccagcaccagggctgccactcacccttcagcaggtgctaatgagcaatgtcccctgcacccctagcagcacacttagggcgacacacacacgctgcacacttggcagccccactgccgactattcattaggaagcttctgcaagctgaggggttttattgttattttaaacaagctctactttaacatacatgtatttttaagtacctaacttcatcccaaatatctgatctaccctcttcagcaagtttcaagtctataagacagtgtctttaactatagtcaccactttgtacattagatctccagaacttattcatcttgcataactgaaactttgtatcatttgggggtggaggaagaaaatggcaactatgtgagatggtggacccgctgttaatttgcttgattgtggcgagcatttcacattggatacatacatcaaaacaagctgcatgtctgaaatatatgcaatttttatttgtcaactataccttaataaagctgaaaagataacatatttaaataagaaaaaaatacacctgagctaaactgagtggctcagccaacccctctttttacctggagtgaactcctctcagcttcaatcctgaagtgacatgcccatgtgtcagaaacttggtgtcagctaaaaatgcttcactttcaggagtgggatcaactaataacattcacagatggaacactatgcgctctcaactccagcatatgatacacggcaatttgagaaaacttacgaatgttgtgctaagtacttccttggtgtttggctgatgggttttgaaatgagtcgccttcagagcatgagaagggcctgagaactgttcccctaggggaaggggctgtcagcgacacattggtacccagagcaggccggttaccccaagagaccagcaggtctggggagttccttgttgaacagctctgatttggcagacctgctcgtcaactgacaatccagctgcttgtcaatccctctcactctccctggcctccatatagggagtggatgtgatatgcatgcctgcctaggtgccagcgctatgctattctaagtacagatagtaacttatacaaccagcagagttattcaattacttttgcaacccattcattttacagacaaggaagtcgagggacagagaggatcaaggagcccagcacagtggctgagggcacaggccgcggatctcagctgctctcctcagtcgctctgggaaaaagcagaaaatgggctgaaaatggaggcacccacgagccgtcgtgtcggccagattaaacgggcttttgctttttgcctgtcttggttttccttcctgctcattgtttttcttttctcttgtgtgtccaggatattgcacagaagttcacaaatgaatagccacgtattttgtgtgtccaggatattgcatggaggttcacaaatgaatagccatgtattttgtgattacgatgactgtggaacatcttttgttcatcttttttttgtcaccaaaaagatcaatgtggaacggatacagcattaaaggagcatggcaaatactgcatgggatggctgaggcctgtccctcacatgccagagagcccctgtgccttctaggagttgcaagaagaggggtaaaggggctccatgtggctcccacagtccaggccccagtgggagccaaaggcctgggagcaccagaagcagacagttctgtaggctggggctttgctggggagggagcagggcgaggatggcccaaagacaggcctttggactcctgtcttctagggaggccagcagggtgccagctgttaaaggtcacaatttggaaatctcaacggagggcttacgaaaatgaggagactgtgtgagcatgtgtggtcaccaggtagtcaaaatatcaatacttggttgtcccagatggattggaaattctcatctctgaaggacgggtctttccatattcaattatattccttttcctgaatatatttaacataagtcttttggattaggataaaaacccaaatgtaaccagacatgatggctcatgcctgtggtcccagcctcccaagtagctcaaggtgagaggatcggtggagcccaggaactggaggctgcagtgagctgtgattgtgccactgcactccagcctgaaggatagagccagaccctgtctttaaacaaactaattaaaaactcatatgctaatggacaaactttaaatatagaactcattaagatcttttcagatttagaaacttcactgtcaaagatcacacacgtacctccctacagatatatacacacgcaatcaataaaaatacagctgaggggaggggctgatcagggcagggtgctggtagctggttatgagactctgatgaaggtctttttttcccaagagtgcagggtgtccacctcacagaaaaagtaggatcatttcacaatataggagaaagctgtgaccctccggcaaatacttgaatcagaatgcaactcttgaatcagacagaatgaggaagaggagcctggtggggagggagaaggacaacctggcctctctgatcttcttaaagaaagcaaacacttggcccggtgcagtggctcatgcctgtaatcccagcacttcgggaggccaaggcgggtggatcacgaggtcaagacatcgagaccatcctggctaacacggtgaaaccccatctctactaaaaatacaaaaaattagcctggcgtggtggtgggcacctgtagtcccaggtactcggggaggctgaggcaagagaacggcgtgaacctgggaggtggagcttgcagtgagtcgagatcgcaccactgcactccagcctgggcgacagagcgagactctgtctcaaggaaaaaaaaaaaaaaaaaaaagcaaacacttaaaacaaaatgattaaaaatgctaatggttaatatactaattagaattaacattggggggggggttcaagttattttgattaactaatttatcatgaaccatgaagacaaaggcagtcaaaatcccaattttaagatttctaaaactacctgagccacagttggctctatctgctagaacgcctcataggctgtgaaggaaggctattttcctgatgacagatactaggtgactagcagatatggaagaaataaaaagcaaagaatgaaaaagaagaaagccagatacaaaactgagtgtttagtttgccattctttttaacgctttttctttttaaacatgagtttctacagtctagctttcatgcctctgtagggctgtttaatacacacacacacacacacacacacacacacacacacacacacacacacacattaactgaagtgtattgttcagttgaggtcatgagtgaaataaaattaaaaaaatatataaaataaatttagaaatcagattttttctattaaaaattttgttttaaacaaaatagttttgtgtatttatatcttgcctcatcctcagagggttttaaggcagaaaacaataggtgcgggaatagcttctgaagcaagcctcagctgcccacacactccagttggcacctaattgttgcttcctttcagaatgtaccattttttccatgaagaaagatggatgagatggaagttagcaaaaattcagaggaaaatggtaacttttcaaaggatacaactttcctagcaatctcaaataaattgtttctttcaggccttaaccatgatttaactttctgaccatgaaaaaaaaatcagaaaattcatcaaaatattgtttatttaaccttccctatcaaatatactaaccagttttatttcatctgaccacattaacaacagaattctttcttagacgtattttggaaagtattcgggctattgctaattacagtggtagtaacaatatttgcccctctcagcctgtgtgaatgtgtggggggtgtgtgtggtgtttgtggtatgcgatgtgcatggtgtgtgtgtacctgtgtgcgtggtgtgtgtgtatggtgtatgtgtgtgctgtgtgtatgaggtatatgttgtgagtagcatggggtgtgttacatgtgttgtgtgatgtgtggtgtggtgagtggtgtatgtggggggtgcgtgtggggtgtgcgtggtgtggtgtgtgtgtatgtgtggtgtagtgtgtggtgtattgggggtgtgtgtggtgtgtgtgtgtgcatatgtatgcggagtgtgtgtggtgtatgtggggtttgtgtatgtgtggtgtgtgacatatacggggtgtgtgtggtgtggtatgtggtgtaggtgaggtgtgtgtggtgagtgtgtggtgtatgtggggtacgtgtgtgtggggggtgtgtgtggtgtgatatgtggtgtatgtgtggtgtggtgtgtggtgtatgtgtggtgtgtgtggtgtgtatgtatgtggtgtgcagtatatgtgggctgtatgtgtggcatagtgtgcagtgtatggggggtatgtgtatgtgtggtatgtgtggtgtgtgtacgtgtggtgtggtgtgtggtgtatgtggggtgtatgtgtggtgtgtgtgcatgtatatgtggggtgtgtgtggtgtgtaagtgtggtgtgtgtggtgtgtatgtgtggtgtggtacatggtgtatatggggtgtgtgtggtgtggtgtgtggtgtatgtgagatgtgcctggggttatggtgtgtggtgtatgtgtggtgtgtgtgtagtgtgtgtgtagtgtgtgttgtgtgtgtgtgtatgtatgtgtggtgtgtgtatgcatgagtatgtgggatgtgtggtgtggtgtgtggtgtgtgtatgtgtggtgtgtacatgtggtgtggtacatggtgtatgtggggtgtgtgtggtgtggtatgtggaccctgaaaacctgagacaggtctcagttaatttagaaagtttattttgcgaaggttgaggacgtacccacaacacagcttcaggaggtcctgacaacacgtgcccagggtggtcggggcacagtttggttttatacattttagggagacgtgagacatcaatcaatataggtaagaagtatattggttcggtctggaaggcaggacaacctgaagcaaaggcaagaagacaggaagcggggaggggacttacaggtcacaggtaggtgagaggggaagggttgcgttcttctgagtttctgatcagcctttccaaaggaggccatcaaatatgcatctatctcagtgagcagaggggtgactttgaatagaatgggaggcaggttggccctgagcagtttccagcttgacttttccttagtgattttgggggccaaaaagatattttcctttcataggtgtatgtggtgtttgtgtacgtgtggtgtggtatgtggtgtatatggagtgtgtgtcatgtggtgggtgatgtacatgcagtttgtgtatgtgtatgaggggtgtgtgtcatgtggcgtgtggtatatgagggatgtgtgtgtggtgtgatatgtggtgtatgtgtggtgtgtgtgtgtggtatgcgtggtgtggtatgtgtggtgtatgtggggtgtgtgtatgtgtgttgtgtgtgcatgtggggtgtgtgaggtgtggtgtgtgtggtgagtgtgggatatgtgtgggtgtggtgtggtatgtgatgtttgtgaggtgtgtgtgtggtatgtgtggtgtgtggtgtatgtggggtgcatgtatgtgtggtgtgtgcgcacgtgtatgtggtgtcggtcagcagtcacttcctgctcagtgtctgtgggaatccagccagtcccggaggctgcagtctggggagtttgtgcaaaagtgtccagtagccccgtgaactgacctgcctcataaacgaaatctctcaggtagcaggaagagtgaccattcgcaggcaggttcatgtttctgaaggtttcttgcttatctttcggaaatgaagtgcagacttctacatcgcacatttatctcatcactttgattttaatcccatgagtgaaagtatctttaaaaagctgcatgcacactcccaagcatttctttgtttaaagaattatgtttttgaatattcaagttttcaaagctttaaaggtatgaagccacatctttcattttagaatgaagataccagcaggcaatgctagcaaatgtgagtgagcttagaaaatatgggtgatgtggatgaagtcaccactggattctgaaatatttccaataagaacagaaaagacatcttagcataacactgcctttcaaagaacattaagggtatttaatttcatccactcaatataaggagtagaaatcagaagaaacatatgtaatgatatcctatggtattttgtccataaaaatagatgacttttgcaaattttcattgctctttactctggggtgttttaaaacttgtgtttaggtgggaggggtgaaggtgttacagaatcatctacttaaatctgcccttctgtggggctgtcccttcttgggtctgtggttctgtattcattagcatctccctcggtcactggtctggaacctccacagggacagacacagcaaccttggtgtttcccatgagctcagtgtcgagtgggtgtttggcaaatgtgtctactgcaggaccaaggagggcgggggggggtccttctagattgcctcccatggctggtagtgctccaggtactacatgtggcaacaaaggcatgaggtctgctctcagtcctgagaaacacatgttagggacacagttagggacatgcagagctaaggctcaaaggcctatgctcgctgagccagtaatgcttgtgctgctcatgtgtcttcttgcctttactgttgcaccaaccgtggaggctgctgccacctgtggagccctatgtttacctgcatggggacaggggtctgcctggtagaacagatccaggtggtcctgagcagggaagggataggtccttgaccgcatttgcccaaaattagaggtgagcactcatcagggatcacacccagtcagaggggttgaaagaagccccaggctgggcgtggtgggtcacgcctgtaatcccagcactttgggaggccaaggtgggcagatcacttgaggccaggagttcaagaccagcctggccaagctggcgaaaccccatctctactaaaaatactgaaaattagccaggtgtggtggtgcacgcctgcaatcctagctacttgggaggctgaggcaggagaattgcttgggcccggggaggtggagagttgcagtgagctgagatcgtgccactgcactccagcctgggtgacagagggagaccctgtctcaaaaaaagaaaagaaaccccaaacaagagggaaggtactgtccagtgacggggggtgcaggagggggctggaaatggagggcaggggaggaggcaggtgtgggccccccaggcttgggacagagacagtgagcaggcttccagaggcctttcctgctgggggctgcagcctcgctctgccccagcacactcacgcagcccggcccagcctggtgggcaccactcgcagcctgagggcgaagacactgaggtgttgctgcaagaaacttgtggccccaatcttatgtccacttgagaaagtcgtttattcaaagccttgccctaaacaaacaggaacattttgccctaccacttgaaatacacacacacacacacacacacacgataaagaacaaggaaaagagagaggaggagaaggggaaggaagaggagaaagagaaacaggagacaaaacgggagggccctgaacttcctggccccctcctgagtgcccccctccatgtgcctgggcactcttcccacacccacttacagcacaactacaggaaatttaacgtttccccgcggagttctatttgggaagtaggaagaggccaacattttagaatacatatcacacagaatgttctagatagagatggaggttttggtgctgcctgcagagccttgacatagacataattaggaaaatacatccatgttgaaatttcccaagtgccgcccccgcctaggcttcaacttgggtttcgaaggtgtgtgatgttttaaacaaagagacctgttcaaatgtcagatgagggatgacagaaaaggggaaagtgtctattgataaagaggtgcccgccatatcctgagccccttgttaggaactaggaggggtctgcaaattccatcatgcattctctggaggcaaacccaaagtcctagtttagtcctcttacctccgtccatgaggttggcccagtaaatgactctgaacccctggagaattccattcaaggcttccttggaaagtgtggaccaggatattgatatgctttctggtgatgttgctatggcttggacattttcgggggggtaactgggcactgaaatcaaataattagaatctgtaataactgtgggtggtttatgagcaaagcaataaccgaaaaagcaacgtattttaatatttcaatatgcaagcaaaaaattgcactcaaccccaaaatgaaagaaaaaataacaaagatcacttccctggaaaaatcttatgataactcagtgctcagtaaaatatcatgagtcaatgcatatattctaatggattccatagtctctctttccaacttagtttctttacttttaggacagttgttgggacttgagtcgtgtacccttcttaattttattgcctgagtagaaaatcattgtttgtctgatttattttccccttactcttggaagttacttctttaagttgcatttactttatagagtacggtacctctgtatttagtaatatctggcatataaattggaagctgaaccattgtaaagtgctaaaaagtagaaacataatcatagatttctcctgtctcatcctcatccctttctctagagggaagagagaccatagacaggtcagaagaatattgaaaatatttttagtactgagcttttgtaaaccttaaatgttggcgctggggcggtgcaaaatactggctgagacacgcatcttaatgaaaaatgagcattgaagcaaaaacaaaggcatatttaacgactattgcaattatgaagatagacaattccagtgttcaggctgcaagtcattgaagactcctctcctcgcaaaaattgtcagatattacaggtgcaagtcctatctgcctccgcaaacctgtgatcaagggccgggcgcggtggctcacgcctctaatcccagcacttttggaggccgaggcgggcagatcacgaggtcaggagatcgagaccatcctggctaacacggtgaaaacccgtctctactaataatacaaaaaattagccaggcgtggtggcgggtgcctgcagtcccagctactcgggaggctgaggcaggagaatggcgtgaacccgggaggcggagcttgcagcgagccaagatcgcgccactgcactccagcctgggagagagagccggactccgtctcaaaaaaaaatctatgatcaaatgactaactgcacaagaggtaaatgtagtgccagcttcctgccttcaaagctaccacttattgctacaaataaccccatatcttaacttcctgcctaaaacactgtgcctctggataccagggttctctattttcaagcactactggaaatttgagcttctgggttattctcagtgacatggtggaagggctaattaatttatctcggccgctagggggcgatcgatcactgtgcaatctgaaaattccttttctctgtactcagaatgcttgaaaataggaaacaatgaaaaataaaataaattttaaaaaaccttcttaacatttgggagaaagttttttagcaaatagcatttctgcattctcgtgagacttctgcagtaatagagagagccttgttttcactccagaaaagcccaattcttgtacctgaaatgaatgaggaagagtctgaaaagggagggacttgctggctttgcagtccagccctgccccagggcgggcagatcagcggggtgggcgaggtcacgagggaaggcttttccacccgagaccccaggccctgcaggtcactgcaaagtcgtggggcgggggagtgcgaggttgggggagccccggggcagacccgagggaacctttgcggagggaaaagccacgaccaggccccggccgaacctaccatcctcgagagtggtggtgatgatttcctgagaagaaggccccgtgccggcccggttacaggcctgcaccaccaggccgtactgagtgaacttattcaggttgtccagggtgtaaacctcactgtccccgctggtgtcgacactgataatgttgaattggaagttacccccagtgctgtactctcggtaacctatttggtagccacggataatcccattttgcaaatgtttcttgggagcctaaacaggagagaaaagaacacactaaagaagtcttgaggtaggacaagagcgaaatcaacgcccacacccacgtaggaaagcagaaataaagtggagtcatcgccacgatgctggggcggtggtccggtagcagccgcaaacccacgtacagtgcaacttggtctgtgccaggcacccttcctttacctgtgaatgcatccggccctcccagcccctctgagccactggaccgtcaatggacacaggaggtcacctgagtatgcatggcaggagcggaatctgaacatgggtgttgggccccagagcctgcgctctcattctgtccttcatgatgtactggttgacttgtctaactggcgagaaagtgtcaaaatacagatcatgtttgtggcgtctccaggtacgcttacgaccgggtgagactgaccctcaggcctgcacccagcaagaactctcgggctcgctgctgtgtgccaggccttgttccaggcaccagggaatagaattgagtttggaaatgtaagaagacaaaagaaaagacccccgtcctcatggagcttacattctaaggaaatatcccagaatcacagtgtttccaggttgaaaactggcatgggaaggtgagtgcacacccaataggaaggtaatctctttcatgaagccccgaatcattctggaatgatttgggggtgattaaatgtggggcaagagagaggctggtgctaactccaccctgctgatgtgaagatggtccaccaggtcaaagtaggatttaggctgatgcgtaggactcatttagaaaccagagccttttcaaggatggtataaggctgggcgcggtggctcacacctgtaatcccaccactttgggaggctgaggtgggcggatcacttgaggtcaggagttcaagaacagcctggccaacatggtgaaaccccgtctctgctaaaaatacaaaaattagccaggcatggtggtgggtgtctgtagtcccagctacctgggaggctaaaatgggagaatcacttgaacccgggaggcggaggttgcagtgagctgagattgccccactgcactccagcctgggtgacagaacaagactcagtctcaaaaagtaaaaaaagatatgcgaatgccaccaagatgaggctctagggaataaaggttttgtagactttcaggcagtcaacagatatgtgtgtttatgtgtatgcgtgtatgtatacatacacacatacatgtgtatgtatgtatacatgtacatatgtatgtatatacatatacacgtacacacatacatttaagtacaaactatggatctggatctctcaagcctctgaaagctttctccgtcctgaaagtgtttataatcgacctgcagagaggaaataagcacttaagaacctgtagagaactatgaagtgtggaaatgcatggtaagaaagtgaaggccagcaggcatctagaaagtgtgagtatgggtggtctgaagtggtgggaagactcagagcccaggtgggcttgacggagggggggaggtggcggggcacggctcagagaagtagaaggaggatggggtgagtggagcctgcaaagggtgcacacctgcccagcggtaagtcaggagggaacggacagagtggagcaagaccttgaaaacctgccaaatgtgaccgggggagggcagacaatgagaagtcagaagaaggtttcgagctgatgaacagcattgatggattcagcaaacacttatggattgcctaataataacttcccaggggattccatgcctcagcctgtcattagtagtaagtctgacttatccaagagcagtaaaatcatttttgtttttcacagcaagtttctccatttatggttttcttggactccacttgcttttcccaacagccaatctaatttagtatattcatggtgccagcaggtgtcagtgaaacagtcgcgtaaaccatttatttatttgtatctgttggctcggagttagaccctggtggaagagctcataccttttttattataaacaaatgtctatgctcctctgaatccacagatgtgctggcttttgcattgatgagctatggcttttctcactgtttagaaatagatttcaagattctatgttttgaaaattcaattactctatgtgaaaattgttttgctgcaaccactgaattacatttatgtgacctaattaattaatcaaatgaatttccctgtaaacgtcacctataagtcaaatttaccaacaaagagatttcccctattttacctagtgttttaatgttagatatagtgacccaaataaaataatattattttttaaatgagatttacatccattaaatattctaattgttcaactggctcccggtgaggctttaagcctccctaagacagcaagttggattcacagtatgggggctgtggagtcaggtcaagaagagtagacagtaaagtcaaatgcctgtgagaaagtgttttcatagagccaccaatttagctaaatcctccacaagaatgaagggacctgcttgctgacatgtagttcctccagtttggggggattaatcctgcctgtgatctgtttgtacaggtagaaaggagaaatcttcccttgtttcctctccatgggtgaaaacccatcctaactagcttaactataatagacaacgcaggtgtttttgttctgttccatttcaatattttgttaaaaagaaaaagaaaattctttacatttttcttagaagaactacatttcagtcctgtggttctaaaataaagcttattttttcttagttgatacttctgcaaaatattgtgtggaataattatctcattttgttttataataaaagtaaacaaccaccatttctatccaatgcaattctattcacattttgatgcatttcagtctatttatctaaagtaaagtgttttgccccacatagctgtgtttgtagcctgtacaatttagtgtctgagtttttcttcttcatttaatatgctattatgattatattcccatctttacttcatagtctttaaatatcatattccatcatattgatgttttattttatttaacctttttttaattgttggggatattattgtttccaggtttatttactaccacaaatgctatgttagacaccttcacaatatagtttctctgtttctaagtttatttattgaactcaagtcccagaagtagatgaccatcttattttttaagtccatgtttcaattggctgttaatgagatagggcttttttgattattattcttccagatgtgcaatatcatagggtaagttaagggattatatcacaaggaacaaacaagagagctctcctctatttttcttaatattccaattttgaaatgaaatatatggagtagagttatgcgttatttgatggtagtagtgtttttacatctttttttttcagggtgctaatatgatctatagttttcatgcagaataaattgttgcacctgaggaagaagtgagatgtgtttcttataaagggaacatatactttcagtttcatagcttgcaggtccccaaactataaggtttaaaaacagacttaaaaggtagtgggagaggatgggagcagcagccagtggttgcaagctttctctgtggggtgatgcaaatgtttacaattatggctacggctgcacatctctgtaaacatatgaaataccactgaatcatacacttaaaatagggaatgctatggcatgctaactgtatctcaataaagctgttttttacaaaggtagtgtgctaactcatctctaggttatctttctatttcaattacaacactaactggcacctccaccatgatgaccaccaccaccaatcaatgcttaccacctctgcaggtcactgtcaccactgccaacatcaatgccactccctcaggtcccccacacagccaagccaccaccatcactactaccatctttaccaccatcatcaccaccagcttcatctctgtcaaaaatactgtgaacaccaccaccaccagcaatagcatctctaccactgacatcaccaacattacaaccaccagtatcaacatcactgccataaaattaacctaatggtagaagcacctctatcacttcttccaactttaccaccatatttatcacaaacttcaccaacaaaccacactttaacctccactacttccatcatcatccttgatgttaccaccatcactgtcactaaaaagatgcttcactttatcactatcccaaaaccaacaacactatcaccaccaccatccatcactcaatcactatcccaacaccaacacaactatcaccacaaccatccatcactccattactattccaatattaacatcactaccaccgcaaatatccatcactccatcactattccaacaccaacattgccatcaccacaaccatccatcattccatcactatcccaacaccaatatcactatcaccacaaccatccatcactccatcactatcccaacaccaatatcactatcaccaccaccatccgtcacttcatcactatcccaataccaccatcactatcaccaccaccatccattacttcttcactatcccaacaccaacaccactgtcaccacaacatccatcactccatcactatcccaacaccaataccactgtcaccacaacatccaatactccatcactatcccaacaccaacagcactgtcaccacaacatccatcactccatcactatcccaacaccaacaccactgtcaccacaacatccatcactccatcactatcccaacaccaacaccactgtcaccaccaccatccatcgctccatcactatcccaacaccaccgtcactatcaccaccaccatccatcgctccatcactatcccaacaccaccatcactatcaccaccaccatccattacttcttcactatcccaacaccaacaccactgtcacaacatccatcgctccatcactatcccaacaccaacaccactgtcaccaccaccatccatcactccatcacaatcccaacaccaacaccactgtcaccacaacatccatcactccatcacaatcccagtgccaacatcactataacgacaaccatccattattccatcactatcccaacaccaatatcactatcaccacaaccatccatcattccattactatcccacaccaacatgaatgccaccacaatgaccacaactactactacctctaccacctccacttccacttattgaacactgttttttcccattgtaattggtgctttatgtatattatttcattttctttccctaaaaaaccccacacagtataagtatgcttctttacacatgaagaaacaaaaggtcaaatatgttaaaacaactatctcaaggcaagtacagggtaggaattctccaaagttgtatttggtattaaccgctcatagagcctcagagaacttttcacccttttgcaaagtttgttagttttgtaaagtaatagtatacatggcatttctaatcagaggaaaatttaatagatcacatgaagagaaaattgtatatttttatgcataaaagcaagcaaaaattctttatcagggaaagtttaagttactttattaatttgtagatagactagtcagattgaaatttagaaatgcatttaaattaaagaaatccttgtggatgtattttaaaacaacctctgaaaaaaatccataaatgtagggattttgtatattaagtgtaagaaatgttatggcctgtggttcaggttttcgaaaatgacactagaggctcactctgagttatggatgagtcagtaggagtggaaggtgtgcttagtggagacacgtgaatccatttgtctggcagtgggcttcatattcccaaggcaaattagtgcataagatccttaactggaaaattgttttgaatgatgctttagacatctttgcttggagcatgtgtctactaggaacaaagggagatggttttctggggtatagagaatatatccttatagggaaatgatctttagaacactgtattaaggttgttaattagcactgtagaacaattgatacatgggtggaaataatggttcactttcatgaaactcagtgaatgaggttaatggtggggtaagaagaaaaggaaaacaagaaatcaggtagggatctggaaacatattttgaatctgagttgcataatattggagaagacaaatttcctaggaaaccactttgaccatgcctctttgatctctgtctcccgatctcagtagtacctgttgtgagatctgatcgctgcctcatctctcaagactaatgcctcctgggtgttgcttgctcacctgcgttcctctctgactgcctgaaaaagggtggggatcccaactgtcttacatattcccaccttataaaagctgttgtcaaaaaatgttcttccttcttctttcaaagaatacccccactactccttctctgcaggccagctcagcttccagctcaccagggctcttccctagaccactcccaccaagaagccttctccctccctggtctccactggcattcactgatcacttctacctcctctagtggccaccattctcaatgaaacgtggtttcaaagaatgtcattgcaagctctagaatgcaaagaaccctacagaatgaaatctcacttgttatttccccctgtctaaatcggggcttcaacactgtggatgttctcagaagatattcttgcagatggagaagagaatggttttgaacacacatgagatgcaaaaaaaagaggtgggtaagaatgatcacaggtacaggtttataatctaactgggtaaaggactgatagcaagggtatgaagtcagaagaaattccttgactgcagacacatggtttagctgttgaagagaggcctggcttagccactacagaagtggagaactcagcagtctagtgtgacagccgggaagtgtggattcaagctgagagttggcttccgcactgggacttagcctgctggcctacacagaaggatgacaggttgaggcaggatttggaggggttgagcttcattgcccaggccccaccagggatgaaaatagcttctgatgagccaatttatttggacactgtcattcatttttttccttcttaaaagaaggattccagaaagagaatttgctcacttactcagccagccggtgggttacatgtttttatgatgatggacctgcagatttacagcaaatctcacctggtaaccagtcatcttaagacaaattaaaggagtcctttgaaacgtaagcatatggaaaaaaaaaaacacaaaaaaaacaaaaaactaagggctcccttctactcctatttaagaactcaataaaacaaggccctttccacagggaaaatgttgaaatttagaaatgtgtttaagttaaagaaatccttgaggacgtatttacaaacaaccgacttctttcctaagtgagtgctttctgtttgcctcttctcaaatccccttgaacgcagtgcaaatctaagagaaggtcatgcctgctccttgttaggtttctcacacaaagattgtttttcccatgttgaactttactcccccattcatttgcctttggattcagtaatgatcctgatttcttctcatttctttcatttatctgccatctgtggaatgctctctcccccttcctagcctggcaggtttttttctcctgtagtcctcctcaacagcctcctttcatcctcccagatgccctttctccagcttccaaatccctcccaacctccacttcctttaagaaaccttctcttttgatctccatgacaacagtcgcaccatgtcaatgtatttgcacggtgtgcaagtgacttattttatatgtccttctcaatcagtcggctgcaagccgcctgtggcagatgcatcatcctttaaagggacagtaaaacagtagacgtgcaaatgctcactgcacctgcctggatgtgaatgattagaacaggcatctcttgtgctgaagaccaccagccatgttctgtttccctcatgcctcctgcccccttcccattgaaaggaaatggcctctgctggatgtgcagaattcacctgttggctggagtctgctaagagcctcactgcagaatttcacgtttgaagaatgctgcctttctcaggcatgctgaataatttagttgggaaatgaattgaacattttctttatagattcctccaaatccacttaaaatgtaatctatcctcatttcccttatgtgacaagttgggtggacagtctttttcatctttgtgcgttttctgcagcctccccttacctgctttccaacataaacagtagccattccataagcttgctcagtgaatgggtgcatcacattgaacaaaccttaactgggcatctgttctacacaaggcatggcacaaccagggacacctttgagtgaatcagtgctcagaatactgcctgatacttgcagtgctgaaggtttgcccagagtactatggaggggcaaatcgtggtcagaaggattgccagagaagagcatacttcacctgagctaaagggtgactggacattgccttggagggtacaatgctgtcgccaaagcaattggcatacacagctgcacccaggtgcaaggacagaagacacccaggaatggagagaggctcaagtgactctggggtgaggtatccatggtgatcacaggggtgggggacggtacaagcacagatgaagctagggacatatctacgggacagaacctatggagcctgtatgtagtggtatggtgcgctaccagcaacatccacatcacctggaaaactgttagagctgcaagaactggggacccactcagagttcctgaatcaggaataaactctgggggtggagcctggtgaggtgtgttttaaaaagccctccaggggataccagtgctccctgagtctgagaatcactgttgttatcactgggagtcactcagtgatttagatttggctttgctgggagagactatttagttaaaaagcagcaactatgcattcccccatttctcaggttagccagtagcccattttcctggttcttggccaaacaaaagggaataaatgcacataaaactgttagaccttcctggtcttgggagtaatttaaagatctaccttactcagcactaaagggattctgctttacaataggtataggggtggtgtgagaaccagctggctatcttggtccatggacaatggattttgagggggctatgtcaggtcgaggagacctcttacattattgcctcaaataattcctttcctctcctctctcctttctttcctctcctttcttcttccttccttccttccttcctcccttcctttccttccttcctcccttcctttccttccttccctctttttcttttatttttctttctttttcacagggtctcactctgtcacccatgctggagtgcagtggtgggatcatggctcactgcagcctcaaccaccccaggctcaaataatccttccacttcagcctcctgagtacctgggatcacagacatgtcaccatacccggcaaatttttgaactttttttgtagagatgggtttttgccatgttgcccaggctggtctccaactcctgagcttaaataatctgcccaactcagcctcccaaagtgctgggattaccagcagtgaaccactgcttccggtctcaaatgatatttttgttcatatatctctccttagagttgcactgtattaaatacagtatctgtgtcctaggtctcataatgggtagatgtatggccacgtgactggctcccccaaagtcattatcttttgaggagctaggaaaggatgagatgtccacatttcatgaaatagaaaagggccacatgacctgataatgagacagtgcttagaacaaaggggctgtgcaatttcagtttgagaaataaatgataaatgacagattatttgaaataggcactgtcttgagagccaagaatgttacttgcaggctgcagctgccatattctagtcagacttggcagctgaggaggaaagagtggccaaggtatatgtgggctttgccttgagacacaaatgcagaatgctagaaatagattgataattttatgacatggaattgaggttaactactgcaaagcaaaactccatttattccatttctaaagtgtaggacagcttccgctttattcatccagccaacaaacacctgtgacatagctcctctttttgggacactccctttttgaattctgttgttcctcatacatcacaccacctgctaaccacagttaacatttcctaccagccacagaggcctatcagtgctctctgccaaggaccacacaagggcattcgggctttgcttcctatgaatcaactctgagggctggcctctgggaatacccccacctagctcccgcgcccaacaatggggacctagagggtgcactctgatgcaaaagagggggtatgctagtctgtgagcctgaggctgggccccaactatttagcggtggctgagtgaacccaaagggctttggcccaccacacacgcctggagggcccaacccagagtagcccctctgcaggtaatggaggccctgtaacggcagtgtggccaaggagggcagggcaggggcccgagaaaggccacagagataagggagggaggggcaccccgactccaatctgataaacaagcacaagaggcaggatttcaaaggcatggtcatggggccatgaaaaatgctcggaagtagttttgcgggatgggagaagacagtgtctgattctggaagctctgtaagacagcgccaggggagggccaatcatgatccaacaccgctggtaaagaggtcagtcgggcaggggtggagctgagtgagatgaaggcacatccacatccacctctcaccccaacaaaccactgggtctgcatgctctggaggcatcctggatgtcttgatgagaaaaggcaggaaaggagggtgaagaagaatcttccttggaacgaaacaggccctttccactggggagggcagggcgtgggaagctggaggccaaggcagggagccaagccaggagtcgccccagccagtgctctgacatgcacacagggcagcctctgtctaccctgtaggtccttaaactggaactgcctccatttccctcccaccctatatataatataatttatattatatttaataatataaattaaagaataactaagagaacccttaagtgatgtaggaggagagggtaagtatggagacaaactgagtcctggaatccacagggatgaggctgagagccagtagcgggtgagagtgaccctgggctggaagggacacacagatgggaacggcactgccaggaggcaggtggaagctgtgacagtcaaactaagacagagagagagagagagagagagagagagagagagagagagagagagagagagaaaggggcttgtaaaggagtaagcggcatcagtcacacgccgggttgttgcagcctttgtcatttttgctaagtatctgttcagaagaaccagagaagatccaggtctcagaaggagcctgcccactgaaaggtgagctttaattttataactggaaggaattcctgagtgctttacatctgtgccaaaagaaccaatgaaccagaagccatttttgagtggggcactgctataaagctacctgaaaatatggaagcaactttggaactgggtaatgagctgaggttggaagagtgttgagggctcagaagaagacaggaagatgagggaaagtctggaacttcccagagacttgttaaattgttatgatcacaatggtggtagtgatataggcaaagaagtccaggctgaggagttctaagacgagatgaggaacttattgggaactggagcaaaggtcacttctgttatgcattagcaaagaggttggagggattgtgcccctgccccaaagatctgtggatctttgaactggagagtgatgatttagcatatatcatatatggcgggaggggctagccttgtctcagatgagactctctcagttggatgtggctccctctcgagagatcatctcaatccaggaaataagggttgacaaactggtccctcctccagatctgtttggctgcttgtttttatgtggctcttagctaacaacggtttcttgttgtggcttacatttttaaatgattgaaaaaaatcaaaagaggaagaatattttgtcatgtgaaaattatgtgaacttcaaatttcacctttcctaggtgaagttttactggatcccagctgtcttcactcatccacgcatggactgcagctgtgcctatgcagcagaattgagcagttaagaccgagactgcagggcctacaaagctgaaaatatctgctctctggcccattagagaaacagtttgcagactcgtacaggacagtgctgtggacagaaccagcatgtgaggtagaacttactgggtgtgctgcaggtccaaggcagggtgggaaggagagaggggagaaaggttgacaggagaggcactactaagaaaggagcattggagaaaggcctgggctctgcccagtgttggttagagttcgttactctccttttatccatgctccaatggatagttctaacttgtgttctatcagaagacaaggaatagtaatgtctgcagtaacaatggagctccagtcctggattcaatatctgccctctatagctcagtagggattaagaggaggatggcattctttctctagagctaggctttgtctctctttccttttcttttttcttttttttttttttcctgagacagtctcgccttgtcacccaggctggagtgcattgatgccatctcagctgactgcagcctcgacctcccaggctcaagtgattctcccacttcagcctcctgagcagctgggaccacaggcacacaccaccacacccagctattttttttcttttgatagagatgaggtctcactatgttgcccaggctggtcttaaacccgtgggctcaagcaatcctcccaattcagcctttgaaagtgctaggattataggtgtgagccaccatgcctagcctcttatctatttttgggtaatgaaaagctttagccttgactaaagagaattttagacatcaacatgcatgaataggtatttgcgaggagaatattgaaaaagttgtctgggcaaggcacagtggctcatgcctgtaatcacagcacattaggaggccgaggcaggaggaccgctgcaggtcaggaatttgagaccagcctgggcaacatagtgagaccttgtctctacaaaaatcaaaaagttaactgggcatggtgatggtggtatgcacttgtagtcccagctactcaggaggctgaggtaggaggatcacatgagcctggaaggtcaaggctgcagtgagccaggatggtgccactacactgcattcagcctgggtggtagagtgagaccctgtctcaaaacaaaaacaaaaacaaaaaaacaaaagaaaagaaaaaaagaaaagaaacagttgtccaataggctactgtatgttccctgttaggaatgtgctagaagcattcagaccaagggcccctgtgaacactctggcttatgttgaggggaaatactccacaagtccagatgcaacacgtgccacagattccacacgggcccacgggagcaacacaggcactccctgaatcacactctccttcagtgggaagtcttgtttcctaaattcactaaggatctgccacctaaattcttctgttatttacagaaaaacaaaccctgtttccaacttcaaattgttactggcaggcaaaacaagaaggtaaaatggttttatttcttatacatctataattactcaaagcacaaagtacttttatttttggtctcaacttaaatttttcaaaagaacaggaagagtttattacaggaattgaaagaatttgaagtagctttcagcatttttaatacaatgaagagtttggctttaaaaatgttatgggctatcttgaaatagtttgttacatcttagtgcattaacttaaatgtatttgaactagtgaaatacgtttgaaggcacacattgtgtttttctgtcttgcttcatgctaccttgaaaatagtctggaaaatagctgtgccctcctggctggggttcttcctgtgatggaccctaaccaacttcgtccagccgagttgccataataataacaataaaactaatgtcatgtttcttcccttgccttaggagaggggtccatgacatagcagatgccatttgatgatgtctatgtaattcttgattggatatatgttttcctttttcattctaacatctgtgccctgtttactaacttatgtatctcacttgatttctctgaaaagatgggaaatgtcatcagcgagatggcttaaggactgctgtctgaggaaatacagcacattaaacagtgtatatccacctatgcactccctgtacggatggcatccatgcattcataatgctcaatgccatattaactttagcttgattttccaatttgttctctgtgaaaagcagagttaggattatatgagaactgataaaactgtctaagatggtcttctgaatacttttattaaattactacctacccatctatttttaaaaattaattaattaaatttttgagacgagtcttgctctgccactcaggctagagtacagttgagcaatcttggctcactgcagcctctgtctcctagcgttcaaggaattattctgcctcaacctcatgagtagctgcgactataggcatgatccatcatgcctggctaatttttgtatttttaatagagatagggtttcaccatgttggccaggctggtctcgaactcgtgatgttaagtgatctgcccgccttggcttcccaaaatgctgggattacaggcatgtgccactgtgcccgaccctatccatctattattaggttactgaaaataaacttctattttttgttgggaaaatttcaccacatttacatttattgggagatatttgccatcagaaatggcagtgctgtccagagccattggtggggtgggcggaatcagcatctaggatagggatccaaatcggggttgttaatcaagggaccaccttatggattccagagtgggcccacatccgttatcctctatggctatcaagtcagcactgggaggtgaggagagaggagaattcatcattaaaatgcactgctactttcttggttatgacataatgaataaaacacacaactcagaactagagaaaagggttcaagttccaataatgacaaatcaagtgacttaaggtcattttgttaggtgtagagatgggtgtcgtatctaattttctgaaatttaatccagtactttttacactgtattctaattatatataatttacttgttggaaatggatttaacttacgctaatgttactttaaaatgtgatgaaatagtgtcaacttatatttttacatgtacttttcagttttcactatgaatattacatgtttgtatatatatgttactgtaaagcttcctagtgaatattatgcatagtgtgcttattagacaatttaagtcattttcaatatcattctgaccatacacaatttttgacctagtgtcacaacttcaggacctggtccaattgtaaaaatgtaatgttgatgcactaagaaaacacctaaggatgagcgtcaatagatgtccaaaatacccctttagttgcaaccttatttgcatttctgataatatgctctttaaatcaggcaaatacaatacttgccttctaaagttatattgcaactttacagcttataacctaaccgttatacaaaaaatcaaagtgcctacacttagattttttgtgttcatccagactcaacgtgaaactcttagaagaaaccatccaacaggatttctggctcgacggcagacggccttggtcctaagccttagtccaagttcaatttgtgtcctgtcaaggccactctgctggagaggtacagctttttcagtggggtttgaatcaagaattgcctcttaggctgacagtcccagatagtgtctcttcccagcctgcctgagcatcagacctagattccacccctgtggctgcgagtagctcttgcaaatgcagccagcattttcctggctgcgctctaggctggaaaccaagggaactgcctgcttagttgaggagacctgccggaccctttgtgcatgcaggctggcagctctgtcctgggacagagaactggagtccttgaagaaggcccatcacatggctaaaccgagaggagtaacccaatgtatagacggagagatgcagaatacattccaaatggtataaataaacaccatggcttcattaaagaaacatgcatagtttacatatacaccaaaaagatgcaaatttagtcacctagggctttctagaaagtccacagttttttttttaaaagcaccacctcttgatatgaaccttttatgataaaagtaaacaatggtaaatggtttatgcattaatttaacgcatattaattgcactcctgctgagggtacagtgaacacacaagacatgtcctcaaccctcacggaacctagagtctagtccacctaaaaaagttgagaaagaacaatcttactttatacggatgaccagagattttgaaatttttttttcttttcttgttatcaaggaaggaggttagactcgttaatatgagaagggctaaaaattctttaagtatttgtaagacatgttggtgttcaggaatttcaataaggctattataaaaccaatgctagaaccaatggattagttcctaaaagcaaatgcaaacttttgtcatttttcatagcctaaagattaaagtgatagttgaagaattaagtaaagtttatttcaaggcaacctttttgaatttcagttgatataggaaaaaagggtgtctactcactatgaaagttactctaagcttaagtttacaatttggaaagaaaaggatactacgtaagaatgtaaatttcatatatctttaatttttatggggttgggtataatttataacatgagtttgcaaggaatagtaaagggagttaatatttattgagcattattatgcacgaactacaatcttggcacttcctagtaattaactggttgactgctcagaaacccaggaggcagaaccaggcagcctgggtggaagtcctcaatctgacagtcaccagccttcagaacttgggtaagttcctttgacttcaggatctccctctgcacaaaactgggtgttcccagctcacagatcaaatgagataatgcatgcagaagtttagcattgtgcctggcggggagcaaatatctctaaggacagctgtcccagttggccaggaaatactagtgctggaaggtgcctccaagactgccttttccaaggtaccttgcacttccctggggtagagggattttagtgcagaaggcaagtggagcctgcagtttattaaacgatgactacggaggtcactggaaataaggcagttttgtttttaaatgacagactgagtcattttcctgttgtaagagctcaactctgaaacttaataggttgtaatgatgcctcaattagctggaattattgggtatagtggagatgtgatattctggttaaaaatattcttcagattactgaaatttaattaaatctctgaatattcaacttagtattttacagaaatcatacctctctttcttaattctaaatgagaattttgcttattctcagtaaaattttcacgcagatagtacaatactgagggccaaatggtaaaattattctcaggatttttattgcaagtaatcactttgataattgttctcagcacagaaatatttaagcaattgaccatttcatattttggggacagcctgtggttctgcaaagatttcttatttaatgcaaaaataaaacaacaacacaaattttatatcaataggaaaaaaactctgtcttaaattgcattctctggataaatgttttgagatgtatataatcattaaatattctaaataatgaatgttttattttatgagtgaccatggcaaacacacacacacacacacacacacacacacacacacaagcatgcacacaagtagctggtaatcacattgtccttaatttgcatccaaagagggtcagctgattctgagactgattaggagagaaggtgacaggcactgctaaaagagacactttaggagataaactaaaaattggaattttctgaaaaaccaaagaattccttagttgtacaatgttcaggtacttcatcaaatatgttatcaattatccatagctttaaatattctttctgattttgaatcagaaacaaaacctgccatgaattaaattgtatttgcttacacaaatccttttgtttctccaagaatgtcaaatgaaactttattgtcatttacttttaattttattcagaactgcttacattgtcttttggatttctgtcaaggcatggggtagcactttaattagcttaatatttgtaaaagtatttaagagccctttctgagacttcatcttgcataatatagacatcataatatagcctatagaaagatattcctcttgaatatctttctatgggcttatatttgggatgtgaagatgtccatttcccatgaaacttatcacaaattggaccactactgccctttacttttcaataaactatattgaaaattaccatagtagaaactcatatgaaaagtggttggtcgcctggtgtactgagtgtggttcacatctttgggtgcctgccgttgtatagtctagggcatttcactgtatcatgagttagacctgagctcagcatgtttgctctctggagatcctgatagcggggatgccatctccatggcagtcttggaaacacgtaatgcttcacaggcaattgtgatatggaacacttgtcttctaggcctcttcattcccagctcacatatacactcacctctccttcacttacccattcattcattcatggaacacatgccagccatgagggatcagaactgagtaagcctctcttcctgctgccaaggagctcccagaacagtggaggggatgcacatgaaacagactgcagaagccactgggtgggaacctccctgagccatcgccaagagcaatgggtaacatagagggtgaaactctaattgcactctggggattcccatcttcatgggggcagtcatgcacaatctgagcctcaaatgagcaggaatggacaggagaggtaagcatgttacaaactgcctgaacactgacaggagagacgatgacacttgtggactgctgcttgggtaggtatccctgggaaggcgaggcaagataaggggcctgaatccaggtgctgcagctgatgtaggatggctgcattcactaggtcctgagcaacctttgctggacatgaaagattttaaaattagaagctcttctttggtgaaagaaataactaagataaaaagggtgccaggtgtggtagctcacgcctgtaatcccagcagtttgggaggccaaggtgggtggatcacgtgaagtcaggagttcaagaccagcctggccaacatggtgaaaacccctgtctctattaaaaatacaaaaaaagtagctgggtgtggtggcacatgcctgtaatcccagctacttgggaggctgaggcaggagaattgcttgaactcgggagacacaggttgcactgagcaaagatcgtgtcattgcactccagcctgggcgacagagtgagactctgtctcaaaataaataaataaaataaaatgaaataaaagtggaaagttgcttattttgatcaatagagggtgtcattacagaagcagtgcttattcaatgataattaaataaatgtaatatctatctccagtgttacagaaaggccaccaaagtgccccttacctttcaaaggcttagagtctaaatggctattttcccaccaaaaccccagagctatttcctcctttaccctgtgtctctgtactgaatgcatcttttacttctgatcagtgtccgtgaccatgaatgagcttccaccttagacttcccacgactgcatatgtccaccgtggctgacagatgtggggctccctctttggggctaacgctatttctccttctttctttctccttacacaaaacagatattctgaattttatgccataaataaaggcatgttatatgtaacatattgtcctttacatatacttaagatttcgtgtaatagtgtccaattcgattgaatcagtggtgtcctttaaaagctcattatataaacaggccgatgtgaaatgctaagctggtgacagggcagccccaacctcattagtcagttagatcaccggcaagtctgcctgctgacaggccatgccacaaaggcccactacagagatagattgcactcctccatgaacaatgtattcagtcgattcacaatctaatgagagccaggcttccttttaatagtcccacaacatttcaccctttggcactaaagagaaatttaactgcaatgcactgacttttgtggctgctttctacagagagagaaaggatacaatgccttttaaagcctcagaagtttccatttttagttataagagctagatcctctgtggacagacacctctctcatgcaggacccaaaagatccaaaaagcttttgaggccacagtaatacctggtctttttcagggcaaaacacgagagaatgtgtaaagctagtgggtaaaacttcacagtcttcaattcaagacagagtgagtcagcattccatttgtagagtggcgggaatgcgtgtggggttatggcttgctgagcgtctttattctacaatgtgtgtgatgctcgcagggggtggatgtgcttacaaagaccaatgacaccacctcccacactcctcggcctgcactttctatgcagctaaacagtcatatcacgctgcccgctggaaacacaactcattggctgcggttgagaaacgctgacacaaaggggctcgctgcattaacgcccgtaataccaaaggtggtatccgccccaacaatgaaaatccatttttgttacagaggctggtcatcttatgaaagaacccatactagaaggaaaacaaacaaacaatcaaacaaacaaacagatgcaatggttagaagaggtgtgtgatgtgaagaccttattgtagttgttggctgccctcttctcccagtgacgccacagaaaaaaaacggtgaggaaagagacaagaaaaaaaatcacatgccatgagagaaattcagagcggggatagttaatgcaatgttacagaacttttgattcgataataacgttctggatgaaacggaatttggcctaagacagagccatctccaagagcacattcaggaggatgactaatgccatggcccaccaggtcagggccatgctactgacctgaaggccatggaacagtggtggttggtgatgagcttgctccagaatcaacactgcttccttacttgagaaaatttgctatggaaaccatggctgttgaatgaaacgatgtgcttagtgatgcaattgtttacactgtggctcaagctttctttctctcccagctacttccaacaaacactaaagtaaccagcagccagtctgcctctatgggccacacatggggtagcactgccctgggagtcagtggattcaacagctcacttcactggcaagaaaatttaggggctttcttgagaacacatctagttagtggcacagtgaggacttggcctgttttctgccacctcggtggactgtctgccaccgcatgctttgccatttaaaaaaagcaatttgaaaacatttttgctgggatgaaatgagagcatgcagtcagggacatcaattttactatttctgtagagaccactgcttagaccttgatcaagattcaaggaagaaaaaaaaaaaagatacaaccactttattctctgagacacagaatttgctgtaaaagtattcaaaatgtggatacaaatactgcattttaagaaaagggctttcaacttaattttgaaaaaataaaagttttgtaaaattcgagagtcttggtgtcataacactgaacaggagtgaagggctcgccctggggggaaagcaccgagaatacaaatgtttgctgagtttaccttccatgtgaccctgatgctctgagatgatataggctccaggtgaacttcctgaggtggaccatcaggagctgtaaggaccaaaaacccacaggcaggttagagacgctttccggagcagatcgaagcctacacagccaaaggtggtccccgaggacaacccatccctatgtttggcacagagaaagaagtttttagcggtcatgggaaatgtcaattttgtagaattactgtgtccaactctaggcctttgtttatttgctctttggaaacatgaatcttggggacctatcatggtattccttctcaccatgtctttgacaacctcgtgaatcaatcccaattttgaacaaggggtacaacagaaagttgcaaaacaaaatttcccttatgaaatgctgtctatggtgtgtattgaaggtccttctctccccgctggaagctttgcttagtgatgtggtattggggtttctcaattgattagaatgacttcgggcaaaaataatcaagattcttctgcctttgggtgtctttcatggcttttgttcttcaattaaaaacccttgtggccgggcacggtggctcacgcctgtaatcccagcactctgggaggccgacgcgggcaatcacgagatcaggagattgagaccatcctggctaacacgatgaaaccccatctctactaaaatacaaaaaattagctgggtgtggtggcatgcacctgtagtcccagctactcgggaggctgaggtagaattgcttgaatccaggaggcagacgttgcagtaagccgagattgcgccactgcactccagcctgggcgacagagtgagactccatctcaaaacataaacaaacaaaaaacaacaaaaaaacccttgtgaaccaggggctctagccacagagtgctgaagcaatgttaaagaggaaacaaaagtgtgcaatttaaagcaacctatttctgctgagtgtgcaataagtcagtgggccaatgagagacaatcccaattacagggggccaatgagagacaatctcaattacagggagccaatgagagacaattccaattacatcccagttagagctgataggcatgtgttggaaatgtgctacctactaggtacatggtgtagaactaagagatgtaaaacattttgccaaccaagagttcagaatgtaatcagagctatgagatacacacactgaaagaaggttgcaatgcaaggcagcaggaaaacaggtgtcttctgagaagcagaagcaaatgacgacacagagatcagagggaaagaatcctttagattaaaaaatgtttttggattgacaatttttagatcactgcagaactacagaaagccagttctgtggacatttgcaaaaggttgtatggcacacgggagataagaaagctgaagtagtggatatgaactcattttggggagtttggaagtaatgggaaaagtaaagctatcttatagataaagggtagatttggggaagcgcatgactaagggaaagctcccttccttttttataaaggaagaggaagttctgagtagtagcatgatgtagttgctaagttgatgggccatttgagttttttctgtccaagttcacattctggttctatcacttgttggctgtgtgctttttctgcgggttacttagcttgtctgtgactccatttctctctatatataatgggccaatggaatttgtatcatagggttgttatgaaaacaatgtgctcagtaaatataagaaatcataatcataatataattatcattaagtgtttgtaaatagggggaagcaaatgggagaaatttaacaacaacaacaaaaggtaaacttgaaggaataatgaatgtcctggcagaaactgaagagggcagaagatacaggctatggagtgagtggggcaaaggaacaaatacctctgggatgggaggagggcagagcgacgggaggccttaggtaggcttactggttgagggaagccaggtgagggcagacacaggtaaacttactggttgaaagaagcgggttgaaacctgattgttgcttttctcaacaatatgacaataagccaagcaggaaatcagaatgggaacatgaaggagagagttatgggctttggaacaaaacaaagtcttggaaaatggctatggtctatagaaaagggtgcaccctgtgtcttagggcactaaggcgctctatcaaggtgcccctccccaggagtcagtgctctaagatgcagggattgctactccaagaggataatgggactccacagctccgtcctcgcactgaggaccaagcaggaagctgattccgcaggtcagggctggcgggactgggagagaatgatactataagaatgccaagaaacgaagccgattctccagcatatgtggtttgttatggtttagaaatatgagtttgaaaggaaatggggacattgcggcctcgattttccagttaagatgtacttataattaaaacaaaggtgttaaaagacaagagctggagagagaggaggtgggggttaggtctctgggctgtttgttccctgcacccctccttcacacacttgctgatgctgtccctgacatctgatccaaatggcccctgtcctatgctttctccaccatcgtccttatggggatccctatctctcactctgataccccactcccaccccacttctatgcctggtgacagtttctatttagttcctaaacattaattctggtctctattgtactcttttaaaagggacatggccccagagcacaattcacactgttcacccaccctagtaattttctgctcccagaaggcacctcgccgtcctctccacgctttcgttccgcgcactccctatgcaccctgtgtcccagccatgtccaaaacacacgggacccctgggtagagccgagccttttccctggggctttcttctccctccatcagggtttgccgcccatgcctgtgagcctcccgctgcagctgacacctgcctaggcctggggacctgtccctgtagtgtgcatatatgtttgcgtgtctgtctttgcatgtctctggtcacccagcagactctacatggcaccaggaactaagcccagagtgagtccttgctttgaatgggtaaagcaatttgtagatgctgaaatgctgagcatgcatccctctcctcagcaggtccagggacagctggcagtctggagtgctacagcctctcagatctattagttccaaaaatgcaaaggctctgctagaactgaagttaaagtccagaacaggagccgagggagagaatggcttccagctaatggtgatgattattgttgagcctctgcacccaatttcttgcacatggggtcaagctcttaggcaggaaactttggacctcaaattcaataaaaactcatggaatggatttccctcacacacagataattctgtgctcattgaaaagcacacggttttccataaaaatccttgaaaaatgatttttgagtctgacagctatactgaggctgggttactttaatttagttacacttaactgaatttgacaagaagccagtttgttaggaattggaggcaatgtcaggagcactgtctcatcctgaatcctctgggctccctggggcatggcctttggtgtggtcctctcaggaagatggcacacaagagttgcaaccttgattttccagttgagatatattcataattaaaccaaaggtgccagcatagtgtttacaagaatgtccccaattctatcagatagcatacatatcataatgtaatcatgaattgggagtaacttacttttccaatctggtctggtatttattttatttttcttgagacagggtctcactctgtcgcccaggctagaatgcagtggcactatctcgactcactgcaacctctaccgcccaggttcaagctattctcctgcttcaatctcccaagtagttgggattacaggtgtgtgccaccacgcctggctgacttttgcatttttagtagagatggggtttcgccatgttgcccaggctggtctcgaactcctggcctcaagtgatccgcccgcctcagcctcccaaagtgctgggattacaggtgtgagccaccatgccaggcccaggtctggtattttatgaaggtccccactgaagaggagagggggtacagttcttgtatccaggacagacttaactgtttttaagaatgtaacagctttattacttagcctaccaatgctgccatgatttgtcagtaatgtatttattgttctgcctgttccctgaagtgaaagcatttggatccctcctcctaaaaaaaaaaaaaaagtgatgaaaacagtccagacaaaccaaaataatttaatttgtacaaacacacaatagggctatgtccaatatcattaggaaggttttttgtttgcttgtgttttacaaagggcactaaattttctactatgtttctaaaacattactttaaaaattttttaaattataaaaaatttcccttctttaagaattttattgctttctgtataactcctgagctgtaattttttcataggttatcatctcattgccaatgatgcctataaaattacagtccaaagccgattgagtttccaatgcaaaatgtattaagggtcaaaaattaggtatatccatttatttaactaaatttgaaaattgtgttgacattggaaatttaagaatttacttacatggtttcaaatgtaatatatagaaaaagcagaattggcttccccactttggaagccaaagtgggcagatgacctgaggtcaggagctcaagaccagccttgccaacatggtgaaacatggtctctactaaaaatacacaaatttgctgggtgcagtggtacatgcccataatcccagctactggggaggctgaggcaggataaccgcttgaacccaggaggcggaggttgtagtgagctgagattgtgccattgcactccagtctgggcaacagagcaagactccatctcacaaaaaacaagtgattttacaaaataaactctgcatttctaagaaatccaaaactcttcgatctgtaaagcagtaataagcgaagactatctttataatttgtattatgtttgcaaaggtaaaagtcaggacaattcattctgtttggctgaaaacacagggatgacaggcacctcctgattgccaaacgcatggatctccgctttgcttccctgtcctgatccttcctggctacgctgtctctgcttctgtccctccccagctggacaacctcccactgcccagcagctcctgtgtccctcccagagctgagactcaagcctcggtgctccattctgctccaaaatactctcctccctgtctcaatatcttggctttagccagcatcttggggcctcatcattaattgatatgggctcaatcaccccagtgagaaccagtcccacatttttgcctctggttctgattgggagatttgccttctatgtgccaggtcctaaactaggcaaagactgggatacaaaagcagaaaaaaatatataaatttttaaaaagtagtgaggagcagctgcataattctacaaacacacgtttgtcttctacaggagttgggtgggtgggcgagaggcatgctctgtgttggacaaagggaaccaagacagtatttagtaaaaatcaaaatacgacaaagaatagctggtgcccagatggggaaaggctgaagtcatgtaataactacttattaaataaatggctgatttatttaacctacttatttaattagcacatcctatgtgctaaacaccaatctaggtgcctgggatacagcagtgagtgagcagaacaagcaactccacctgccctggtgggatgggatcaaagcagaccataagcaaaataaatcaacaacttatacagtacactgggtgctgatacaagcgactgctagaaggagagtggtaagggaggcaggggacccagtggagtgggcagtgggttgaattttaatagggtggccaggattggattcttggagaataatatttgaaagtggtaagggaagagacgaagaacatttcagaacattccagaactgttccagaacctttcaggatagcagacaggggtatacacaatgtgtatgagggacagcaagaaggccgataactttctttagatttaattcccaaagtttcttcaaacccaggatggaggagaatgacaaaaatctacagaggcagatcgctgagggcctggttggtcatggggtgtgctcggctcttctcgctgagtgaatgctgtgcatttgactcttactgaagaacacattgatgccgccctctgcactaatgagcactgctagccctgtgtttgcttcacatgctcctgacttttattccttctgccctcattccatcctctcccctccaccccagctcagcacataggaaactcttcttccagatcacagctgctgccccggaatgggaggaaagatgaggcaaggacttaactcagtgccagattcattggaaacccagtgactctgcatcatgacccttccataatccacaccttctattctctgatggtctgtcaaattcagtggtgtttcaatgagcacccactaattgaagctgcatgttctatgcacagatttatagtgaaaataatgaagggggcagccatcccaaactcggtcacaaggcactaagtgactcatgacctgcagggggcagctgctaatggggaagttggtctgtagcaagggttagctgtgaatgtcatgtgtcacgtggctgatccgtgtcaaagagacacacttcgggtccattaacagctcatctcattaactccgactgtgtcacttattctcttgactgctcctttgttgtgggggctgctggtgctaggggtggttggggaagccatgaagactgcgctgaatggtgtggtcttggcttcatggctattctctgaggtcgagtgtattaaagtggtatgataacgctttatgcactttcacatgcaacacatgcaaataaactgagtagtttggggttggagcaatgagatttcccaacattaggtagggacactatgccagtggcagcaatcccttcctcactaagctttgcagtagatacagcagaaatctaaaactcaaattcccatggtggccagacttcatcagagatccataaacatttctgtaaagactcagatagtacaaattttgggctttatgggcccatgttattctttttttttttttttaaagatgaaaaaactatgcttagttcaaggtctgtaggtgaagtttggctcaccgactgtagtttgctgatccttcaatgaatggaggatgggaactatggctcactgagggggtatggtcagcctctgggatggccactccatgcttaactccagctcattgctgccaagcaggaactcaagaggaactcaaaatttagattttcagctgaaatttccagattttaaaaattaacatcgaatttaaaagtttcgcacaacactgagccgactcacatccacaggcctggtctgtcgtgggctgcagcttatggcctgggacatgccctattccatcaggatgcggggagggcacctcaagctccagatgcagccatttcatgggtggtcactggagctctgatgggggctgtattctttccccatcttctttcctctcagccttcctgtcctatctttcacctttctctacttttctgcatgaagtccttgtcttagtcttttggggctgctataacaaagtactctaaactgcatgacttatacaccacagaagtttatttatttctgtttctttttttgacaaggagtctcactctgttgcccaggctggagtgcagtggcacgaccttggctcactgcaacctccgcctccagggttcaagcgattctcctgtctcagcctcccaagtagctgggattacaggcatgtgccacaatgcatggctaatttttttttgtatttttagtagagacggagtttagccatgtcggccaggctggtctcgaactcctgacctcaagtgatccccctgcctcagcctcccaaagtgttgggattataggcgtgaactaccgtgcctggctcagaagtttatttcttacagaaatttatttctagaggctgacaattccaagatcaagatgccagatttggtgtctggtcagggctcattcttctggttcatagatagtgccttcttcccatgtcctcccggggcagaaggggtaagtgatcttattgggccttgggcctattgtataagggcatactgatgctattaatgatgggtccaccctcacttcctaaaggccccacttcttaatattattgcattaggaattaggtttcaggatattcatttgaaagggaaggcatgaacattcagaccagggcacccttcagaatttcactgtgggtttaatccagcatatattttctcaacacacacatacacacacacacacacacacacacacacgcacacacacacacacgcacacacacatactctgctcattgtgacacccattctaaaggcaatactgtgggtaatgtttataaacgttcatctcatactttcatctcccttatgccagacacacacaagggacagaattgtaagcacatatgccccctgatgtggagggggccacagcccctccacatcaggtggtatatcatcatggacagcagggtccatgaagacatgatgatacacctcaaaggctactgtcagcaaaatccctcctctgtcctgagctgagtagtccctaactacacatgggagatggaaaaaggcattgcaccagggaggaaggcattcttgaacttgacttttcaaggaagggcacagaaaaggagacatggaacttgtagtgccttcaagacaggggaagaagcacaacaataggggtctgggagcatgcaaaggcaggtgagtgctgggcattgggctctggggagtcactaagtgtcattgcaaagtagtagcattggggggcatcctcgtgtgcccaagacttgggtactagattacagtaaaagtgagtgggctgacagcttccggaggctcccatatgaggaataagggaacagtgggacaaggtcacctcaagacagctacagctcctaaaaagatgtgcctttgggtttacctgctgggaaggggcagcagtgtctacagcccctgctcaatactctaatgaggatgcctttggccagagcaccccattctaggtaagtcacacatgggaaattgactttttaatttcagtcatgcaaacctatgaaccaagacaaagacaagttatctgctgtagcttttcatttctagaacctgctcctttccttcccttccccttagctcctctgaatattaaaggagaggggctgtgtggggctgccacagccagcacacccagatacaatacaaaaggccagcctgggagccaaagaggcagcatctgcatctgtctgcagacatgccaggcagctgccctgcagaccagcaccccagaggctcttcacctggccttctggcagggagagagctgcttccatggcaactgccagccgcagcagaggtcacagaggaaacgaagaaaaaagcaacaacagcagcattaataatggcaatcagaaaagcaggtgcaaaatgcaccaccggaaaaatgctgttttcccgaggaggtggctgggatggggcgagattagaaaagggcttgagagagaaggagaagattgagcaggaagtcagagatgacattttgggctgaaggatggggacagcttattctccctaagtacccagcataatgaaatctcagggatctgaggaagttagtgggttgtttacatacataattaaatacaattctattttttgcagaagcagattaacacttatttcccacttatttctgagacatgcaaagtattttcagagcttgagtttttttcagtgatcagatatgtctgtgtaaggagcagaaaggcatcataatgtccattttgcagatgagaaatcatacagagaatccaagtctcagaaatggctcactctcaggcacttcagcctaaagatcttctgtcactcactcttgaaaacaattttcaagaactgacatcttccagcattgaaaaatgggcattcctctgcagttcaggaagagttgtacattttaacctattctcttgaagacaacactgattacagatatcagaagggtgaaaatgttgcatttgattgatccagccatctgacttcttaggatttaatctaagaaaatgatcttggagatagcaaaagacataccaccaggatgttcattgtagtggtgtttatactaatgaaaactcgaaaataattgacccgtttggcaatatgagatttgttaaacacatagtgagagatatcattacaaattgtagaaaagtacttaagagatacataagctccatttatatttgggatgctgttaatgagggtagcagagatgaggtggtgggaaggaagccaagatcaacctctcttgaaagttgcaacaaacctccggtcttctgttagccatctgggtgtggcaatcaccttaatcttggtgatggagaaacagggacttgagactaagctgccatcttccctgcagtagggagtggctgattgctctgatggtgggcaggaaaagaagaggtaggtttgggagctggacaccctttccctacaataaatgggccaggcatgcaatccttgtggatgaaacccaagcgcagtggcttcctctcctcctgccaggaggcgggctgacaatcagcattcatggaccattgcctgattgctcagttctctgcacacctgttaatttcacccccccggaaacatgagtggctcgcagtgtgttaaggggtgtgaatacactggtgcgtgcctgtgtgcatgtgcgtgtgtgggtgatgaaattatttagccagttatcactgcctgttcctgggttagctctcagtgggaaaatgatggaagctgttttgccttctccacaatgcttatctctatcttctgaatttgcaacactaaatataatgttgtttgtaatagaaaaaagagcaaaaacattatttttaaatattgatgtttctagtcaataaaataatctgttccccttcccacatctcccgcacagtaagcatgcttgcagattcctagttaagcattactgcttcctcccacactggacttcacagggtctcaggaaagaaacacactcacggttctcctgtcaacctggattccatgtgtccaaacaaaggaattgtaaaacggcatgattctttgaatctcaccagattgttagcctcatacgtctttcttttaagtcttgggtatgggaaacttgaactaaatcctatttgaagagcagtgccttcaaagtaagatgcagagcgctgtctgcgttttttatagggcacagaactacggagagcacgcatcaaagacctccgcctagcacgggcaaaggtctgcttctgcatttaagcatctgagccctcaagagttagctcccgggctcctctggagcaaggttccgcccggtcccacgtacctgcctcgtccgccgtgatggtgagctcgttgctgggctcgctcttgccaatccggttcttggcgtacatgcggatgctgtaggtggaggaagggtggatatcaatgatggtggccgagttcagctgaggggaaacatctttggttctctgagcagaatcccaggagtcttttgggttttgtttttcaaaaaagaagagatagagacgtgagtttttttcctctgcctttgaaagttcacaagtaggaattaaaaaccaaaaaaaaaaaaaaaaaaaaaaaaagacggaaagaaagaaaaattacactcaaagtgatttctgaatgcaatgttcccagctttctggcagagttggccatcagaggggatgtgacatcccacacacattattcacgctgcgagggacatggggcaacaagccagctgagttcagggaggggtgatggaggaagcacagatcagccgactgggggagatctcagaaggcaaattccagtggtggaagctcaggttagtggaatggacgatggccactgtaagcactcattgtataggacagtacaatgaactatggtttggatagtacccctgggcccccccaaaatccctggcatttgaaaaccagcaaaacttcaagccatatcagatcctttcctccccaaatagagtgtggtaaaaacaagataatcccatacaaaccaatctcaagttccagaataaatcctgattaccaaacatattttttcagttctattttttgaaatcatttagtgccaaatccttggttgtaggaattatttttcaaccacagctaattataacagcagcacctactttgtgtgaaatgttatcactgaatctgtgacattttgtatctggtggttttcaggcttcaagcaaggatgagaatgtcaatacgtggttcttatatcaaaagagtttgggcagttgttgactgtaggtgtgtggtcgacagctggtattggctggggatgaaaaaaggagggcccaagacagtagacagagatggtgcctacatattcccaccctcctcagggtctgccttggtggtgctcaccacacaagtaagtcttccatggataatctgaatctgtgttccctgctagactttaagctccaggagggcagaggccatgctggccatacccagtcttttatccctagtgctagcacagtgcctggctcatagtagacaaatagtacatgaatgtttaatagaggaacaaataaaccacaaatacatggacctctgagtcttgggaatggggccaatcactttgtcacactaagggtgagtatggcagtttaggggacttctctgtccagagttaaacataaatgcaagagattttctggaattgaagaaaaaatatgtggcttaaagactgcttttggatactgtaacttctcagagaatgaagcctaatagaatctgacaatgaatattgcagttagaaggaaaaagcatatttggggtcaagaagattagaggtggaaaaacatgaaatacaaagagttggaaaaaaattgacaaggggaagaatgggattcaatggaagacaaatgaggagaggaaattttatatcaatgaaacggcacacacctatgaggcttgtcccacagagagaaagccagaccttctgcagagatgtttaggaggatgaggaggaatgccaggtgccacaagatgcagagacatttgctaagtagcccctggaggaagtaggcagttgtggtggttgatgcctctgcccaggcaacattgaagtttctgaaactgacggggccaatgaagatacagccatcttcactggaggctcttgtctgggagttggcaggcagcctggagaggcatatgagtgtccatgactgcagtcccttacaccaatccaaggcatatggtggacctgggtagggtggggacagtcccctcttggtggtcactgggcacctccacatccatgccctataggttcctttagctcagcccctatctcagtgatgtcaccttgttcaacagtctcccagtgtgacttataaatcctctctgatgctgcgtttgcaccctgtctgtagcaactaccactaactccctccaatgggctgggggacccgttacaaagcccatcctcaccctcctgtccgtggccttcccagactctccccagtcacacttgccacttttcagatcttggatgtccatgcatacatttctgtttgtgttttacgcctaagaacttttttattgggtcaatggtgcattcttcctagttatatttatatctcaattttcagtttcctcctcccatcaggtcaatgtgctgggcattttcaaacgtgacttctgtggccccaaatctgtgggcacattggaaacaccttggggctttttgataattctgctttcagacctaccaaaccagagtctctggggaatggtgcccagaaacctgtgcttttaaaaaggctccctatcttggtcattccgatgtatagtttggacagactgcttcatttgattaaaattgtacaacatcctgtcaaggtaaggtttttatttccttagtgaaagtcaagaaactcaagccctgttacatagctggtaacaagaagggctgggatttggcctcgcctgtgttatctccaagttcaaggtcatttttctgtaatgcatgacctccacatactctctgaaaacacctaataagacaggattttgatatttccgggcacctgctgaaaatctcgtatgcctagaagaagaccttctggcaaattattgacttgacaatgcacagaaatcgtttggtcaaatgtaagagaagaaaactttggccaagaatgactgtaccatctgtgggtttgtaggaagactgagagggctgtataggctcggagttgcagcctggtttaggaagatgtcagaagcattcacgaaagagtgggcgggatgccatggcttgctccagggagactggtggtgtaggaggatggggcagttcagagtcccactgcagcctctgtgaggtgaggaaggagtgaagagctgacaggagccagtgagactgcgctgggtgcttgctggggagctcgccttgggggtcagataccccaaatccagtggatgcaagagcaacaaggactaatataagagagtggacttggtatgaagaagtgctgttagaggctaaagaccagaatgagtgaaggtgactgaaagttctggaggtgaattacatgaaaggtttaacaatggagaggtagctgggagagggagcgggcccttcatgttggtgaataggaggaggtgtggggacacaggagagccccttgttctctgtcttattcttctcaaggataacagtcctcagggtgaactaggggtgggaagaccaagagaggagaggggttggggtgtgcaccttctgtgtcagagtctgtgtttcctggttacctttcagggtgtgacagagcttgccatggtgctgaaacctggtcagagacctgtgagccaccacggacaggagggagggacaagagaaactgtggacaggacggaggcaccggagaaactgtggacagcagaggccaacagagaaaccgtggacaggagggaggtaccagagaaactgtggacaggaggggccagcagagaaaccgtggacagaacgggccaccagagaaaccgtggacaggagggggttaccagagaaaccgtggacaggggggggttaccagagaaaccgtggacgggggggggttaccagagaaaccgtggacgggggggctaccagagaaaccgtggacgggggggggtaccagagaaaccgtggacaggaggggggtaccagagaaaccgtggacggggggggttaccagagaaaccgtggacagaacgggccaccagagaaaccgtggacaggagggggctaccagagaaaccgtggacggggggggttaccagagaaaccgtggacagaacgggccaccagagaaaccgtggacaggagggggttaccagagaaaccgtggacggggggggttaccagagaaaccgtggacagaacgggccaccagagaaaccgtggacaggagggggctaccagagaaaccgtggacaggagggggctaccagagaaaccgtggacggggggggttaccagagaaaccgtggacaggagaggcaacaagagaacctgcggacaggagatggcccccacaggaacagactctgaagggcaggctgccttccaaggaagggaataaagggaggcaacaaactgcagacgaatctgctggaggtccccagacaatatgctcgaagggatgttaaaggtggccttgggtccttgtaggggagaagcagtagtccctgggaatcagaaaatatggcaaccaaggcaacctgtgtaattgccacctatgggagaagaagaatgttccagataaggaagggacagcttcactgtgcctgtgcccgctcagatgacgcctctggtgctgccactgggcatgaccagagttaggggggcaggagatgatgacaggagatacaataacaaggacttggggtgttcagtgtttcctggaaaagagtaaaccaaggaaagtcatctgttgtcaaatcctgggaggactgtcatttggccaaagggttaagaggtgggaggagagacactggatccaggaaggtctattttggtgcaataaatgtaagaacttgtagcagtcacagctggccaaaggcagagctgtgctccctgggttagtgagtttctgtttctcggattgttcaagcatagagtgaatggtcacttgcagaagttctttctgttacgaatgtgaagtactttaatacattggttatatgctgctttctttgaaaattaatgaaaaggaaaggaaaacttttggggggataatttcaccgttgcctaaaacagatgttgagagtcaacaatttgactaatggttattatgagtctcgtatacatgtcaggcactatgaggggcacagggacatagcataaggtttgtcagagacaattccagccctcagggctcactatggcccatagggggacaactgttcagtggggtgcagatagtaaattaatagtcacaagcccaccaagtgttccaagacatgctatgaatagtgaaggggaataggtagtcagggaaggcttcctggaagaagtgacatttaggctgttattaatacttgaaggatcagttttctatgtactcagtctaaaactacactcacttaaattatggttgtaatttttatacaccaaaaatttctggaggaagaaactaatacatgaaaaatctgactaacacaactcgtacagcagtgagtacaggtgctatctactctcagcacagctccttcctcccagggcttccaaactgaaagtaattgaagttctgtagggtcctggtagagaccttggtcatggacttggatctgcttgtcctgtgggcttttctcctgggacccatgctgccccttaaaatgacttgctccagggctacataaacatcttagccacaccactggccctgtctctggttgaagtagggcatgaaggatggaaaagagtatccctcaatcccgcctgtactcagctttatagacaaggagctttcctgctttggttatataaaccatgatcaatttatacatttaaagatgctgttgataataatgattcttagatttcaattgcatgtaaattaatgcaataaacatttacagtatgctcttcacttgacattgtgctgggtgctggggatcccaggacacagagaaccagagtccctgcctttgggaaactcctgggtaagagtagggagatagtgaggacacttagatgctgagtaagtagtttaacacagagggttttagaggcattttactcctaagtattttcctgcatgctggagcaatctacaagctaccacctattagatgttgagtatgctccagacaacgaggaaggcgttttcaatgtcttcccttcttagagttcaccaatttccattgagtgtctccacatgttgggtgcggtgctgggtgttggagaaatgagctgggtgaaaatagacctactaggtgcagggagcccccaaggagcctctagcgtggtggaggtgaaatgcattaatcagcatatttgtcagtaatcatagagatacatatatagtgacccataatgccacctgcccagattgaaagggagaaggagctgggtgagcacctgagaattgagatctatggagggggtagtaactgggtggctcagggaagggaggactccaggcagagggcagctggtggcctttgtggtctccttgccagtcctttgaggtggatgcagcagtgcccacttcacaggtgagatgcgcaagcgagggtgcagagctggtgcaacgcaggcccagcagcgaatcccacacaggctgggtcccaaatcactgagcccaggcctgccaccagcatccggcaatgcccgctcctccatgaggacaggggaggtcctgggctgctccagtaggagaggtctcctgtgtgctcccgcaccaacagcatgggcagcctgcagccccatagccagtgcgcagccagtgagataaagggctgtccctgtccccacggtgctcactgcatctgtctgagctctcatcactgtcactaagttccaggacagtttctgctcaaatgtgcctgcctcacctaagaagcatttgcttcacttcaagacctgtatacatgaacttgtaagaaaggcaaggtcagcctctcctccctgggcccttgggaaacctgttggtcctagtccccaaaagatgcttgttcagctcagcactgtcttgggtgagccccccaggtcactgtgcctcacccctgagcccagggccctggctctgcagcatttcttggctacggtgagacttgcagtccaatcaaccccggaaggcccttcctcagactttgtgtaagtgacacctcacttctaggcccccagttgcaactcagaggccgatgacctgagccattccatctttcctcatgtgcatttccaacccagcagtcacagatactacttttcaaaacactattttttgttttgatccatatcttctcaatcttcaaattctgttctcctgaattcccgaagagtcacccctcggcttgcctttgcagtcaccatttcctggctctgttcctggcttgctcttgctgaaacatttcctcactcctgacctgtggttcccagctgccttgagcttgattttttactacagctttagtgccaaagatattagatgggtcacaactgggtaatctgaaataacgtgcggtatccaggaagtgaaaaataaagctgcttttgcggcctagaaggattttattaacccttcccatgctggtggtgctcgaattcctcatatcttttatgagacacagtaaaaattctgactagaggccactgtggtggtattctaccctcgcccaatgcatcataaagttcaaaatggcccgggcattgttccttgaaggcaatgaatgggcacacctgcagcggccctggcagcagggtcagttttatttatgggctctgggccgagtggtcctgggtgcagcagccagtgtcgccgatggtccctgagcatttccaggaggttgctccagagtgaattttcctttttctgcaccaaccaccactgcacagtttatccgaccaacaccaagcacagcttgagctcaacgctctgggtgcaggacatgggctcaggctctacaaaagtcacccagctcgggaaacgggaagtgaagggagcaggtgaaatagaaaaggtcatggtgggggcctgtctccatcagccactgcccacatgccaacaggaagctgcaatatcaaggagtccagcaggaagcaagactgaagtctgggctggctaaaaaagaaagaagcagagctgagcctcaacacgaaactccactcccacagcagaaagccaggatgtgcttccagcaaggagactgggggaagtggtgccctctgagctcctgtgagctgagctgtgcgcttacaggtaaaacacattaataaggagaaaaataaaagaactttctgaggtggaagggaagctggaggaagtaaagaacttacctgatttatttttgcattcaatatcgtagcctgtgatgggactgtttccatcaaaccccatggtccacctgagcgtaattgtgcgtgctttgacatctttgatctcaatttcgggagggtctgggggctctgtgccatcaacagaaagactacgagttagttcaaacagagctctgacataaaacgctagtggaaatgctgagcgtgactcacaaacgatttgtctgcattagacaagaacagaagctttttatttggaagcattttctttttcctaatcacattttagggaagagaaattccactttcccaagacttccaattttcatagcccttaagaactggaccaagcctggaggatataaaatgtcacgattctagtttggatctctaactcaaaacatattttggccccaaatgttaaacttccctttcattctggtcatctagtacatggattcctaaaattgagcaaagaaattccaccgctgtacttgtgtgcatgtggcttgactgtcatgggcttgtcatcttgactggttcctctaagggcttcgttccctgtttgggggctttactttgacataatcccaggcactgcaaaattctgctttagcactgacattatacatattcaaaatttcctgggaattaggaagtgttacatggcaagttgaggacacagagatgcctgaggctgagcatacagctcccatcctgaaatgactgtgtttattctcttacgctatcgtcttcctaccttgcactgtgagctgaattattccacggtcctccccataagaattaatagcatggcaggaaaagaaaccagaatcttctctcacagttggcaaaatctatgtgtaaagcagaaagaaattcatctttttcagtaggcaaaatgactttgagccgtaaagctctctctctccactctttcagttctcctgccatgccaagcacacacataggtacactcacacacacacacacacactcacaaaacccccattcctccagactcacatactaaatcacacacatgcacgtatccctctgaggacaaattatttcagtgtaattgaaagtaggcggatggataggattcacgtacattatccatgtcaggtgtagctcattaaattggatgtgtaatttatataagatgtcgtggtcagcttgacatatatcccacatatacattttttttttcatggtatccaaagcaaccatgcctaaagagacagattaaatactgcaggcagggctgggggcccgcaagactcgcatcagattccttttctaggaggattccaggaatggacccttgtctgagagccaatataagcatttcaaacacagggcttccccacctccccaccctgtgtgtgctacagtatcatcctccaaccgcatgacaacagcacaaaccagttcactgctcacagtccttttctctagcttttgtgatcctcttttaacgacagattttttttttattgtggatttttccaaagaagcaagatagtttttatgataatatttttgtcccaaagcccatctcatttttctttttgcaggaagttaaaacatgcacacagcataggccatcattcctgaaggattaactgtcatttaaaaaccttatttctcactttttttttttttttttactacatttgggttccctgctgcgttcataataaccctattcttaataacacttaggctgaagcactatttttgaaggctacttcactaatctcgctgtgtgaaaggggagagaaatagtgcttcgtaaataaattccgaaagattatctgctacttatctgcacccgcttctgtgaaaggaaagacttattcttccaataaagttcattccattgtgttgtatttgccatgcttttacctgcagagtagaaatcacctcttctcccacctccttggtggacacaagataacgggccatctcagggttaatgattcggtcctccttctcccagcggactataatgggcttctcaccatgcgccgtgcagctcatctcctttttctgcccctgcgtggccagggtagtatttggataggatgttatcatcgcaggaactgaaaaagcaaaagggacacaacttgttcagcaaagcagggttcttgattttccctggcaaaacactcaggtaaaccatgcttcaagagatatttcttcaaaatgaaatttattcaagaaactgctgcatgagaatctcgagcaaaataaaggaaaggcaccagaaaaatgaaacttgagtaagtgagccctcagcagaaattgccatgccgtttcatatccacggcacgttgctcttccaaccctgttgagggctatggcctatgtcccttagcacacccagaatgattgatatgggttggctgtgtccccacccaaatctcatctggaattgtatgcccataattcattcccatgtttcatgggaggaacctggtggggggtaattgagtcatggaggcggatctttcccatgctgttctcatgatagtgagtaagtcttatgagatctgatggttttaaaaatgggattttctctgcacaagtgctctctctttgcctgctgccaaccatgtaggatgtgacttgctcctcctcgccttccatcatggtcatgaggcctccccagccacatggaactgtaagtccattaaacctctttcttttgtaaacagcccagtctcaggcatgtctgtatcagcagcatgaaaacggactaatacaatgatgttactggtttctaactatcattataaacaatggggataaaacttccacttttagtcaactttaggtgaatcccttgttgctgctaaccagtccttgtaaccacttttcacaatgcccatctcccacagttgttataaaccttgcaaacctttatcagtcactggagacctcaaacctgtccttcttccataacttatagcagagaatctcgtctccaatttactgagaaaagggaaccctttatttgtgaagcttctcaagtttccttttcccacatcaaaattaaaagaagtctaatacatagacttcttttcttggcaatagatgacaaaagatcccaccccaattccacaagccacttataaattgtagactgcatatgacaaacaccttttaaaatgcatactaagcttatcagaaagtgagagaaaaaccagagaccaaacacaaaagctgatagtgaaaagccagaggtaatatataatggcggtgctttgactacctgagaggcatgacattaaatatgagacctccaaagccaggctcctcaaagggttctatcttgacagaaagtatataaccaaaataataataacaataaataaaaatccacaaaggcaaagagagaagaaagctgcctcagcttgtgttatatatgtagaaaaacaatctctcccctgagaatttataaaactggcctgactctacataggtctgtagtcaaattcatgctaaagctttaacatgaaggtgaccgtaatttgataatggcctgaggagcctagcaaaagctaacatactctagaagaatgtgtcctctgtccaggcccactgaaatgcacccagataaagccctgctggccgtgagctcacaaactgaaactaaagaacacatgagaaaactaacaccatgattgagaaccagcctcccaggacttcagatgatacagttgtcagatacagactgcaaaataactatgcaagaatgtttaaagatattttaaaaatatgataaaggaacaagatgttaacaaaaaggactagaaaggtttgaaaattcatcaaaacataacaacctttttatttgctttttatctcatttccccaatcacaggaagaagctcccttcccccatttctgaggtcaagctcagactacgtacttgattgcttgcctcgtaagacttccaaggtacttgaccatagaaacactgtggcttcttctaagactggcacatactgggtcatgtcttttcccatggcttactagagaggtttgagacatataatgaaacgtcaaaatactaccagttccgtagcctgaacacccacagaagaacctacatttgggagtttctctagagtcagcagccatgtggcagagatgtgccccacagcactgaccgtgtaataagatggaaagtaggcaaattggtgactcaagaaagaggtgccaagagtcctgcatatcaaggacagttgctcacaactgttgtgaaattccttttctggcatttctgagatgcagcaaaactggctgtactgtccccagcctttggttctgatcccccccttcccctagcctataaaataaataaaaatgtttatttttattaatagctttattgtggtataatatccataccataaaattcacctgttttaagtgtgcaattcagttgtacacttaatattgcattcgcttcctagagtgcctgtaacaaattactagaatctatgtggcttataataacagaaatttcttctctcacagttctggaggctggaattccaaaatcaagtcgacaacagagccatgctccctctaagagctctagaggaagacccttccttgcctcttccagcttctggtggccccaggcattccttggcttgtggcggcaaaacttcagcttctgccttatcttcacataatttacattcttctttgaatgtttctgtgtcttttcacatggacttcttatgaggataccagtcactggatttaggacctaccctaatgcagtatgatctcttcttaacgaattatatttgcaaagactctatttccatataaggtcatattccaaggttctaaggggacattaatttttggggatactattcaacccattacaaatatatttatattatccagtacatatacatatataccattataacctgtatacaaatatacacagttgtataatcatcactgaatcaaatcttaaagcatttacattaccccaaaagatttctcctgcccatttgcagtcatttctcttttccccctcaagttctaagcaatcactaatctaccttctctccctgatatggtttggctgtgtccccacccaactctcatcttgaattgtagtttccataaatacaattcgtctcccatagtgtcatgggagaggcctggtgggagataattgaatcataggggtggttacctccatgctggtctcgtgatagtgagtgaggtctcacaagagctaatggttttatgaggggctttccgccctttactctgcacttccccttcctgccgccatgtgaagaagcatatgtttgcttcccctttcaccatgattgtaagtttcctgaggcttccctagtcgcataggactgtgactcagttaagcctccttcctttataaattacccagtctctggtatgtctttaaaagaacagactaacacaatacccgtattacctttttagatcattttttataaatggaatcatatagcatgtattctttagtatctagctttctggatttttttcactaagcataatgttgtcaaggttcatccatgtcatagcacagtactttgttcctttttattgctaaatgatattgcagcacacggatatactgcatttttttaaatccactcacccactgatgcacactggggttgtttctactttggggctattatgagtaattatactataaatattcctgtataagctgttgtgtgaacaaatgttttcatttttttccaggagagattcctagaagtggaactactgggttatatggcaatttcatgtttaacattttgagaaactgccacactgtttgaccaagtggcagcaccattttgcactcttgtggccggagattggagagagaagagggaataagaggaggtgttaagattcagcatttatggtgagggaacaagaacattccctttcaaccatttgagttcaacaatttaagttcaaccatttgaattcaacaggggaactcaaagagtagagattgggtgcacctataaaaaggtgagctggcatgttcctcgacagctggaggcttactggctgtagaaaccccaggctcaccatggatctgccatcacagaggaactgaaggtggtggcactttctgtttggcctcaatccactaatcaagattttttctcatacgggaaagaggctaactcaagataattagagatctcaaagccaacaaaagtaacctaaattacaaaactgtgaataaataaattacaggcctatgaacaagaaaatatttactcctcattctttctctcacgactggggaatgtgaatcagaaaccatgacacccacatataatttagctttgaaaggtgacccctgtccactaccatcaacccccacgccccaattcctgatgagtgtcctgattcctgcaacaccctcatccttagaataaaatatagaaactcttgttgcaaaactgaaaatcaatccatgtttaatgcctcccagtctcctgggcatctcaaggctatggtcaggatttcctattttgcagtgtttgtaaaaaggaaatgtataaaatggtaagacataaaaacagacagttttcctttgagaacttggtaagtcaccatcatcacctcccaaatccagggtagtttaacactcactgactatattccaatgagagcaagccaattctgaagtaagggtttctgtcctattctaggagctccaaggctggtgttgacccagaatgtaattccctagtactttaaaaccaccaactggaagaactgttctccaaaaactgcagcattgttttgaggacttgtttgttttcttctcttttccttttttaaaaaaataatcacaagttttatcgcatttgatgagagaagtaccttggccaaaccatagacctctggtttgtttatgacttgcccatcttaatctgcacacaatactcctcagttttatttagatttctactttgaaagagtgccctactaaaatgggtatttttgttctggttattaaattcagcacttagagagaaatgctctgactagcccatgttctcctatccagctcaagtattttcagccctttaaagtaatggtggaaaggaaaaaatgaatcattaccatggcttctttgcaatgctaatgtttgaaggcatgaccttttcacttgtcacagttatggatgcctagagatgacaacatgtctgtacagcagccctttttgcgaggatttctgaagcataacaaatggatggggtaatttaacagggattggtaccaaggagaggctgtgggcaaaccctgctagcagggccaagggagatccagacccaagaaggctttgtccaaaggttgtgtgctgcgtgcctctcttgcaaaattacccattgaggaaggtgctgttttacatcatatcaatttataaatttgcttcataaactataatattatctaacagcatccttaatgctcagtaaatctgtgttcttatgatataagggagcatccctctgacctacttttttgcagcataaagatgcagtggtgtagtggagctgctgtcattggccagggagatctgattgtgcacatctctgcccagcttggcagtgcagtcatgtctctttcccatttagcttgaaattggcaatggtggtagtatttataccactgaaattggcgagtgctagaaatcacggctttctccatcctctccccctcaatagctaattgttaaacatttaccagaataatacttaggagagtgtttcactatattaataattttaaagggtgttcccatcgtacaagagatactgagaagatagtaagattaagctaagagcaataattaactttatcaatgaaagtaaacccttatttattaattaaataattaaaatatgaacagtttgtcactgtacgttttgacaagtaattcagtgataaattgatgaatatcttaattttttaaccctaggatacagagagaatgaaaaattctatcaataaatcactgatattaaagactggttccaaactttactctcaagtcttttaatgactctatcaataatgcaaaattaatccttatacatttttatggtttttgttcctacctggttctgctgaaaagaaaacagattgaaaagaaaacaactgaaaagaaaacaggagaaagtaccaaacagcctggataatcccgaatgagacaagattcctgtcacaagcatctggctcaatactttcattttatagagaagaaagggtgtcaaatgcccaaatacaggagtccatcaggatctgactctgatcggtcctatttgaaaaccatcatcgtcatgatcaccccaaacataggagatggccaactgtcccagggtgtccaggacttccagtgttttaacacaggaagtctgtatcctgggaagtttctcagtccctccaggcattcagagcagatatggcagaggagggtgtggagccaagaacgaggcagcataaacctggcccaatgcccaagatgggaaactgaggcaggaattacagggttcccgggtgggaggtcaaaagaaggagatgctctgggacataaacacattttaaagctattttttcaagtcccttttaaaccagtcctcccaaatttttattatgaaaaaatttcaaacatacaggaagccaatcagccatgtatctactgcctggattccacagttcacactttaatgcacagtgttgaatcaaaatgtgttttctttgttatcaagatttactgaatacattttttttattattctattttaaaactaccttgggtaaacacatacatcagcgtgggtctcaaaggtcgagctgtaagatggcagccacctgcctggattctgcagctcagggtgcagacccactggcctcctggtgtcccaggtaaaggaactgccgcaccctggcctgcagaggtgatgtggggttaggtggtgcctggggtagagtggtgcccctcacatatgtcttaccaaaaggaaaggtgaggaaggggcctgggagcagagaatctgactccaacctcctgccgctgggactgggcaggacccttggccgtcctgggttttggctttctcacctgagtcatagaggagctgaatgggatcacgggctctcaacctggcctgtatctcggaatcacctagaagcctttaaaataggccagtgctcaggccccaccgcacgttggctcagagtccctgggggtgggggttatgcatggatttatttaagtttcccagacgatcctaaaatatacagcctggattgaaacaactcaatccgatgatccccaaggtcttttcccccactaattgccatttcccctccttctccttttttctttatttctttccctctatccttctgttcctccctcccaattttttcttcatttttcccttccttccttcttcactttcccctctctttcttctgtttcatcctccctctatttctgtctcctgcttttttctgttttctccttcacagtgccataataacaacaatagctaatttttatgagtgttgactgtgtgctaagaacttttccatatactgcataagtatttcagccatacgacatgatggaataaaaacactagccatggaaatgacccaagacacatgagtactattttaagttgattctaaattatgctataaatagaagtgagacacatagacaaaacatttccagcagattaattggatttgcatctatattaacaaaggtctatgcagatggtcaaatagaaaccagacaccaaacaccgcctttaaatgggcaaaaataaagattagaatataagagaattttggaattaatttctacttgacatcttctcccctttctccttaatttctttctttctttctttttttcttttttgagacggagtcttgctctgtggcccaggctggagtgcagtgtcgcaatcttggctcactgcaagctccgcctcccgggttcacaccattctcctgcctcagcctcccgagtagctgggactacaggcgcccacaaccacgcccagctaattttttgtatttttagtagagagagggtttcaccttgttagccaggatggtctcgatctcctgaccttgcgatccacccacctcggcctcccaaagtgctgggattacaggcgtgagccaccgcgcccagcctctccttaatttctaagtaaggaaacagagaactagggggtttaagactggaaatgactagacctattccccttgcctctctcctatccctaatgcaaagttctattttatttagtaagtttattaaaaaatcaatattaccataaaagtaatacagtaaaatgatcttcattaatccctaaagtgatgaatctttcccatcccctctcttcccttctctttcctccttccttcctccagggtctggaaagctaaatggtagtagcagcacagttagttaataacgcatctgtccttctgtcctttcacgtctcagatcattttcatatcatgagcttgcagcaacacatgtgtttctcagtggagaagggattcttaattccatttacctataattacctaggatggggaaactaagtaattagcctaaagtcatacaactagtaaatggaagatctagaaggagaatccaggtcttctgattccaagtgcaaagcctctttcccttatagtagcggaggaggccaagggtgcagagtgtctgaccacaggggtatctgacagcctgactgtcttcaagcctgaacacccttggaagcccctcagtctggggcctgagtccatttacaggagactcctcataaagtccttgaaatttccactttctcagctgcaaggcaagacccaaacatctcccgcaagcctattgcatatttgtagaattaagcagacgagactggctacacaatttgcaggacccagagcaaaatgaaaatatggaggcttttgttcaaaaagcaggaaaaaggtgccattaaagttctaaaatataaagctttttccttccttctgtggtctccctctctccctctgtcatgatggcctttattttttatttaatatcccacttcctctggcatggtgatactggctggtcaagtgctgaccctccctaactcccagtaacagccctgtgacttggcatgcacactcatgtgccccaccacatgcctggatccccaccatcatcatacccaggccagggtggggacgtgtagtcaggcctctctcagtcgaataggtgaccttcagtgacctggagacccaccctgcccggtcatcctctgtaaactctctggtactgccacctagaagcagggaggggtgccacacccagaaatgttacaggaggctgtctctgaccttctccacatacttacccagatccccatggactggatgaccatagccattgctgggcagttgcaggaaaggggagcctggggctccagggggcaggaaagtgaacagctgaaaacctattctggagaggcagtgggaggtgggatgacatgggagctgtggctccacataccctgttcatgctccattgtcacactggacttcacttgcaaaacacaatttcaaagacaaaattgttaagaattcaagatggcggctgcagataatctttggcttgtgggactggactggtcttgtaccgatgatgctgtccctgaatgtcaggacagtactccacttcctaggcagcctctactgcttccagtagaaagaaacagcccaggtaccttgagcaggaggggaataagaagagctgaggagagggcagtctcttggataagacttagatatgagtaaccacaatctggaatctgaagtagggagcccactctgcccatcatgaaggcaatgggtacagaggcaagccttaatgagggaagtgactaatccacttgcaatcaacatcttcccaagccactcaatacatcacgattatctttcattaaacctgtggtccctattccttacatcacctgggagccataaaaacacccacagtatgctgagaatgatgacttccagcttcatcccctggaaaggataagatctcattcttttttatggctgcatagtattccatcatgtatacatgccacattttctttatccagtctatcattaatgggcatttgggttgtttccaagtctttgctattgtaaatactgcagcaataaacataagtgtgcatgtgtctttattgtagaatgagttataatcctttgggtatataaccagtaatgggattgctgggtcaaatggtatttctggttttagatccttgaggaatcaccacactgttttccacaatggttgaactaatttacactcccacccacagtgtaaaagcattcctatttctccacagcctcgccagcatatgttgttcctgactttttaataatagccattctgactattctcacttataagtgggagttgatcaatgagaatacgtggacacagggaggggaacaacacgcaccggggcctgtcggtgggtggggcaaggggagggagagcattaggacaaatatctaatgcatgcagggcttaaaacctagatgacaggttgatgggtgcagcaaaccaccatggcacatatatacctatgtaacaaacctgcacattctgcacatgtattctggaacttaaagtaaaattaaaaaaacaaaaaacaaaaaacacccacagtagtatcttcccagtcacagcgaatacttgctgtcctcaggattcttttttttttttttttggtaaaatacacataacaaaaaattggtcattttggtcactttcagtggacaaagtacattcttagtctgtcttcaaatcagaacacccttggaagcccctcattctggggcctgagtccatttacaggagactccccataaagtccttgaaatttccattttctcagctgcaaggcacattgctgtacagccttcactacaattcatcccccaaactttttcttcttcccaacctgaaacttggcaactcttaaacaatccctattctctccttttcctggcccccaggccctggcagtcaccattctactttccgtctctatgaatttgacttctctggggacctcctataagaagaatcatacagtatttgtctttttgtatctggctcattttacttagcataatctcctcaaggttcagtcaagctgtagcctgtgtctgaatttccttcttttctaagcctgaattatatttcaagatatgtgtacacagcatttttttaatccagtcatctgtcaacggacacttgtgttgctttcaccttttggctattgtgaacactggtgtacaaaacattattttttagagtctgtagaactttgctagagaaaatggcttgagtctttttgcctgtttcttctcaagccattcaaaggccaagcagtattttccctgtttgtggtctctgcctctcagtttcatctccgtttcctcatctgtaagaacaatgagacctgccgcctcctaaggctgtaatgaggattaatgagattatgttagaggaaccctctgagggtgttggaagaatggccccacagaaacaccaagtgtgattatccctgctgcagaatcaaaaatttctcctgtccaaatacttattgttcataagatttcggcaagtgaggctgcctactgggcagctctaatccttataaagaaaatgatttttccagccaggaattaacaaattcttagcacatactaaaatatctcctcagctgggttattatgcttacataatgaagttacttagattataaccgttaatcaaattcatgtttccaagctggagtgggtcatatttgatgctaagcttgaacaagaatgacaacatctccacttcctggcagcttttccaggcccttatgacatgattgaatgtgtcaggggaaagacgaagaacatttagggttcatattacattcactctgaagttatttcaagtcacattattggaagaaagttgatttattttttaagacaagtatgaatattaaccaaaagatatcaaaaacagtattttcctctaactcgcatggaggcaggctggccatttctttctttttttttttccatctgtctggttctgtacataggtactatattttgcccaataagaaagcttcttatttatttatttattagacggagtttcactcttgttgaccaagctggagtgcagtggcatgatctcagctcgctgcaacctctgcctccctggttcaagcaattctcctgcctcagcttcccaagtagctgggattacaggcatgctccaccatgcctggctgattttgtatttttagtagagacggggtttctccatgttggtcaggttggtttcaaactcccaatctcaggtgatccgcctgcttcggcctcccaaattgctgggattataagcatgagccattgtactcagcagaaaacttcttaataattatgtagaaaaaggaaaatagtaaatagattttgatttcctgccatcaatgatagtaaaaaaataaagaaacaaggaagaaaatagatcatgtcatcctgaaaaattgggtaagtgctgtccaggatattaattgcagcaaaaatatattatgagccatgggttagccagtttttaaggtgacctgtggtaatctcatctcctggaattcaaactctccacattttatcactctgagaccagattataaaaggactgtagcttctaccttctacttgggtgccccagttctctctctttctgtctgatcacttgctccagggaagcctgccatgatatcaccaggatacccatgtggcctatggagaggaccatgagaaggacaagtcttgggccaatagcctgccaacaaccctgtgtgggagctggggggtggattccacccccgccacccttcactcttatattcagatgcatttcccagaaggcaagcagtttccatgtggcttggggacagacacagagttgtcatgtctgaagccatgttctaacttttgagcagctgctttatgtacagctgtttttcatggagaaacagagaagataaatcatcatccccattagcactcaatggggtggtgaattctaccatgtcttgtctccatcacccactgcacagcacactgcctgtggctcccagccgttcagtgtgctgtgtcttctggaagctgggctggttatctccttgaacaagtccttcggcctctctgtgcctcaatttctgtacctataattacagcaccccctcctagggttgctgtagagattacaagctaatagctctttagggtgtcccagggatctcctctacctgaagattcttgtccaaaatgggccaacgcccagtattttgatccttccttcaacgttataatctccaccatatttctgattcctaaagtttcaccttttccttgaaaccactctgaccatgtgatcttcatctgtgttaatattcattttccactgtgcctcttcattcaagcattagtggcatgattccattggcttgcatgtgatgcccatatggtttttttatttggttatctggattgtatcatttatttcattcctttttcatttgactatgctagtatcaaggacataaatgcccttttaaaaacatctggtgtaataatgaggatgataattatagctaatatgcattaagttctctgctgagaaatgtattagcttttaatacctacagcaatcctaggaaggaggttttgtaaatatgagtataaaaattgaggcacagagaggctaaatggcttgttcaagatcacacaggtagagaggagcggagccagaattttaaaccatgcagcccatctgtttcccacctgggtatggatgcatgaacaacttggtacatccttggctgcttttgaactgtatgtaaaataccatcaacctttctgcattcatttgtgtctggcttctttccttccaccttatgtttgcagatatctaccatacatgtatagtacctgttgtttctttccttttatacacagagttattatacagccctgaaccagcatcacctgggaacatgctagaaatgcacactctggggtcccacaacctgtctgaatcatcccccacctgggggctgctttacatctgttctttgtggcatccctcccctacccgtcacccagagccttgttttctagtaccctgcgtgcatattgcagaagcagctcaggctttggaatcagcagagctaactttgaggttttttggctctgccaattgataagctataaaattaggtgggtatttatgttctgaatcatctatcaaatgggtgcaagggtgatgcccacctcaatagagagaagcaacacaattaaatacatgcaaagacctttgtagattataaagtgcttataaggttagttttttttctagttaatatttgtgttcatgacttggttttctaattacattgtacattcctgtacggctaaagagcttttcatatatatgtataggcaaggattgtaagaaaaaaagtgttaagataatgggatcatacagatttaaaaattttaaatatttaatgtggtttttataaaggttgagcaataaataaaatatgtttaaaagtaaatttcacttatgtaggttttaaatgaaatattaatgaatttgataaataatataacggttgtgtccatcatatcacgtagaatattaacaacataggtaaaagataaaaggaaaacaggggtgttttaagtgctaacttttgttaacttgttttgaagagaatggggtgatggtctgcttactttccaagaatagggttcccagtggtgttttcaaagagattgctgctacagattaattgtagggcccatatttgtgtgcgtgtgtgcacacacatgtacccatgaatgtgcctgtgtgagcacgtgtgcaattctatgcatgtacattcattcttttgtgtgtgcctgtgtgcatgtgtttgcgtggatgtggatgtgtgtttatgttcatacctgcctgggtgtctgctggaagactagagggcaatggctcctaaagacttttaattatcttgaaacctttctcccaaattttgtgtgaaagccaagatgatgcatttttattatgtttattagaaaataaatatacaactatatatttcttacttatttaagaacgttctcataaaggaaaaccttaaagttctcagatggtctctataaccttggcctattttataggtttgtggaagggacaactgacttagagaggctatggagatacaaaataacaccaatggttttgcagatagaaaagcacctcttctgaaagaataaggaatacacccagcctgtggaagccagaaccagcgcctttactttcataattcaaagtgggggcgagattcttctcatgtaactgaactgtagtattaatgatacaaagagatggaggtcgtatcctagctttcgagtaaatgccaacacaagcaagtgtgtctgcacatgcacacacacagtcacatgtgcaactaaaaccagtgctttttcctgctttgtgttatgggcttatgagccctgcatccagcagtgaaatgggtaaacagatgcatggcacatttgcaggaatacattccatgtaactgttggcaggctgcaccccttctgtgtcttctgtttatgtcagttgatacatctttaagaagggggaaatggaaggagcaaggaattgttggcaaacagcactgttaatcaggaggtattttatgacccagcaactctcagggggtttttaaagttcagaggctcatgaagagacatgtgtaaaggtccctcccaggggagacgaacagacactaattgaggtattgacggctctaaatgaagcagaaacctgctagaagattcagctccaaggaagatgagtgctgccaagcagtgcatgctgggggccttagcaggtttcattcactgctccttcatgcaagtaagtgtactcttgggcctggtgcagtggctcatgcctgtaatcccagcactttgggaggccaaggcaggcagatcatctgaggtcaggagttcgagaccagaccggccaacatggcaaaaccccatctctactaaaaatacaaaaattaactgggcatggtgatggtagcctgtaatcccagctactcaggaggctgaggcaggagaatcgcttaaacccgggagatggaggttgcagtgagctgagattgcaccattgcactccagcttgggtgacagagcaagactctatctcaaaaaaaaaaaaaaaaaaaagtgttctcttgaacacagaaacttgtgcctctcacagcacaaggtcccaagctaaagagccacaaaaaatgatctgttgaagtattaaaaatatctccttgatcatgtccccaattctttgcctcggtgaatattatattgtatatttccccatatgcacatataaaacaggcatataagatatttaagcatgtttcaaaaacattcaaggatagtaaataatgtttaaaagcatcacctatagtttctcctgaagaaagattgttgcactgctctctccatcccatttagggaggatttatgcaataagtattggaggttttaccacatttggccttttatattcgacatggaactatctcacccacagaggctttttggcattggcagcagcacctgcttcctcttagagagcctgggatgcccaaagcagagggaactgtgaaatctgacacaacgtgtaacctgtgctctaactgtatctctctgaactccacccagttctaaggatagtaatgtcagtgcgtctaggtaaagagacctttgaacacccgtgtgagtctgtgtgtgcctgtgtgaatagcaaatgagctgtcaccagaataccttcatcccagtaggtgtgtccctaatgacaggaacaggatgtgaggatgaatccactggaaactgctggggaaaagcacctgaggccaggggtcaaggaggcagctctgggtagcagagcagaggctgtgagcatcctctggagggcatgttagcacacgggggtaggcccgacctgtggagctgactcagtgggtctaggggggactccagaggctgcacattctacatgttcctgaggtacaatggtacagctgggtaggtggtggaggagggcacacattgagacccagtgagaggaatgggtgcctccagcatcaaccatatttcctgggccatttccacatagctatttggatgtgttatatcaagtaagttaaaactctgcttttattttttaaaaatcccaataatgtggtagtaaacatttctaatccttgcttttcctgggatttgccaaaaaaaaaaaaaaatgttcaaaagaagcctgggcaacatagcaagaccccatctctacaaaaataaaataataaataactgagcatggtagcacatgactgtagtcccagctagctgggggactgaggtgggaggaccccttgggcccaacaggtcaaggctgcagtgaactctgttcatgccactgcattccagcctgggcagcagaacaagactttgtctcaaaacaaaacaaaaacaatttaaagaaaatttaggtgatttattttccatttcaagaaaagaaagacattgcatgcatgataccccaggatagaaaccacaaagatagtgcttagcagatttgacaatgcatcctgctaaagattctgtatggcaataaacatgcaaacaaataaatatggaaaacaaaatttttaaaaagtcaaaccgaaaaaaaattgtaactatagtaaaaaagtattattatgcaataacataaatttataaatactaaaaacaatcccagaaaaagtgaaaaaggatagagaattcattaaacaaatggaaatttcaatattaaaataccaagatattcaaattctttctataatttctttaatttctgtgaaattttcttgccattgcagagcagatgactgaaagtgtccagtttggtaggaggtggggactggggtgctggcactctagtcttgcaatggaaatgtctgatggtacagtcttctgggaagccagtttggccaggtgtaaaaatatgttgtgtgagcagatcttttgaccctgtaattccttttcttgtattttatcctaggaaattaattagataaatgtgcatagtttatgtataaggatggctcattgcaatcttattgattataggagcctttaggcacaacataaatgttcacagttacttaaaaagtaattacacatctataagtggcatattattcagcccctaaaacacaaaaactataatgtaaagtctcagaaagatagatctgtgttcatttgctaggtctgccataataaattatcatggattggcctcaataataggactttattatctcacagtcctggaggctcgaggtccaagaccaagttgttgacagggttgattcctcctgaggcctctctccgtggcttgcagataaccatcttcacctggggtcctcacacggtcactcctccatgtgtgtggctacacgctaacctcttcttagaaggacaccagtcagattagatgagaactacccttaggacctaattttaccttaatcacctctttaagcctctatcttcaaatacagtcacagcaggagttgcggcttcaacatgcgaattttagggggagacacaagttagttcctaataatacctataatacattatcaatggaataaaaatggaatccatggagtaatagatttagtgtatgttcccatcaacaaatattcctggttcaaatttgagcagcactggccaggcatggtggctcttatctgtaatcccagcactttgggaggctgaggtgggtggatcacctgaggtcaagagtttgagactagcctggccaacatggtgaaacctgatctctactaaaaatgcaaaaaattagctgggtgtggtggtgggtgcctgtaatcccagctacctgggaggctgaggcatgagaatagctcgagcctgggaagcagacactgcagtgagctgagattgcgccattgcactccagcctgggcaacacatttctgggctaaaccgggccacaattccattgtcacagaaagtggcagcgaatctcaaagggttttcggttgagcatggagaatggctcactgagctgttgctttcattgttttccccaaggatcttggagtgctgcatgctctcatattctcacatggtcaggagttcttactcaccaggaaacagctggggaaagaagtaacatgtcctctctaacttacatgtgaaggaacattttgagtatgacgagaacatgcagaaagatctcctgacataactgttatccgtagggggttccatttagccctacacaaaatccccttgggttgcgaaacagaaatatggagaggcagctgcggctttcactgccctactcctccctcctcttaacctttcatttaaaaatctaaaacaggccaatctgatcctctaggaagattaagaaatttttgctggcaataggaagcatgcaactaaggaaaaagccctcaaaacaaacagcccctcaaagatgaggtctgagctattgtgatttcttttcagaagctctaagagcaagacagctgacagctaaatgagcgggcactattttgagaactcgcattcaggattaattgtaggggtgaggttctgtgggctcagagaggctgcctgtagccacgaggacaatgagtgattctcccctcatcgtcttccacttgggactctcagagctggttgccatggttgatgaagtgaagtgcacatgcttccgccttgatgacagtgagtgacaggaggttgttaaggaagcagtgggggaggatgagtgagaaggttatgcagggtgtgtggccaaccctggacctgtccagtataatgccaggctttgagcaaaatgccaagaagaagactggatgaagtgagaaactactcatttcatagacgttgcatggcgatgcctgcacacacaagactcctacatttctgttcttcctcttctgctctcttttccactcttacccttgctgatctgacctgcttgggctgtctcgattatttcttataaagccctgaccactctctcctgagctgctgtctcccatctctggaggtcagccaggtacttccatttggaaggcacaccatccccttacaatcaacatgagacagatgaaatgtggcacctttccttccaagctttctccctgtccctattcctgtcccaggctcctccttggatggattccaggtccccaaggcaatcagtggcctggtccttcttggtcaaggttcatagcatcatttaaattagacttgtcccctctaggcccgtgaccatcagcttactgcaagccataatcaggatgcctgtgctgggctgtgaaatggcattataactcatcgctcattcatcttccttttccactccagtctatcctagggctctgccagactcagcttcctcacatgcaacttccagtatgatatcctctcacttgcaatttacaatgtcttcctgctatttacagattaagctcagttttcacagcttaaaagttaagacgttttataatcttgctgcaacctatgtttccagttacccactaactccttctttacccagacattccaccccagcactcaaacataccttgtatgtttctccacctcccccattccctattttgaggtctgagaacatggttttccttttccaggtatgactggctggcactgttttgccattctgaaaattacctccagttcttcaagttggatttcattccaccttccaggttaaactcacgtcctacctcctctatggagccctccctgacctcacccctacaaggggctctcccttctccaaactcccacaactttttaatgtatatattcacatttattgcacatatatatcttttggcatttacttttacaaagctaaagttttgcaatacagactcctaggaagttgcaaaaatagtagagtcctgtgtgtcctttagcttctggccatgttgtgaatttccatagctgtggtgcaatatcagagccaggaaacccacatgggaacattcccagttaacattatccagtagactagatgccttcatcttttattcatttatttgttctttaagatggattctcgctctgtcacccaggctagagtgcagtggcacgatcttggctcactgcaacctctgcctcccaagttcaaatgattctcctgcctcagcctccccagtagctgggattacaggcatgtgccaccatgcttggctaatttttgtatttttagtggagatagggttccaccatgttggccaggctggtctcgaactcctgacctcaggtggtccatcctcctcagcctctcaaagtgctgggtttacaggcatgagccactgcacctggccaccttcattatttttaacccacattcatttgtgtgtatgtgctcgtgtagctctgtaggtgtatacttccgtttaactttatcccattacaggtccatgtacccaccaccaccatcaaatgaggaactattccacaccacagaagaattccttattcctatctgtctgtgtttgcacctggccccatcctacccattgtacctgtctactagtatccactaaggtattctccacctctgctgttttatcgttttgagaatgctttataaagataactttttgaagttggctttttttcactaagcgtaatgcccttcagactcatctaggttattgtgtgtgtcaacagttcatttcttttgattgctgaatagcagcattccaaactatggatggaccatagatttttcaaccattcacctgtgagaaacattcattttgttgttgttgttgttgctgtttgtccagaatttagctactataaagaaagctgctatggatatttttatataactttttgtgaacataaattcatatttctttgggataaatgcttaagagaacaattgctggaccacatggtaagtgcatgtttagttttatgagaaactgccaaagagttttccagaatgtctgcaccatattacatacccaccagcaatgcatgagagatccagtttctccacatctttgccagcatgtggcgttataatttttaaaaaatttttgttgttctcataaatgtgtagccaggcatgcatttttgatgtgtagacctatccacctatccatcagggcatgagtcaaacatttccaaaggcagtgacttgtccttggtacagcccatgatgcatcagacatgtagattctcaccaaaatacctatggaccaactgccttctatctagaagtgttatcacactttccactgcatactctgctaataggcacttttatccacacctcattattctcctccatcattgccctctggattgtaaactgcttgaggttaaagatgatgtcttaattgtgtagaccctaattgttggcaaatagtagctgctacacaaatttgtgtgtgtgtgggttttgttgtgggagactgaaattctgaagcttttttttttttggtgtggggggtgggagggagtcttgctctgttgcccaggctggagttcagtggcccaatctctgctctctgcagcttccgcctcccaggttcaagcatttctcctgcctcagcctcccaagtagctgggattataggcgtgcaccaccacgcctggctaatttttttatttttagtagagacagggtttctctgtgttggccaggctgatctcgaattcctgacctcatgatctgcctgcctcggcctcccaaagtgctgggattataggcgtgagccactgtgcccagtcaattctgcaactttttttattgcaaagaaggaagggtgctcaaggcatagagaacaacacagaggcctcaccttgagaggcatagccatggggtttagattgaacatgaatttagttttgatacttaagaattctaacttcatgttcaatctaaacaccatggcagccctggtctcagccttacctctgcagtctagttgtcgcttggacagtacatcctttcccagtaacgagatgacacacccctgtgcatatttcaggctgctttctatcttgtttttcaccattctcacaccaagaacaccaaggtttgtgaggcctctgttgtatattgtgacaaagagcaatttatatggttggcaataaagcaggttttttaggggttgatatttttcagtttaattttcatccctttagtgggttgaattgtggtccttcaaaaatatatcaacatcccaacccctggaatctcagaatatgaccttacttggaaatacagtctttgcagagttaaagaaagtaagaacctctagataaggtcatccttcattagggtgggtcctaaatccactgaagaatgtcatataagagacagaaaaggagaaggcacagagacacaaaaaagaagccatgtgaaggtggaggcagagactggagtgaggcagccacaggctcagcagtgtgaagggttgaggaagcctctggaggctgggagaggtgaggaactgatgtgccctcagagcctccagaaggcaccagccctgctgacttcttgatttcagatgtctgtgagagaagaaacgtctgttgttttaagccactccatcgtggtcattttgcatggcagacctaagaaacggatgccatcttcaagatcatttgaacagtatagaaaaatgtatttcacaaaacttttacttattatttcacatttttaaacttcatattccacgttttgctttattttgggtatcaaggcttctagggcatattttaatcaccccagaagcatggacataataagacctggttaaagagtgcactgtgagtgagccatggggtgaaggatcctgctgctgcctcacagcctcctgcctccctgtgcacacataggtttactgtcaggactgtaatgaggtttgcatgaataaacagctttagaaacagctttcaagtttccaccaaaatacctgttaggaagtcttgtttccaccataattgctaattgcttacctacatgtgacctgggtatccataatgcagacatgagcaacacatgattgtagaaaattctaatttaaattattacatttttatttgggttccacgcagaaaacatcttaggcagccactgcagattatttctagaagcgaagggaaacctggcttggagatggagtgggtgagaagctagaagggaatctgttaaggatgccagggatggaggggttccttctccatgaaaataagtggagtcaaggaggaatccttgaggcagcctctccaagacatgcaggatcatgggttttgactaggggaattttacgatattctagtgcagggatataaggaggcaatgtccagggaacagggctcttcccccaaagacagaacccctgggtccctcatcctttccgcatcttctgctgtgtttggtatccaaggcccttggcccagccatttggagtccactcaaatccacacctacatggtgaggaataaagggagacaaactcattggagtcattgcccccatagagcttcctttcctagacagacggaaacccagcaaacacacgaagcgagacatcaggcaatgagtgatacctgggtgtagagaacaaggcatcccttctattcttgctcctaaggatttcaggtagtttgttgcccagcccacttaggctataaatgctgctttctctccaactagtcatagctatcagccagcctggccactttggaaataagaatatttaatgcactcatggacgtgggagcctgtgttctaagacattcttactcagtcatagttagctgagactctaaagagtggcatatgtaatcaagataaaatatgaagtgtgcatctggtatattttggagcctataaagaaagattctgtgctgataatatttacattgggtttttcttgttgttttgtttttccaagatgatggaatataggcattgttagcattccttttccacttggaaagataaaatagtgtgtagagattcacactgtgaacttttttccaagaaggaacacaggaccgtaaacagctttgaaagaagctgtgagtagcagcctacaccgctgtctttgggaaacaccactgaacatgtaaggattcttatagactacaggtaaagggtggaaaaagagatttccagcaaatggaagccaaaaacaaggagtagcgattctgatatcaaataaaacggacttcaaagcaacaacagcaaaaaaaaaaaaaaaaacaaaacaaaaaacaacaagaaaaagacaaaggtcactatataatgataaaatgaccaattaaacaagaagatgtaacaattgtaaatatatatgcatcaaactccagagttcctaagttcttgaagcaatcagtatatcaaaaagacacctgtacacatgtttatcacagcacaattcacaactgtaaagatatggaatcctcacgcctgtaatcccagcactttgggaggccgaggcgggtggatcacgaggtcaggagatcgagaccatcctggctaacaaggtgaaaccccgtctctactaaaagtacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaagatatggaatcaacctgagtcctcatcaatccatgaatggataaagaaaatgtggttcatacacaacttacccatgtaaaaaacctgtacgtgtaccctctgagcctaaaataacagttggaaaggaaaaaaatcataaaagcaagactcaactaaaaaaaaacaaaaagaaaaaattgtgatatatataccatgaaatgcaacccagccataaaaaaaaatataatgacttttatagcaacttggatgaaactgggggccgttattctaagtgaagtaactcaggaattaaaaaccaggtactcatgctctcacttataagtgggagctaagctataggtatgccaaggcattcagagtggtgtaatggacattggagactcagaagtggggagggaggtgaggaatgaaaaactagcagttgggtaaatgtatactatttgggtgatgcgtgcactaaaatcctagacttcaccactacacgattcatccacgtaaccaaaaaccacttgtaccattaaaactaatgaaagaaaaaaattaactaattaatttaaaaaccacactggggagtccctgcatgctaagtaggtagaacaaatcaatcataaatgactgccattttgtctacattctgtataaaaaaggtgaaactgctccttttcttctcctttaaaaaaaaaaaaaaacaactttggtatttgtgctcaagactactatgggaaggacccagttataaacatgcatttcacgccaatatttcttcttcagaataagtgctaagcaagtcaagacatgcaatgatttcttttggcctcctataaaacaaatgagccctttttgttttgtatttgttttagagacaggatctctctgtcacccaggctggtgtgcaagatcatagctcactgcaacctcaaactcctgggctcaagtgatcctcccacctcagccgtctgcccaagtagctaagactacagtcatgtgtcagcatgcctgcctaatttaaaaaaaaaatttttttttttttagaaacagagtttcaatatgttgcccaggctggtctttaacttatggcctcaagtgatccttccacctcggcctcccaaagctctgggatttcaggcatgaacaactacacccagccaatgatccatttttttatgaaatttatattaaactggttgctttataaaaaaagcttttaaaaacctctagaggcaaagtccgtctattttagaatcttgatagaaatcataggcttatctacatggatatctataatcaacacctattaatgcatcatcagttacaaaaccaaagtgagaactgtgagtataggaaaatgtcaatactgtttaaactagatttatgcaaccacaaggaatatcacttaaattgttcatcatagagcagattttgcacctggcagatgagactgttgtcacagcagcacaggtaacacccagcagtaaggccaggaggcccctcccgcagccaaccagtgcccccatgagaaggcagccactgccctacctcccccctggagctgctgccctgttagaatgtgatggaacagacaggacaccttggcagggctaagtgaccaatgtcttttcttggccgagaatctcatgtcatttgcattatttttcaaagtcggtcaccctaagtagaaaacaaagatggctgtgtctgaaaaactgaacacaactaatgattccattcccaggccagaaaagggaccagtggacagatttctctcctcaaactctaaaacacaacctggctttctaaaagagaatatctgttatccctttctcaaaaatgccatgacaaagattttcatcatttcaagattattttatatttgaagtctcagaagactatgtatatatcttattattgtattacatttcttgattatatttttctgattgcaaatgaatagaagcttaatgcagaaggtttgaaaaatgcagaaaagtataaaaaagcatagaaagatatcattcataattgtaatactgagagaagcaaccattttaacaagcacattttcttctatctaaaaagatatgatttctgagccttgtcaacataatactacatatatgtatacatatacttttcaaacgtcctgctttttttaacttttattttaggtttggggtacatgtgaaggtttagttacataggtaaacttgtgttatgggggtttgttgtatagattatttcactgctcaggtattaagcccagtacccaatagttgtcttttctgctcctctccctcctctgactctccccactcaagtcttccacaatgactgaactaatttacacttccaccaatagtgtataagcattcctttttctccacaacctctccagcatgtgttatttttatactttttaataataaaattattaaagtcattctgactggtgtgagatgatatctcattgtggttttgatttgcatttctctaatgatcagtgatatcgagatttttttatatgcttgttggccacatatatgtcttcttttgagaagtgtctgttcacgtcctttgcccactttttaatggggtggtttgtttttttcttgtaaatttgcttaagttcctgattattagacctttaccagatgcatagttttcaaatattttctcccattctgtaggttgtttactctgttgatcatttcttttgctatgcagaagctctgaagtttaattagcttccacttgtcaaattttgcttgtgttgcaattgcttttggtatctttttcatgaaatctttgccattcctgtgtccaggatggtattgcctaggttgtcttccagggtttttatggttttgggttttacgtctttaatctttcttgagttgatttttgtacatgttgtaagaaaggggtccagcttcaatcttctgcatatggtcagccagttatcctagcaccatttcttgaatagggagtcttttccccactgcttgtttttgtcagctttatcaatgctaagatgattgtagatgtgtgaccttatttctgggctctctattgtgttccattggacgatgagcctgtttttgtaccattaccatggtattttggttgctgtaaccctgtagtagagtttgaagttgggtaacgcgatgcttccagctttgttctttttgcttaagattgctttggctttcaggccctttttttggttccatatgaatttcaaaaatttttttctagttctgtgaagaatgtcatttgtagtttgatagctatagcactgaatctgtgaattgattttggcagtaccattttaatgatattgattcttcctatacatgagcttgggattttttttttcacttgtttgtgtcttccctgatttctttcagtagtgttctgtaattcttgttgtagagatctttcacctccctggttagctggtatttttagaaatgttattctttttgtggctgtgaatgggattgcctttctaatttggctcttagtttggctgttgttggtatataggaattagtgatttttgtacattgattttgtatcctgaaactttgctgaagttgtttatcagctgaagaatcttttgggctgagactatgaagttctctacatatagaatcatgtcatctggtttgacttcctctcttcctatttggatgccctttatttccttctctttcctgattgctctagctaggactttcaatagtatgttgaacaggagcagtgagagagggcatcctcgtcttgtgccggtttttaaggtgaatgcttccagcttttgcccattccatatgatattggctgtgggtttgtcatatatagctcttattattttaaggtatgttccttcaatacctagtttattgagagttttgaaatggaatgagtgttgaattttatcaaaagcctttcctgcatctattgagataatcctgtggcttttgtctttagttatgtttatgtgataaatcacatttattgattgtgtatgttgaatcaaccttgcatcctggagataaagcctacttgatcatggtggtcaaatcctgctttttaaaaatgcagctatattatacgactgcctcctatattaagaaaacttatttaaacccataatttaaaattaccacataatattgaattaggctgatgcaccaccattcacagaagcagtcacttcattaagctatttagagagaaacaattttttattattttaaagttctgtcttgactctttctacataaatatttgtctataacttttatttctttggtatagataattaagggtgaaattaatgagtcaaaagacattaactgtctttggcttttgatatattttgtcaaattgctttaaaaaattttcctgccaaatgatatatcagaatgtaaatatttgtgcatctctgccaatattccatattatcatttattttgtttctctatatgtttattaataaaaccaataaccaacaagtgaagttaaatgaatttttttgagtagcattctacttcataaatgtttgtaaattaatacaaatgccaacaggtagaaatcttacatatgtttacttttgttatatatacaccaaatagcatttttgaatatgtttggtgcagttcagacataaatattctatacttccataaaagatactaaatagctgtggacaaaaagaaaacgggaatcaaggctatctaaggagttaatggcttaactttttctaacaaacagctgtaaactgttttcaacgttttgccaggttagatttgatctttggttttaactgtgttatgggagccttagcaatataaaactgcctttcaacatgacatcctgtctctctcacatccactgtggcctggggtcctggaagcaggctttgggaagatgtgagcaccttgtgtacacttgagggagagtcattgtctgtgtgtggccagctacctctttctccatgaaccaacctcgagtggctatttccaaacgtagccaagtcaagcattagaagagtttcatttaaagtgaatatacatgtctgacttaataaataaaatgtagaaggaaaatacagaatggactgtacaacaaaatattcactgaattcactattttgtctcctctgaaaacattctgtatttgtaagaataaccttagcctgggttttgaggttaagacatttggtattcaagagataaattagcttatcccactttttaattaaaatggttttcctccatggtacataaatagactataaagaaatttgatgttatgcaaactctgctatgataaactctaacactgtataatctttaataaaaagtctccacaattttggtgccacacagtgatgaggatgtattagaatagctatatgagactccccatgagagttcacagcttaactgtgactgaagaaacagatgcaggacacaatttatttccttgtattccaaggtggatagaggtattgtgcatgtgtgaaaagcggtaggaaatgcagcaggctcaccctagcacccaaccaaaaggtggtcatttatccttctgcgctcatcactgtgctcactgggccacgaggctgcacaagcttacttttacaacgtgttgtctgaggtcactccatcaatggaggttttaatttcattaatctctgaaccatcctaggaggtagctttgtattatctccatttcacagatgcagaaactgaggctcagaggtgctcagaaacctgctacaattcacatggctagtgagaagcaaagtaaggatttaaattcatttttgcctgactatagtacctctgtttattattatgcaagagttgtggagtgtcaaacaggatgaaaaagagttgagagcctcaaagagttgagtagagtgaaaccatgaataatagacggatctctcccagaactacactacctgtcccacccatgccaccaccacactacccagcctgcagagggcattacaatcagacacctgattggattactcagatccaagatctagataacctgaaaaattatttcatatgtatatttatatgtataataatgtgtacgtgtataatacatatatgtataatatataaatatataatatacatacgtaataggattattatataaataacataaaatatatatgatatgcataatataaaataatacatattatatataatatacatataaatagtaatcataagattgttttgtatcaactgatctcaggtacagtccaacaacacctgggatccctgatactttttcaaaggatctgtgagatcagagctattttcagaataacactaaaaaattatttgcctttttagccaacagtacaaaagcaacagtgggcaaatctgctggggccttaataggattcaaggcagtggcaccaaactcttctcacggccgttgtggtcttcacaattgtccgtcaacactcgcaacaaaaacaaacgtggcagcttcacttcagcatgtccttgactaagcagtggaaatcatttcatttcattccatctcaaccattgagggtgtgcgtttttaacattctgtgtgacagaatggcagaaacatacaaagcacctgtgtgttgggtgctcaagaaaagctccagtgtgggactgaatatgagctgatcagctgtgattttcatggaacacatttctacttgaaagaaaaactgataaactatttttgtctgggtatttgacaaacattttctcaaaaggaatgaagtgagcctgtcacttcaagggaaacaactgagagtgtttgttgccagtggtaaaatttgagcttttaagtcttaattcgattttagaaaacttggattcttcaccacatgcttaacacaccttcccaatatttaaagatattttggatgacattagtagtgatattataaatgtgattttcaaaagtattgtataatggagtgcatcaacatttggaacgtctacattactaagtgaataaatactttccaaaaaccaatgcatggtgttataaaatcatgcatgtgtaaaagatccagaaacactgatatattttaatgcaatagggtaggaaaaggctgttgatatggtttttggttctgcatgggaattaatctttaaaaaccaccgcttgccaaattttggtagagtatcaaagagcaatagccatgatgatctgaaaatgctattaagcttccctgtccaactacacctctgtgcgaattgtattttcttcatatgcttcaacgaacataacacatcacagtagattgaatgcagaagcagctacaagccagacttcagagattttcaaaaaatgtaaaataattcatcctcttctcaccaatttctaaaaatagtttattaagaagtatatttatgataatatgtcatagttgtcatttaaaaaaatatctcagtgtaatctctagtacagcaaatattgatagatccaacccacagaaacaaaagccctttggaatcttcaagaatttttaagattataaagtggtcctaggatcaaaaatcttgagaagtgtccttctatataattgagacaattttaaagtttgaaatctatactgatctgtattaaagatctaaagtctaatggaagtttcttagaatgagggccaaatctgcaaatataataaactttaatccctggaaatgttctttgctcaatattcttttacccatgaccacgctcccctccagcatccctaccaacctttgttcccttctcaggtgtgtccggtgtggcctctctttcccctcctgacaccaggagacctgcccagcagcctgccctcagtccctgctcccgatgtgggagccaagaggaaggtgcaggattggagttgcctcctgagactcaccctcagagcagctttgaggaggtccccaggctgcagggccctgaaccccaggtaacacctgaacatggtccttagtcctgcaacccagagaccagcccatcacttgagcctgagagcccccattcaagtcatttctgagccacgttgaacttgccatcatcaccgctttcattccagctgctactatcctaagggaaatgccattttcagctcttaaacacattcttttcttgcagcatgacatatgggcttcctaaacacaggtaaaaaaagctccaataggaagacagcttttctcagaaccagaagagtatttttaaacatctttaacgaaaatctaagttaccttttttttctacagtcatatcatatatacacattataattagaaacacacatgctcagacacatccatgtatctatctaaatagatttttttgtcttttaagtcatcaatagcggttgttaacatgatctaataaaatgcctaggctatatttcaatgtgaaattgttaaaagttacaacattaataaaaagttgctctcattcacttatgaaggttagaatggtttctgagtatgagaatgacaacacttatgtgaacacatttaatggcctctctaaaacagagagggtgctcaaaaatgccctctcatatttcccacctgcccagataggcccatgtgatggttgcctccatcaggaaggatggagagcttctggaaacccctaccccaccccacatgctgtgggtccctggggaatgcacttgcatttcctagatttcagagaagtgaagaatgaatgaaatcaggatgaagcaaaatgaatttctcaaaataacccacagtgtcataacaatgtatgtactagggaattgagaaaaccttcggctaggtataaaaatggggattttttaactgaaaaagaatttttgaactctttaaatatcctatgattcagtctatttttctcccccaagaaatcaaagcagtataatctttcattaactggttgattatcactcatgcatcattgaacaccaacactatttcaaacaagatctggttaaattgcaaatgagaataaatctggtgataaatggatatcatatttaatatttaaatgtctctggtatttacacatctctggtagttttgttcttagtcaattgtttaagtgaatgttgagaagaaatgaaagaaagatgtttgctcctctttgaaaacaattacggtttccttgcaggaatatgcttatctttcacatttcatcagaaacataagaagtctggctagaggcaatgacactgatgggaagagctctatgatggggaaagactgcttgggaaatgcagccttctactatatacactaaaattatcaataacgttgcaaaaagagaattcaattccataaactaatattgatgcacaaatgagcaaaaatcaacaattggcaataaatgacatcttaaatctgcatttgaagattttacaatagtcaaaaataaacataaaaatttgctttcatattttctaaaatgagtatcagagacactgcatcctctcaaatgacagctattgggacaaccatctctaaggctacatcttacgtttcatatttatatgccagtgaatattcaagttaaaaaggacacttcaaaaaagataacaagtccatgttttgtcctaaattgaattgtcggtcacctgaacattcaatcccacatgtagttggctctatggactcttgataaaaatgtaagttggtttgaattagaaactaccttttcaaggaggtactgtgcatgctacaaggtgaagcacatgacactcacacgaggtacacacaccatacactcaggttgtgtactggtaaacactgaaacatccctgttcacaggagattggccaggccaactgcatgaaagacactgcccattctcagactcagatcctcctgccaacaaggtaagcctgtgaatgatagatgagtgtacacatatgcgtacttgtatttcccttctctttactgcctgccttcatttctgtttacaagacctgccccaaccacttgaccttgaccatcatttcacggctgcaccttgccctttggaccaagcccatgacatctgccttgtgtttagaagctcattgccatcccagcctcttcccccagcgatctcaggcacagcctctcaaaaccccttacccacattcattcccactcaaatactctacaatttgtaattttcccaccttcaacctttaagccttctctatcttcaaaacggctaaaatcctgccagatatgaaagaagccatgacatcttctcctccacccttctttgtgtgtggactcaacagtgccctcctggatccctcatccaggaggttgagggattaagaggccccgccatccatcctgagatagtgcagaccttgttgataaacgtctctatattcccggaggccagttgcttccctatccctacctattaccgctggggtccacacgatctttgttgggaccatggagagaacacaaaggtaacaatacttttccccaggcctcagagcctcgatttgtgtgaactaaggggagaagaaagtagagggcagagaaagtccccctgtcctccaacaccttcttggaatcagacacaagtgtgttggtgatgctccaccattgaccaagatcccagaaccatcactacattgatatattttcacactgaaaggcaatgattccaacatgaaaatatctattcccttatgggtttgataaagactttctacatataaatagcacttatttacgaactgctttacatgcattaactcttgcacgtccacttatctatccaatgagatgtgttctcttatgatccctgttgtacaattggagaaactaaggctggaagagatggagttagtacatcgcagagctgggatacaaagccagacagtctggccctcagaacctgtgctcttgactttctccccaaatggtagtgaactctgcaataaggaacatagataagatgcacagaaagtttggtgacaatgtgcggacacaaatgtggaacacatagttttatttattacttggtagacaattctttgtaattcagtgggttctcggattttcttggattgaaacagaaatttctcccttgaacactgagttgataatagctcagttcacttccttgcatttctttaggggtgctattttaatgtcgggagagatatcaagcagcagaagagattctatattaaaatgatattttctatttggctacgaaatgaaagaaatatagatacggacaagagctaagtgaggaggcctggtggcaacaaaatgtcccaaacccatgcagccctccacaaagacctcattgtgtcaggctgtaacaaatgaacccaaagtcattctctaatgtttagagacctctttcaagaacagcaatatagatctttaaccaatccaaaagttaatttgccatttatgttgtttatacttcagcaattatttaacattttttaaaatttttattttaagttcaggggtacaagtgcacatttattatgcaggtaaacttgtgtcacgggggtttgttgtacaaattatttcattatccaggtattaagcctagtacccgttagttacttttcctgattctctccctcctcccaccatccaccctccaaaaggctccagtgtgtcttgttactctctctgtgtccatgcgttctcctcatatagttcccacttgtaagtgagaacatgtagtatttgttttctgtccctccgttagtttgctaaggataatggtctccagctccatccatgtccctgcaaaggacatgatctcattctgctttatagctgcatagtatttcatgatatatgtaccacattttctttagtagtttcttaggctctaggaggaaaaaaaaatcatttaaggatcaaagactgatgctgggataaaatgtgtcatggttgactctggcccattctgaagccacattcctgagaattcagcactaaagcatttggaaggcttcgagcttttccagaagacaggtgcatcctgtgagaatcacagcacaatgactcagcctcccagctgccaccttcctgaagatagaacagggcaggcatcttatggcatgttaaccaactctttggaaaagggtcatttttgtggcctgtcacaagactgaggctgataggaaatgctactttaccaatagtagacaacatttggggtaaattgttttctaaaggcctagcagctgtctcaagttcttcccatgatatttctcagaatttgaaatgtgatgactctgtcttaagatcatacaggtattttgaggtctgtagctacagagtaccacccctttcccccactgctacccttactggtacacctgggaggatacctgctcttctatttggtttttcaaagtaataagcaacattttagaatacatttagatttatagaaaagttgagataataacacaggaagtccccatatacttcacatctccacatccagttcctccattatttacaccttacattagtgtggcacgtttgttacaattattgaatgactattaatgcattgttaactaagtgcatacattgttcagatgaccctacctgctacctaatgtccctggtttgtttcaagatcccatccaggatcccattctacattctgccatcatgtcttcttaagctcctctgtagcagtttctcagactttctgtgttcttgatgactgtcagtcttgaggaatgctggtcaggaattatgtagaatacctctcagttggggcttgtctgttgtttttctcatttttaggctgaggttatgagagttttgaaggggcaaactacggaggtaaagtaccattctcatcacatcatatcaagggtaaatgctatcaacagggcttatcagtgtcgctgttgaccttggccacctggctaaggtggtgcctgccaggtttctccactggaaagcttctctttccatgtcgtcctttctggaaggaagtcgctctgcaaagcccacacataaggagtgagagttatgcttcatcttcttgaggtggtatatctacataaattacttggaattctttcgtcaggaaaatttggctattgttaccatttattcaatcatttatatcagtgtgggcttattttacacttatcacttattttacactgatacacttatcagggtgtatttattttaaactttgggttataatccaataccgccttatttgttctgttgctcaaatgattccagatttaaccactgggaactccttcaggtggctcccacatcctattgatgtatcaccatcattgcttgtttattttatcctttctttccccctccacctcttttcttttttttttttttcttggtacttctttattttctaactctacaagaagttccaagtgcttggaagttccaagttcttttatattcccttaccagtcttagaattagcgttctcaaaggagtcctggttcattttattggaaaatcctattagaaaccaagatttggggacagttgtgtttattgctactgtggcattgttccttgcttccaggttctcttagctgacagaaaaaaaaatgtgtgtatactaacacatgtatatacacacatctatgaatattcctgtatgtatccattgtatctctattcagctaaacatgagttcgtactgatgtctctaagtctaatcaggtaccacacagctcattctagcctcttccctagcttgtttgtaaactcccacttcatggtgagaaacccaactcccatgatctgccacccagggccctaattgtttaattacagtttagatgtatagtagtttcagaagtaagtccctgttagaaacaactttgtcaaccagagtgcaatgtttaggtatagttctttttgcctttagtcatacagcttccattcatctccaaagttacttaggtcagcatccaattagtaaagttatttaactcatttgtaatacaattagattgatttgcacagtctccatttcatcctggggtcccatgacctcttaaatgctttttttgaaaattttaattacattttaattcacctacattaagattcattctttttgctggaaggctctgtggttttgacaaatacatggtgttacatattcatggttgcattatcatacataatatcctcaactccctaaaaatgtcctgcatgcttcacctgttcagtcctctcctttccccaaatccctaacaaccactgatctgcttctgaactctattgttttgcctttttcagaatgtcataaaaatggagtcatagagtatccagccttcttagactggcttctttcccttaatatgcacttaattttagtggtttgactcatcattctactttatagctgaataatattctactgtcgagagatgtaccaaacaaaagtttgtatttattcatcagttgaagcacagcttgattggttccaaatttttggcaattacgaacaaagctgttataaacattgatatgcagatttttatgtggacatacatttttacatcagttgggcaaacacccaggtgtacaattgctggatcctaagacaacactgtatttagttttgtaagaaactgtcgagctggctctatacttctgcatgcccaccagcaatgaatgagagttgctattacttaatatccttgtcagcaattgatactatcagatctttggattttaactattctaatagatgcacagtactatttcaaggtcattttaacttgcatattcctaatgataaataatagcgagcatctttttctatacttgtcatcatatgttcataagaaataatggtacaaagttttcttttcttgcaatgtttttatttctcatattagaataatgctagactaatggaatgggtgaagaagtgttctatctgcttttgttttctgtaagactgtggagcattggtattagttcttctttaaatgtttgttagaattaccagtgaagcaatctgaacattgtgctctgtttttgtttttgaaaggtttaaaattatttattcaattattttaatagaaatcggactattcagtttatcagtttctctttgcttaacttctggaattggccaattttatctgaataatcaaatctgtgagcactgaccttttaaagtcgatgggaccagtcatagtggcccctcttttatttctttctctagttttctcaggtgtagacttaggtttttgatctgagatctttcttctttttgaatatatggatttattgctatacattttactctaaacactgcttttgctgcaaaccacacattttaataagtatttttatttttacttagttaaaaatattgttcaatttttcttgagacttctgctctgactcatgggataactgaagagtgtgttgtgttaattcccagatattagaggattttacagctatctttctgctattggctggcagtttgatttttttgtggtcataagttgtgagggttggggagtgttccatacttatgattaaatctcagtgttttttgggcctgtgtttcagggccgtgtccttccaagtgtctgcctctcttccaggtacacagatgtccccacaacccccacccggcatccctgctctgttctctggctgcagcatgcccaatccatttctctgaagccttgactctcgattatgcttttttttttttttcacaacttagatcatataggtaggctggagagggctggagtgggaaggaatttatttcttgcaggtgagacaaaatttcagaatgtggttctggaagaggttttttttttttttttttaaattttccgtggagagtagacctttgttatggagaaggtttgatcttcactgtgagaatctggtaaggttcctagagagaaagtctgtgaaagtgtgaggacgaccccaagacggtggcctttaggagctcctcactctcactccagtccacactcagccaccaacactgtaccaaaattgccatttgcttgttcttgctacttcactggcccagcagcttctgttccaggtaagccaatctctgttgttgtatctcgctgtgacacctatctccctagatttccgggtgagagtttatctctgtcaattcagttctctgtaagaaaacttgttgattttcagtttttccaggcttttcttttatttcttttttttttagacagtgtcttgctttgttgctcaggctggaatacagtggcatgatcacggctcactgtagcctctacctcctgcactcaagtgatcctcccacgtcagcctcccaagtagctggggttacaggagcacacgaccatgcccagctgactgttctattttttgtagagacaaggtcttgtcatgtttcccaggctggtctggaactcctgggctcaagtgatcctcctgtcttggcctcccaaagtgctgggattacaggagtgagccacccagcctggcctccagctttttcttgttgtaaagatgagaatgatggcctacaagctcttcatgtgtcagagctgaaattaaaagttaatgcctcctcttttgtgatcaaatattttatttaccaatctgatatatatttgagcagcacaatgagaaactggtctggacaccacccttggcattttaggtgattaatatttatcttacattctaggaatcatctaaatgttcccatatatctacttgaaaaatatcattgtttaccccacaatgaatatagtaattttttttggattttataaacagtgcatgtttacagaatggaattccactacttctgcattggcagacctagaactgtaactacaggcagatgacgtcactcattatgcactaagattgaattctatttctagttgcagccctgaagacaggagaaacaagagaaaaattcaaatatgaagaagccaaaaatggacttgttgagttaaatcaagaggcttagccacctgttatgggatggctggcttttgtgagttgccataagagacagataataaatgtatgaatctacggagcatggggtatgatagacccataggaaaagctttgatacagccctttgatacaccttagaacagacagggattgaattttacaaacaagatgctagtcagtgtctctacaagggacttctctggttattaagaaacctcagtccactaggaaaatatccctaaaggtgcccggaaagctactgcccaagctgtttgacatttcatgttttctcagtagataagtgtcttctacctccagaaagagttagaattccatacagagatgttttagagaagaagccccaagcattactatttttatggtaagaaatctgtgcagtttagctgtaatttttatgagatatagcatattagtatttatcatatttgtaattctaatttaaatatataattaagtaatcaatttagacaggtgatactaagcaggacttttactgagattaaacctagtagggtgatatttaaggagtcataataatactaagttattcatgttgtttatttatttataagttattaagatgcccagaacagttctgttagataattggagtatttaaaaaggaaattaaatatgtataatttataaatgtagtttaatatataaagaagaaaatgaactatgtttataaatgggtctaaacattaatcaaaaatctcttcacgtgagataacggagaggatcagaaaaaacacctattgggtattatgcttattatctgggtgatgaagtaatctgtacaccaaacccccgtgacgacagtttacctgtataacaaacctgcacatgtactcccgaacctaaaagttttttttaaaatcccttaagagtacttgtttaaatttacgagatacatacatagaataacaaaatttataagttgaactgaaaaagagggtttttacatttataactttaataaatgaccatattaaagtccaagtaatattttaaatatatttttttcttcactcaaaagcatctgcaggctccaaaaaactcacctaaacaaatatacttaaatctgatgaagaaaataaaggtcactaaaaattcaaccaaccagtctgaggcaattttggtcaaatttctactgaccatgcttcaatatgttcttatgtatgatacacacacacacaacacgtaatattgcacaagtggaaacacattacgtatgctgttgatataattagagactttttgcccctatgtccacctttctgtccttctcctccacatggacacactccctcatgctcatccctgccctctagtctttattaataacctggtgtatgccctttcatatttttctctgcaatcatacacacgcatgtacacacatacgcaattttttggttatagttcatttgacagaacggtatctactacacacaactcggcatttactttcccaagcagcaataactcatagcaattccacatgacctggtatcactccaattcacttctttttcatggctcagtaatagttcttgcatgttaagatggctccaggctgtatcaacatctgacagcctcaggtaaggtctgcacactccttcctgcctcgctttggctgttgaatgactcagttcattcagccagtctgtgcaaatctcagttcccaggctaatgatgcctgcagtccttcttaaccagaaggcccatgctgggaatgtacaacagctcttgtcacagagtgaacctgaagagctggctagcacggaacatggctgcattctcagaatattatatcggtcttaaaacagtgatttggttttcactttactcttgaggcatggaattactttttggacaacatggtgcctgggtcaaggtaaatttgagtaattctactaagaccatccaagttgtgaagatctacatagcgcagaagtcaactcgtctctggtacagaacagttctgcaactttggacaagtagtttaacatctctgagccacacagttgctttgcctgtaaaatggaaatcatggtcatgtccacttcagaggctgatgcaaggataaatgagattacataagcaaagcagttcccactgggcctggcacttgtaagaaaagatcattgtaagctattacgtgcttttccatacttggtaatgttgagtcaagatgtggctggttcttgaacttttgggaaataaggaatatgaaaattctgtgaccattctaactcctgtctattgtagcctcagcattctgtttcctgcttctcctctctgtctttgcctattctatgatgttcttgatccagttctctcttctctcacttttctgcagtcacatggtctctgtcattccttcctggtacatttaaatgcatccagttgccaattctttgggtggatatgtttctttttttctttttttgctgatagaacttcatgtaccctgaatgattcccctgggttgtttttcctaaaaatataatgtgagtaaaatatgtatccccgaagcccagggtagaggcaggtcacaggaggcttcttggtctccgtctagctccagatcttcgtaagcatatcagggcattatgacttagttgccctatgtctgcaatgatagcagaccttgttaataaaaatcactatcactatcagctcttcctcgtttgtatgaaactagcctcttcagaaatgcaatagtattaggagtaatttatttgcctgtgtaattaaagaatctactacactacatgcaagaaacaaaaattagcagagcaaatgtttatattattctatgaaaatagtgatacattacaatggagttatccaccttcagccctactgaggcattgggatatggtcagggggccagatggtgaccataaaatacaaagatgagactcaaaacagacagtggtttcatatcagttaaccgtatggtccagagtaaccatctgtactagcctctacaagaaacacattttgccttatgaagtaggaaaacacaagagaggaagctgtcaggttttcaaaatatggaggcatttattttctttcgctgtatgtttaatttgaagaatgttacataaaggccgataattaagactaagagagctgctacttcggtctgtgtagggctctttctgagctctttaatcaccctgtcccccttcagcaagagagctcagctgaaataatggaaaacagaatttagttctcaaggaccattcggaagaaagaaaatggcaccacacccatgagggccaaacactgccttccattcaaaatgtatcttctccaccccttaggatcacctgattcgacacttcttcaactgtattcatctgcaagcaaatttggcctcactcccaaggacattgcagctaggaagttaatgatgatgcatcaccaggcttgcattccttttcagaaaaaaaaaaaaatcaggtccctttacactgcaccaacagccatcatcattactgagagagctccgtcacattagatgcaataaacgtatgtttgtatcatcaacgggactaagaaaaaaagctcactgttgcatggataatttttctattattcaaaagtaaggttgttttgctaaaacaaaagttgccaaagccccaggtgatgaagtacaatgtggctgtattatcaagtaccatatcgagggtggaaacactgtgggttggaaataaatttcctctgtacacttgcttccatctgcacacttaaatatataaacttgtttctgccgatgcagctgcatgtattaaagaagaattctaaaccttgaacttagctgcccatgtttcttgcctgcattctagaaactgctttctgtgtataggtagcaggttgccttgctttgtatgatatgccaagcactgagcccagggtgtggcccaaagaggaaacttaatcaacatttgattaatgaataagtcaaaatatgcttctcaaagtgcccactctgaagagcatcggagctctggctcacgctcaccgtgttgtaaggtcaccatagcccagggcttctggctcttctctatctggtgggtctccgtggatgtgggctagtttatccttccaaaatctgtacagaacttccagttctgtagggtgttacttccagggtacaaatacatggggtaaggagctagatctcaggtgctgtagtcaaaggaaagaaacacccagccctcagacacagagcacatgacgggttttgagtgacaccaggggtcaggctgcccagactcacaacctggctctgcttcatagaagcctggggtcaactgagccctaggcattagttccctcatctttaaaatgaggttaataatagtactgaaatcattgtggaggaataattattaaatgagttaatatggataaacagcttgggaccatgactgatctacagtaagcagtcagtgtctacctaattacactcagataaccgaaacaaagatgtttcatcttactagtgtctgagaggaggctgccaatgtcaccaggcaaggcacatgaggagaacagtgcgagaagccatggacagctttattacttctgacaatgactgaacaactgtcttccaactctcccgtcaactcctgaaaggtaggtgtctagtgcccatcacacatcccagcgctagctcttcaacaattctgtggagactgttcagtccaggtttgctgaacaaacactgcaacaaagctaggaggttgtagacatttcctgtggctgctggaataagttctcactcttgaaataatgcacatttattctcttacagttttggagatgagaagtctgaactcaagggtgtcagcagggctgtattccttctggaggcactaaagaagtttattattattattatactttaagttctggggtacatgtggagaacatgcaggtttgttacataggtatatacatgccatggtggtttgctgcacccatcaacctgtcatctacattaggtatatctcctaatgctatccctcccctaggcccccaccctctgacaggccctggtgtgtgatgttcccctccctgtgtccatgtgttctcattgttcagctcccactgatgagtgagaacacgtggtgtttggttttctgttcttgtgttagtttgctgagaatgatggtttccagcttcatccatgtccctgcaaaggatataaactcatccttttttatggctgcatagtattccatggtgtatatgtgccacattttctttatcaagtctattactgatgggcatttgggttggttccaagtctttgctattgtgaacagtgctgcaataaacatacatgtgcatgtgtctttatagtagaataacttataatcctttgggtatgtacctagtaatgggattgctgggtcaaatggtatttctggttctagatccttgaggaatagccacactgtcttccaagtctcttaagggctgcctaaattccttggttcatggcctcttgcctctctgttatgaagatcctggtgatgacactgggcctgcctggctaatccagggtcatctctccatctcaagatctttcccttaatcacatctgcaaaggcattttgtcatgtaaagtaatacattcacagattccgtgggttgggctacagacatcctggggagggggtgtatagttttctgtctaccaaagagcttgtggaagattgggagaaaaattgaatcagatatggggatatgtgggaggaaatgaaggaaagatggccctccctggggtagaatctgaggattttttaaaccataatactccaaagaatcaactgggtgcctccaggaatagaaatataagactccagcccccaagtctgattctgtggtctggaaagtggaatgggaatctgcattcttagttagctctctcatctccagtgaaaacgacccttggacatatttggacaagcatactcaggatgtggcactccaggtggaggaactgaaaatgggccagactttggctcatgagaatctcctctttacacaataatccacagccaaaggctctgtgttttaaaaccagggaggtggtagagctggatagcttttggggacatctgggcctaacagcgagtaggagaggggatagaggtgttcaccgctaaactccacctagcaggtatgttggcctaggtgtcctctcagaaggaggaagacagagacaaccaagcgctctgagtggaaagcattgcgtcttctctcacatgtgccatagcagctgggggaaaagaaaatgactaatttgtgtgttgcctaaataagcaacaccatccagaagcatctctttccttttccatgcctaaaccatgtctaagtaccggcttgacatggccttaaatgacatgcaactattctttttggtgacagctcccagaggtgacagtgcagtactcgggaggaattaaaagactttccgtaattttctagaatcctaccactttcaggtgagaatgactgtgcccttctcatctgaatctgacagtgatataagtccccatataaggtgatgatcctgcttctctttgcttgagaggcagcgtcaatgccactctgaaaaaaagtagattctaatttgagcatcatgtgtatcattcaccgtctaacttatgatcttttaaactttccctaggaatggcttcagagatggagaacagttatgtgtccagagtggaatcaggccattatgatggattaccatcatttctccctatctctagaaagtctgctccaaaggtcttttctgcagagaagaatgcacagcgtttcaggatgtcaaaaccttaaatacccggatacttaaagatgaatcgggccctagcaaagaacaggaaaattagtttttccttttttttcaaagtgagaagaaataatgatagtacatgctggaaatataattttgatatcacaagtttcttaggaaaaggaaataataacctataacaacattgctttagatcacaagatagagaagtaggcctgttttgtatatgctatttttggatacctgccttcttaaatttgagttaatcactttactgtgcaagaagaaatcaaaaaaagcaacgatgaaagaagaggctccttctaagttttcaagagataaagaaagtaattttataagagaggaaataaaatgtaatgctttttccagcataaggtgaatgagatcatctgggttaggaagtttttctatgctgggaagatatgataaagtaattgaacataagtgcctagaattttataggaaacttccaaagtcacttgatttagaaggacagatgaggctcaatatggcttcttccctcagaagtggcataggttacagcagtagaaacttaatccagcctcagaaagagttcccaaagcactcaaaagttgtatgcaaaagacttagaaaaccgggctggaaatattttatacagtaaccctgaatgctttaggatggttactttttaatgtattccatgcttgtctaacacctgcccattccagggggtacatacgcaggggcctctccaggcgagcatctcagttatacttccatcaggtcctggcaggaacactggatagggaggctagattcactgcacatcgcctctaccatagctgctcagaccttcatgtgcacacaaaacacccagagatcttgttggaacacaaattgccagggtacaacccaggggaatttgcatttctcacaagatctgcccctgggccccctgcaatgcagatgcggtgggtccccagaccccactttgggcagcaccgatctatacaaccacaggaggaagccctcccgattaacattcaagccaggcaggtgaaggctggccacatctacctgcctgtcccacagggacctccacctttcctttctattcccattctacctttgttcagtaggccttcatcccctcttatctagctactgcagtagcttcctcactggttttttttttttttttttttttttgcctccttttctattctaactctacccattctaatgtatcttgcatacagatagatagatattcattacttttctgcaaatacatcttggattacactttgtctgcctttaatagcattctgtgtcttccacaagatgacagtgaattacatgtgagccttttctacctaaattaccttatattttccagccttcacgtttttgttcaggctgttcccaatgtcagaaatttcttccccattcccgtcctttcctctgcttactgaaactgcatagtttttactacatagctccaatgccccctcctttgtgcagtatccattgattgccctgtgtgaaaatattggattcctcctctacattccaataacaaattgcctgacaggcatgcatgccatttgtgacgagtgccactgatccccttgtaacaggtatttgtagcttccccaccatatctaagcttcttgggtgcagagatcctgatgattctatcaagatctatcacatcttacccacagaaaatgactaatggtaatggtgctgggagaactggctaaccgtacgcagaagattgaaactggaccccttccttacaccacacgcaaaaatcaactccagatggattaaagatttaaatgtaaaacccaaaactgtaaaagccctggaagacaacctaggcaataccatcctggacctaggaacaggcaaatatttcatgacaaagactctaaaagcaatcacaacaaaagcaaaaattgacaagtaggatctaattaaactgaagagcttcagcacagcaaaagaaactatcaacagagtaaagagacaacctacagaatgtgagaaaatatttgaaaactatgcaactgacaaaggtctaatatttagtatctataggaatgtaaacaaatttacaagggaaaaacaaacaaccccattaaaaattgggcaaaggatatgaacagatgcttttcaaaagaagacaaacatgtagccaacaaatatatgaaaaaagctcaatatcaccaatcactagagaaatgcaaatcaagacgacaatgatataccatctcataccagtcagaatagctattattaaaaagtctaaaaaaaataacaggtgccggtaaggttgcagagaaaactgaacattcatacactgttggtgggagtgtaaattagttcaatcattgtggaaagcaatatggtatggtgattcctcaaaaagctaaaaagcagaactaccattcaacccagcaatcccattactgggtatgtatccagaggaatataaatcattctaccataaagacacatgcaagcaaatgttcactgaagcactattaagaatagaaaagatgtggaatccacctaaatgcccatcaatgacagattgaataaagaaactgccgtatatatacaccatggaataccatgcggccataaaaaagaatgagatcacgtcttttgtagggacatcgatggagttgaaggccattatctttagcaaactaatgcaagaacagaaaaccacatgccacatgttatcacttataagtgggagctaaatgatgagaacttataaacacaaagaaggaaacaacagacactgggttctacttgagtggggagggtgggaggagggaaaggagcagaaaagacaaccattgggtactgagcttaatacctgggtgataaaataatctgtacaacaaaccccagtgatatgtgtttacctatggaagaaacctgcatgtgtacccctgaacctaaaagttttttttttttttttaaaagaaagaaaatgactttgttagatggactcctgaaggaatgaatgaacaaatggatgaacggtcaaaataatcaagtaaataaagtaatgttttaggctctgtggtgatcgtgagtgctgtctgtcacatgtttccgctcatctaccttctgagcacctgggaaacttgttctgcctggtcccttgtggttggatggggccatatgactggctttagccaatgagctgtgagtagaagtgccatgtgtatcttccaaccaatgagctgtcagcagaagtgccatatgtgtcttctgacccaggaaatgtgagcagaagtaccatgtggtaccatgtgtgtcttccagccaatgagctgtgagcagaagtactacatgagcttccagcaaataagctgtgagcataagcaccatgtgtagccttcagtgaatgagttgtgagcagaagtgccatgtgtggcttccaggctggaagccttgttatgatggcaccatccaggccactcttattgacactgtgacatgcaactttgaaatggtgcttgttttgtcagtctgggatcctgagcccacaataagcagatccccctgcccccaaccccacagtgggcatattgtgtgagtgataaacaactctttgtttaagcagctaagaagcaggttgctgcgtactgagcagaaccctctatcctcactggcacaggacttttctggatctgtttcccaccactcatttccacctcacgtacagctcttccagccacgaccaggtccttctctcaacaacttctgtccttgaaggtgaccccttattacccattttattctagtaacataagactcccctgtgtctggggctttgcttcctgttttctatttacagctaatgatatctgagtctcccacctcacagctgagtgatctggtctgtgctttgggaccacccctgggattctgttacagtgaatgttctcatgtatttagactgactttggaacatgaaagctcaggagaagaggtctccctgcaatactcctgttacattttgcaatttagaattaaagcagatgtacaatcataaagaaaaaggaaaaaaataataaagtgatttttttaaaaataaaatttcagtctttgtgggaggggatggattgagcatttccttgattggattgttttgctttggtaaaaaagcacagactgtcttcttaaatgcatttctttttctttttcaatagtgaaaggtagtgaaaaaaggaaagaaatgagcacttttaacaagaatattttcacacatattacctgtacaggagacataatcagtgcaaaatggaaatgtgaagcttctcattcaaaaactaagatttgcaagatgatgacagcagtaaataaataaaagcatcggttttttctgagtgtggggccctgtgtgactgcaccgtttgctcccccataaagccagccctgcctgtgacatggcagccttctaaaatcctagattttttgctcctccacacattgtttcagcactgtattccatgacttcagagaatgcccaggtgtgattgctgaattcggtgagcatttctggaggagaaaaggataatgcaaagaaagaggaatggaacacccttgccagcagccaccattgcttgtcatcacattaatttcccccagtgtcatggagacggtctaccggggcagtgatccacacaggcatcagagggagggacctctgacggtgacggggtcatttcccatctgtgatgttcatttcagtcctgtcaaccccagaaagcacagctaaagacaagtggaaaataaatgcaccttgatgcccaaatgggttgttccttccccatttagacaacacaaggaggagaccatttttaaactggtctactgccatgtggaaatggaccattctgtcacggtgaactaatatcttatgacttttatcatactgattggagccaaactgttattaaaattcacaattgtgaccgggaagagtggttcacgcctgtaatcccaacactttgggaggccaaggcgggtggatcacttgaggtcaggagttcgagaccagactggccaacatggagaaaccccatctctactaaaaatacaaaaattagctgggcatggtggtggacacctataatcccaactacttgggaggctgaggcaggagaatcgcttgaacccaggagaaggaggtttcagtgagcccagattgtgccactgcactccagcctgggtgacagaatgagactccgtctccggaaaaaaaaaaaaaaaaaaagtcacaattgtgcagcagtagactactctccatttaatcaatcattttcttaagtccctgtgcctggtttgcattttgttttctgtgatgcagatctaagaggtctgagatgaatcctgaagggatggggcgcacgaggaaagctgctgaaggtgttctggaccaaagctaagtagcaccttctgcttcatggtccctcacagcagtggtaggtaggtagttaggagctctgctcaggttggggcggcgagggtgggaaacgtgagccagaaaagccccagaagtaatctgatgtgcagtttgtaacagacctcattttcctccagaagccagggggtgggatgggtgaaagaggagttttaaaaagcaagaaagctcagtgctgttatgatttgcatgcagaagtacttgaaaatctgtactggcaattagctaatgagacagtgctcatttccgccgactgccaagggcttgacttcctagagagctgagcgaggcactgggaatctacaggaagaaaatcgagggagggagggagggatgctcctgcttcccccagtcaccttgaaccccttccttacatgtggcaaccatgttgttccaatgccagcccaagtgtcacagaatagctgtgagagaaaataaacaaagaatcactccagtaactttcagcacaatttattggcacttgtgtcttacggctgctgccgcctgttggggtaatgacacatgatgggtgattaaggtgcaagtccttaaatcaaagctgtgcatttggtctggagaggcagccagcagccctgagtttgctcatccctctgagtgggaggacctctttaggacaaaaaggggcctgttatcctaacaagggcaagtcctcgtgtctgggaactgtttcatgttttcaggatttaccctagctcctctctgacacatgagaaaaaaggaaagctgagagggtagcccagtccatcatagcttgctgggtgatttcgcatgaggttcccggggctgggatggcttctgaagatgcctccacctgcacctctccctgaagggaggcctatcaagcagcaagtcaggggaattttgcaagtgttttgatgacatgaatctctgcttttcaccctttcagggttggtgctggcagggaggctcgcttaggtgggtggagctcatagtctctctttttcctttatgccaggaattaacaaatgaggaagagattgtgtgtgagcctccctgagccatggacattacacctctggtctgccatgggcttttgtgcttttcattattctgaaactggacaaatcaatgacgctttcatacttatctagccaggaggaggaacggggatggtagattgctgataagatccaggttcctgttccttaaaaactaggagctccacagcaatggatcagaaggggccaagcttacctaagctggcaggatagggaagtcccttctgttttagccctttaaggacagtcacttttaaactacccatcagatttttgttctctgtatctgctttcctcaggccttttctctctataaaccccacctcctctgctcagctcatgggaacactcattctatggcatcaaatgaggtgttgcctgaatctagactctcaaataaaagccaaaggagattttaaaaaacatcctcaagaagcctgttcagagagcctgagtgaacatgggcaagaatcccatactcacttcctatacgtccagaaagaagcagaaaagaggctctggcatggtggctcacacctgtaatcccagcactttgggaagccaaggcaggtgaatcaaatgaggtcaaaagttcaagaccagcctggccaacatgatgaaacccagtccgtactaaaaaaaaaaaaaaaaaaaaaaaaaaaaaaaaaaaaattagctaggtgtggtggtgcatgcctgtagtctcagctactcaagaggctgaggcaggagaactgttggaacctgggaggtggaggctgcactgagctgagatctcgccactgcactccagcctgggcaacagagagagactctatatcaaagaaaaaaaaaaagaggccccaggagagcaggatcttggggtgggtagatgtgcactactcatgactaacacggtgaagaagtatccaacagcaatgaaggtgaagtccatactactgtaaagaacagtgctagaaatcaggcagaagcccacagtggatagcctggagagggcccaagtttaaatctcagctttttaatttcctgctgtgtgaggagtccccaggatgcaggactttcaatgtggagactgagagagtcccagggaaactgagacagctggtcacctatatgtggccttgggtcaatctttaaccttgatgaatgtattagtccattttcacactgctgataaagacatacctgaggctgggaagaaaaagaggttgaattggatttatagctccatatggctggggaggtctcagcatcatggggcgcagggaaaggcacttcttacatggtggcagcaagagaaaaatgaagaggaagcaaaagcgcaaatccctgataaacccatcagatattgtgagatgtattcactatcatgagaatagcatgtgaaacgctgacccccatgatttaattacctccagctaagaccctcccacaacacatgggaattctgggagatacaattcaagttgagatttggtgggggggcacagccaaaccatatcattctacccttggcccctccaaaatctcatgtcctcacatttcaaaaacaatcatgccttcccaacagtcccccaaagtcttaactcatttcagtattaacccaaagttcacagtccaaagtctcatctgagacaaggcaagtcccttctgcctatgagcctgtgcaatcaaagcctagctacttcctagatacaatgggggtacaggcattggggaaatatagccattccaaatgggagaaattagccaaaacaaaggggctacaggccccatgaaagcccacaatccagcagggcagtcaaatcttaaagttccaaaatgatctcctttgactccatgtcttgcatccaggtcatgctgatgcaacagatgcattcccatggtcttgggcagttccacccctgaggctttccagggtacaaccttcattccagctgctttcatgggctggtgttgaatgtctgtgacttttgtaggcacatgatgcaaactgtcagtggatctaccattctggggtctggaggacagtagccctcttctcacagttccactaggtggtgccccagtagggactctgtgtggggcctctgaccccacatttccctttgacactgccctagcagagattctccatgaggaccatgcccctgcagcgaacttttgcctgggcatccaggcatttccatacatctcctgaaacctaggaggacattcccaaacctcaattcttgacttctgtgcacccacaggctcaacaccacatggaagctgccaaggcttggggcttgcaccctctgaagccatggcctgagctgtcccttcgccccttttagtcatggctggagtggctgggatgcagggcaccaactccctaggctgcacacagcatgggcaccctggtgttggcccatgaaaccattttttcctcctatgcctccaggtctgtgataagaacggctgctatgaagacctctgacatgccctggagacattttccccattatcctgggaattaacatttggctccttgttacttatgcaaatttctcctcagaagatggcattttcttttctatcacattgtcaggctgcaaattttccaaacttttatgctctgcttcccttataaaatgaaatgcctttaacagcacccaagtcatcttttgaatgctttgctgcttagaaatttcttccaccagataccctaaaccatctttctcaagttcaaagttccacaaatctctaggacaggggcaaaatgctgccagtctctttgctaaaatattataagtgtcacctttgctccagttcccaacaagttcctcatttccatctgagaccacctcagcctgacgttattgtccatatcactatcagcattttgggcaaagccattcaagtctctaggaagttccaaactttcccacatttttctgtattcttctgagccctccaaactgttccaacctctgccggttacccagttccaaagttgcttccatattttcaggtatcttttcagcagtgccccactctacaggtaccaatttactgtattagtctgtttccacactgctgatgaagacatacctgagactgggaagaaaaagaggttggattggacttacagttccacatggctgaggaggcctcagaatcacggcaggaggcgaaagccacttcttacatggtggcggcaagagaaaaatgaagatgaagtaaaagcagaaacccctgataaacccatcagatctcatgagacttattcaccatcacacgaatagcacaggaaagactgacccccatgattcaattatctcccactgggtccctcccacagcacatggaaattctaggagatacaattctagtagagatttggatgggggcacagccaaatcataccaatgaacatcagttttgtcatctgaagcagggcagatagttatgcaaattgcagtattgttggatattagctgatatggtttggctctgtgttcccacccaaatctcatcttgaattgtactcccataattcccatgtgttgtgggagggaccaggtaagagataatctgaatcataggggtagtttccccgatactgttctcatggtagtggataagtctcatgagatctgatggttttatcagaggtttctgcttttgcatccttctcattttctcttgccgctgccatgtaagaagtgccttttgcctcccaccatgattctgaggcctccacagccacgtggaactataagtccaactaaactttttttcttcccagtctcgggtatgtctttattagcagcatgaaaacaaaacgatacattagcgtagaaatatattcaaatcatgggaattgtgaagggtgaacaaacacgagtatgaaagcaacatttcagcaggtttgagaaagttgttcatgaaggcagctgtctctctggagtgtgtgatgtggcaggtctcagggtcagaagtgagctctctttgcaacctggtatgctgggagttaagctttaggaaacacagagttgaggtaatcatggcttcatggggaaaatgcaggggttccttgcagccagaagagaagagaacaacctccaagctccaaagaaggatgaaggagttaggtgtgtagccccagcccctaataaggaagaggcctcaaggtattttgtctgagatcaaggcctcctggcactattccaagtggaaggaaaccctaagctgacacacatctgagacctgggtggagccatttcaaaggaagctgaggtccttctcttgacttttaaccttgagaacatggtcactttgtactgtttttgcaggttctactcacattgaccttgactccatgaccttggaatttaaacatgagacaatgtcgtatccttgcctgggtttggcaattgcagggttcaggccagtagaatgacctatgacggtttggggattcacagcctctgtcgcaagcttaattcatgcagcatctggggaccccaacactcttcatgtggtctgcgacatctctgaaaaacttctacatggtaaggaattttggtgttttttaaaaaagtcaagggcctcaattagaaatatgaataaagggagatgaaggctacttcctttaaggttgtatcaagacaggaagacataaagtaagagtgtatatatgacactatgtggtaagctgcagataaaaatttcaatttagcttgatgcatcttctgtggttctttcataattttttaaaaaattccacacttaaacagttgtgatagatggcctgctaatacagtgcaaaatgtggccattttacattttctcacaaagaattaacccagaatgtctgaatccccagatggcttcactgttgcctcctttcatccccgtcactaatctgtgaaaaggcagccctcacattaagacactttcctgaagtggcagcgacagctcagtgagggctgctgtgctgcactgggtcggggctgacgttcccaacctcactgctaatgagaagacttgaaagattactgacatgttcatgttcatggaggtggccggaagtaattaagcactcttcaataaagggctaccttggcaagttcaagatttgaatgggaaaagggtgatggctgggctgggtgcacatgttacctgcatctccaagaccctgtccttcttggcgtctttccctgcttatcagaccagttctgggcactgataacaccacagagcatttgctcaatctctatcacctgatatcctgaaaagggagtggaggcctttttgcagacttctgggctcccacagcccttgtgctgcagcatgctgcctgccttctcttctgtcatcaatgaaatatggtggagggagctatgctgctgatgcagcttggaggctgtaagggaccagagtcaaatgggccatcgagggctggctacacagttactgggctggccatgtgatagagagtgcagaccactaaaaggcacatagcagaagaatactgagtaacacagaaaaaaatcaacacatatagatcagaataaaggctaagttattaaacagtacattcagatgtttctagttacagaaaaatgcttcagcacatattagcagagagaaaaaaaaataggccacaaggagatttatcactatattaatttttttttgtgagggagggtttttctcaccattcccgatgtttccttctacgtagatcagacctgttgaggtaacacttctcctatttcctagtcttcccttgttttaatttgggatagaaggaatgacttacacttgataatgagtttggaagtgggaactaggcatatacagctctaccctttcctgtactttttgttgggagctgacagttcctaagaaacaccctgtagtgggcagattccaagatagcccccagtgatcctgtcccctgatattcatgcccttgtggaatctcctattcttgagtgtaggtaggtcctgtgactttcttctaatcacttaaatatggcaaagatagtgggacatcatttccttgataagctcacatgatattataacttccatctttcaactctctctgttgccttctccacttgcatgttttcttttctttcttttttttaaaacaaaacaaaacaaacaaacgacacttgcaagcaagcagccatgttgcagacatcctcatggcaaggtaccaagggtgacctttacttggccaacagccaaagagtaagtgaggccacaagttgactcctgacaacaattacatgaacttggaagcagatccccacttgagccttcagatgagacctaagccatggctactactttgattgcagccttgaggaagacattgagaaagctgtttgtttcagatggttgaagccaggacctcagtaagctatgtctggactcctggacccacaaaaactgtaagaacataagtgtatgccattttaagctgcaaaatctgtgataattagttacaaagacatagataataaaatcagacctttatgccataaagtatgcatgggtggccctaatctttggtagggtacagaggtggtattggggtcctgtgatgcctaggactgtctgggtaagcctactggattcttagcttaagttatgaggagtatctgcccatagatataaacagcattgtctcacatgaattttatctttgacaaatgagattttgttgttttcctcctttgtttccctcataaatttcagatcttgagtaggaaaaagagaaatatttctatcaccatcttttgagtgttgggataaggagagatttttctacctttcaatctattattttatttttaaaatatatgggaacctgtgtaattgttataatcagaaaaaaaatactaagaagggccagccgggtggccaggtacatgcaagtgagttttgatagggactttttactattgccctagactttgtttctatgattcaagattgaggatcaaagtatcacatccttaaacttttttcaagactatgggaaccagattcccattaaaggcttaagttctgctactctcaatcattactccagtccccacaacttcccaacgtataaaacaaaattgggggaagtggggagaaagagaaaattgtcctgggttactagagagtgctaaggctcgagttgtctgtccccctagacccaagtaaggggcggggggctgagaacgtatcactcacagaggttgggagtgcctgtaaagtgggtaaatggaatttatattcttctgtttgctatttaattgggaagtgacatgtttatctgccttacacatacctgagcaggaagacataaaccaggagggagaagacaggtgaagtgtgagcacaggacgatgatgcctaagtttccatggacactacagaaactatctgggcttaggatggttggtccacagtgagggaattctgtagcacaagtctctgcaaggcattggggagcatcgtgggagggaggatgttatttacctctttatcattctcctaactctgttagggactgtatagcagggagcctggaaattccctgccaaataaattgcatgtatttgattacatgatacaatgcagaatatatctggtctttgttcctggttccgggacagagcttcaaaacctcttggagttttcagagtgatagaaatgtcttcagttactcacaacagaccctttctacttctgcagtacctgagtttatgctaatgaggtgacttatggtgggccctcagatgattatcaaggaggggctggccttctggaaagaccaaccatgtgatgagaggagggggacattcagcctcaccccctgacctctggggaaggaagaggggctagaaatagatctcagtcatgtggccaatgatttaatcaatcacgcctccgtaataaaacttagataaaaactctgagcaatgcaactcagacagcttcctggttggtgaatatatgggtacgcccggagggcggcacaacccagatccacaaggctggaagctcctgtgctcaggacccttccggatcttgccacatgtacctgtgcatctggctgttcactcatgtcctttttggtaaaatggtaattgttaagtatggcattttcctgaatgctgtaagaggttctagcagattatcaaacccaaggagggtgtgctatcttgaatttgcagctatccaggcagaagtgtgggaagcctgggaccccactcactgctggtgtctgacataagagcagtcttgttagggatcttgccctttaactcatgggatctgatacgaactccaggtaattagtgcctgaatcaaactaaattgtaggatacccagttggtgtcagacaatattgaaggctgttttccatacagagtgagggctttgatggtcagtaaatattagataaatagtcacagctaagataaatgacagagcctttgttttgcatgatctcctcatatcatatcaccccattacaatagaggcaagttaccctgaatgaaaagaccaaacactccaggcagggggagggtggaatatcacagtttaagttggactggctatgatgatataaggaaataagtaaaagctcagaacccggtggaaggtggtgatgggagcaaatttaaactgattcattatgctcccccattcctctaagcaagaaaggattttctgacgcatacaaaatgatacagttggcaatacgaatgcatctgatgcttatagtcatgagcttttccaaccattgaaaacagaggtctcacctccagaaaactgaggtacattatgacttaacacacagaatcaaggtgactggttcacgggggtgggtataaagcccaggcccccagccccagccaccttggaagggccacccagcttcagagctctttgcaggatcagctgggccctgcttgcatctgcatcccagcttctttctgtgcctctccaacttcctgtactccccctatggcgttgatcccaagcgctttccagcaggtttccagcacacagatccctgccagaagccagcctaagacaatcctcctttatccagctttccactcaaaaatcagcgtcctcagagtggctttcccttatctctcacgtgccatctagtaagtgccttcattatatttggtgcatgttttaactgtgagattattcatctgctgatatgattaatgtcaaattataagctccgtgtgggtaaaggccccctggtctaatcacaattgcatctctaaggcccagcactggcagttgtatagattagacttccaatatataattatggaataaacaggtaaataaaggatgttaaatcccattgaggagacgactccattttttaagtctcctactcagttttcctctatatccattcatccctttaaccattgagtacctgctgtgtatgttactgtgtgctgggtgttctgtgccagagagtggtgactcagacagctcccgctccgtttttgtggtgtgattcatgaagccgggttccgctctgcaaccccatgttatggtttgagataatgttacaaatgatctactacatgtatgtggctcttttccccagtgagtctataaaagacttaaaggcgaggacatttacagtccttgctcatagcaatacagtaggcagaataatggtgcttcaaagacctccccggcctaatctagggaacataaatatgttactgtacacagtgaaaggtattctgctgatggaatgaaggttgctaattaactgatcttaaaatagggagaagatcctaaattctctgggtgggtccagagacatcgcatgggactttaaatgcagaataagaaagcagaggagtcagtccatgccttgtggcagaaacagaagcaaaagaaacagaacagaaggagagtcagagatctgaagtgtcagaaggactcaccccacacttggctaattctgagatgtaagtgattatatgcaaggaatagaatgaggcttataggagctcaggacaacccctagctgacagctggcagggaagcagcgatgtctgtctcacagccacctggagcagaattctgcccacagtcagaaagagccaggaagaaaattctctcccaggtcctccagtaagaggagcacagtgctgcggacgctctgactttggctttgtgatatgtgaagcagagaaaccagccaagccactggatgcccaacctgcaaaactctggataataaaagggtattttccttaagtcactaagtttgtggtagtttgtaatggcaacttgagaaaactaatacagaaggtatccaatgtatgttttggacttgagtctttaaaactctgtattcccaaattaaaatgcagcataccctgaagcatttacagagtgaatttgcagtttcaactttttgtaaacagcatggaagttcacggcatgttaaaatatgcacacgttaatatgtgtcattttgctgagggaggtatttaggtatttaggctgtgggtgctacaaggcatgtgtgtgggaatataatccttcctgaacttttaggccactaatatcaaaatctgcattagtcagggcttcccagagaaacagaaccaataggagagagagagacagacagagagagagagagagagacagagagagagagagacacacacagacagacacacacacacaaagagacagagagatttatgataaggaaccactccatgaaattgtgtgggctagtaagtctaaaatttgccgggccagccagcaggctgtacccaggaaagaactgatgtgcagcttgggtccgaaggaggcagcatctcctctttcttccagggacttcagtctgtttttctaaggacctttaattgatgaagcccacccgcattatgaaggataatctactttactcaaaaatctatggatttaaatgttaatcacatctaagaaataccttcacagcgacatctaggctggcttttgaccaagcatctgagtaccatgcctagcaaaagtgacacatacaattaaccatcacaaatccacaccttgtcaactcggcatccatgcacgtctgcttacaccatacttactcttcaaataaagacaataacaaggttatacttccacttcacataatatcactaccctgagcacaactgaaagcacacaaaccctgtccctaaaagaaaagcaaagtcctttggtgatgttcatgcctctccttaatgtcccgtaactttactactatgatgtgaagttgacaatacttaaatactatgatagcaaatcaatgtatcatatgttatatgataatgggataagagaggaaagaaaacaaagatacaattgtttcttggtatctttggggaattggttccaggaacccctcatacaggatacaaaactctgagagagttcaagacttttcatatgcactggcctagtatttgcagctaacctacacacatcctcctgcacactttaggtgccatctagactacatatgaaacctaataaaatacaagtgctatccaaatagttgttgtattgtactgtgttatatttgtatttatgtttattgttgtatttttttgtttttttttccctgaatattttttatttgaggatggttgaatctatgagtgtggaagctgcagattcaaagggctggctgtatttgctgaacacacacacacacacacacacacacacaatggcaaacgcactccctggcactgcctctccacatggctatgctattctctcataatgcatcatccttagccttttacagtgattaccttgggagacaggactgaatgagcagaatggattcatttagcattactacaatcccaatttttacagttgtggaaataattttacagtggcacatgagaaagaggggcttctcagaggtcgcagaaaataaaagacaactcaggacttccaaacgttaatttttttaatgctcatgcacttacccttgtttttttctcctggcttcaatacatggccaaggtagcacagaggtggctccatggtgtgatgacaatgacaacactcatggtattatgtgcctgttaatgcagtttatggctacagaaagcccctttctccttattcttttcacagagcaatgtaccttccccttgctgcattatcaatggggttttaagcaaaagtgctcttttctcctcttgcacatttacaatcaatggctacagactcagaattgtgaagtgctttctgactgttttgtttccattttctagcaatggcccattctgtatcaatctaaatgagccacagaaaacatggcatctgacctgcatctccggggagaaagtattgttcctagcagcattcagcagtaccatatacaaaaaggagaagcgatgaaaacctaaaagcatgtcttccaaaacttcttcctggagatcttcttctatgtctggcatcagctctcctgctctttccctcttgcatttcttcctgctgcaaacactggttgagaacctactacttccaaggcctagaaatgttattctcaaatgacaggaacacatgaaattgtttccaagctgaatgtccaactaagataacagttgcaaaatgatgccaaaccataaagtgaaatatgagctactcctgaaatacaataaaatggagctatgtgtatttatctgtgtaaaaagtaaagtagaggttcctcttcaaagactttcctccccatctaaataggaataaacagtaacttctcttagaagcgaaatttattcaaagacctgtgctaacattcttaaatgtctgctagccgcaatgaagaaatcaaggtactttatgttcttagctcccacaatttagcttaaatatctgccctggcatgcttatactggtccaaacaagcattaggtcatagcctgttcctcttccttatttgaaggtgtttctacctttctcagcattccacaagttacttcctccttcttttgttctcctctctctttacctcttttaaaaagttctaagttgctagccaatcgagacaaacacagaatgtgaggtcccgttccagccaatggaaaccagacacagcagtagagtggacacctcaggttataaacgaccctgtctcctttgtttggtgtactcttggggcaaaactgctggcgggtgtaccccttctgcagaaagtaaaaatggcactgctgaggagattaaatttatgttgaagtgctatttctttatggcactgaggaacaagtatttctaacgtctggaaagacaactgtgatatattgtcaacttaaaaagcaaatgcatactaacatatactctgtgatttcattttcttaaaagagaaaacgcttacacatatgaatatgcctactaggaaaaaggaaaaatgaagagcctggccatccatccagagtgcaatgcaaagttctcacctccctcgaaggatctgatctcctctttaatgaactctttttttttttttaccccagcagtgtcatggaggaaacacaccaagcttcctcttgccatagggccttttctctggttataccatctccctggaatgcatatggcttccctccttctcattaagaataaagactccactctgagcaaatacagaagctaagtaataaggggcaagaagctagacagggacttcccagtatggagcagatcccacagcaccaaccagagatgagaattaggccacacctgtaaagaggcgatgcatctgggcccagaagttaaaagttacctccatttccttagaaagaaggctacaactggaatcagttgaatactggttactgaatagttcttagagagaatgaaagttttgagtcagccattcttttttttttttttttttttttttttttttgagatggagtctcgctctgtcgcccaggctggagtgcagtggcgaagtctcggctcactgtaagctctgcctcccaggttcacgctattctcctgcctcagcctcccgagtagctgggactacaggtgcccgccaccacacctgttataaatgaccctgtctcctttgttcggtgtactcttgtacagttacaagagtactagttttttgtatttttagtagagacgggatttcactgtgttagccaggatggtctcaatctcctgaccttgtgatccgcccgcctcggcctcccaaagtgctgggattacaggcgtgagccaccgcgcccagccgagtcagccattcttaactaacaatgcttatcctgtgtagtccttcaggttttattatacaacatactgatgattaaagtcacagttccagtgttcagaatgagctgaaaatcaggtgctcttttctgctcaagcatctttggaatgagaagatccttacttgcctgtgtatacatggactgtacacctctgtaatgtgtcttacaatcagtagccaaacggatagccacaaaaagtggacatctaacttgaggttctggaatcaattggcttaagggtgtggaaattgaaataaataggtgggaaaacagtatattcaaaagtctaccacctccagccctgtctctgccttcctgcctcagccacagctgaactgcaaagagcagatggtgggtcactgccctgtagcatggacacttgccatgacctgccattgctttacaaatgtgcatcagtgactctgctccgtagctgttgtctttggatatgtcctaacatgaggagtgaggatggtccctgcagagggtcacacctgggagtcctcaagagaaaagtgagcatcacaaccaggcacttgcattctacaaagaataaatcatcagagaaacatctccaagccttgcctgtccatcagcttatttccatgtacccattcacaaggcccattgcaggtcaggagcttgtttcagctgagtttgcaataagactggtctagtggcccttgatgaaagcacttatgtgtagcttctcttcttaattaagtctaaacaaaactatgtattgtcttctgcatccttttcaagatgaatgatattaaaaatgattacatgataataatgaaactagagattggaaaaaagcccccgacatccaggagctggctgggaactcccacctgggccttggtgttctgttattgaagataaacaatttcacaaaacactaacatcagacaaaacagctctgtgaccgagatggatcaagacaaaagaagacccctccgttatcatgtttgaacatagacaatagcatgagcattgttcaaagaaaccacaacaatgaccaaacatctgttcttttgtctaacgtgactgaccactgcttctttacccataacagcattagcctggcttcatttctctcatcttatgaacaagatttattaaatatctgctatggtttgaatgtttgtcccctctgaaactcacagtgaaacttaaccacaattatataactgtgctaagggggtgagaaatcttgcccacatatttggtcaaacatgattctatatgtatctgtgagggtgtttctgggcaagattaaagccgaattggtaggctgagtcaaacagattgccttttctagtgtgcatgggcctcatcccatccatttaagacctgaaaagaacaaaaagattgagtatgaagaaactctgcctgcctgatggctgagctgggaccttggtcttttcttgtctttggacttcgagtgaaacattggctctccttgggtctagagcttgatggctttcagattggaattacacattggctttcctgggacttcttagcatccataatcatgtgggccaattccttataataaacttattctctctctctctctacacacacacacacacacacacacacacacacacattcttatataagtatatacatatataccaatataaagagatataaatatgtatgctaataaatagcactatctctctatatgtcttattggctttgttactctggagaaccctgacaaatagaaatttaatgttatggatttaatggtagtacctctccaaaattcatatgttgaagccctaaccaatgtaatggtatctggagacagggaggtaattacttttgagaggtaattagagtgagatgaagtcatgagaaggtctagtctgattagatcaatatccttttaagaaaaggcacctgagagttaacttgagtgttctctctctctctctttccctccctccctctctctctccctctcgctttctttctttctttctgtccatgtgtacataaagaagtaatgtgagtgcacagtgagatggcagccacccacaagccaagaaaagagacctcagaataaaacttaccttgctagaatcttgatcctggacttttcagcctcgataactgtgagaaataagtttctgttgtttaagcccacctcccaaaagagggtgggaaatctaaccacggtatttgagaggcaggatatttaggagataattagatttagatgaggtcagcttcctcaccatgtcatgctttatgcagcaaaaagcctctgcagagagtcctcaccagcattaaggcccttacaggtgcagcctcttcaccttgaacttgccccgcctccagaactgtaagaaataagcctattttctttataaagtacccagtctcaagtaataattatagcaacagaaaacaaatcaagacaatacccaatcatagaattactcccactttctggcagcgtcactccagagttaggtcctacttacttgaaccttcccccaaatcacctaacacaagcccaagtttataatacgtccttcccaacaccctcttatgaaggcatctcattgtttccatgttgtatgctttagctcatgacaagaataaactcaacttggtaccctacaagtatgtgactgatgggctttggctggagggcagtgatagaaatgaggtacaaggacagcagtttgggaatcccagctcagaggcttggctgactgtgcctaataccgtgcttggcacatggtaagaactcagcaaatgtttcttgaatcaatgaaaagaatcaggcagctcctgttgaaactaatgtgcatgcaccttggagctttcttgccattggccatctcaccatgaggctgttaattttgcaaaaatattcaaacataattaagagtccaatagtattaaattaataaggatgtgtgcttaggctatacaaataaaagagaaagccaagatacctttttaaaatgccatacaaaattcaaaattctttggtaaaaattaataaaatatgtctaagtccaaaatggagacaactgtgcctcttcgttaaggaatctaccagaaaactaaagacaataaagagaagtttcatttctggatataatgactcaatatggtaaaaaggtgggtccctcacattaaattattctataaataattacttaatggttatttttgaaatagacaaaatcatgtttaggtttacctggatgaataaacgtgtgagcagagcaaagaaaatttcaatcatatcaagtatcttctcagaccacagtggaataaaaccagaaatcaattccaaaaggaaccctcaaaactatacaaatacatgaaaattaagcaatctacctctgaatgattttggggttaaccatcaaatcaagatggaaatttaaattttttttcaaaatgaatgataactgtgacacaagttatcaaaatctctgggatacagcaaaagcattgctaagaggaaagtttacagcactaaatgcctacattaaaagtctgaaagatcagaagttgacaacctaacatcacatttcaaggaatgaaacaagaacaaaccaaacccaaagctagcagaagaaaagaaataacaaagatcagagcagaactaaatcaaattgaaacaaaaaaattataaaagatcaatgaaacaacaaggaggttatttgaaaagataaataaaattgatagaccactagctagattaaccaagaaaagaaagaagattcagataagttcaattggaaatgaaaatggagacatcacaactgacaccacagaaatgcaaaagatcatttgagactactatgaacaccactctggacacaaactagaaaatctagaggaaataaataagttcctggaaacatacaaccccatagcttaaatcaggaataaatagaaatcctgatgagactaataacaagcagtgatattgaatcagcaataaaaaaaaaatgccaacaaaacaaagcccagggccagttggattcacacctaaattctaccagacattcaaaaaagaattggtaccaatccttctgaaattattccaaaagacagagaaggagggaatcctgcctaacttattctatgaagccagtatcctcataccaaagccaggagaggacataacaaaataggaaaactacagaccaatattcctgatgaatacagatgcaaaaattctcaacacaatactagcaaaccaaatccaatagcaaatcgaatccaatagcacatcaaaaaaataattcaccatgataattctaaagatgcagggatggctccacatacgcaagtcaaaaaatgtgattcatcacataaacataattaaaaacaaaaaccatatgatcatctcaatagaggcagaaaaaacatttgataaaatctaatatccctttatgataaaaactctcaacacactaggcacagaaggaacatacctcaaaataagaaaagccatatataacaaacccagagcccacatcatactgaattgaatggggaaaagctgaaagcattcaactgaagcaagacaacgatgcccactttccccacttccattcatcataatactggcagtcctagccagagaaatcaggaaagagaaagaaatcaagggcctccaaataggaaaaaaggaagtaaaactacctctgttagaaaaccctaaagactcctccaaaagactcatacatctgataaatgaattcagtaaagtcttaggttacaatatcaatatacacaaatcagtagcactgctatataccaacaatgaccaagctgagaatcaaacacgatctcaggctgggcatggtggctcacgcctgactttgggaggccaaggcaggcagatcaactgaggtcaggagtttgagaccagcttggccaacatggtgaaaccccatttatactgaaaaaaaatataaaaattagccaggtgtagtgacaggcatctataatcccagctactcgggaagctgaggcaggagaaccgcctgaaccaggtggcagaggttgcagtgagccgaaatcgtaccacttcattcactccagtgtgggggacagagcaaaattccgtctcaaaaaaaaaagaaaaaaaaaagaactcaacccctttaatagctacaaagaaaataaaacactttatttttaaaacacttaataaatatactctaccaaggaggtgaaaagatctctaaaggagaactacaaaacactgctgaaagaaatcatagatgacaaacaaatggaaaaacatcccatgttcatagattgaaagaatcggtattgtggaaatgaccatactgctcagtaatctacagattcaatgcaattcctatcaaaataccaacatcgtttttcacaaaataaaaaaaaaaacataaaattcatagggaaccaaaaaagagctagaatagccaaagaaatccgaagcaaaaagatttattcttagaatcacattacccaacttcaaatgatactacaaggctatagtaattaaaacaccattgtaatgatataaaagtagatgcatagacaaatggaacatgatggagaactcagaaataaagccaaatacttacaactgactgatctttgacaaagcatataaaaacataatggattagacacacaatttaaggagaatacaacttattcaataaacggtgctgggaaaatcaaatagccacatatataagagcgaaactggattcctatctctcaccagatacaaaaattaactcaaggtggattaaagacttaaatataaaacctgaaaccataaaaattctagaagaatccctaggaaaaactcttttggacattggcctgggcaaagaattatgtctaggaccccaaaagcaaacgcaacaaaagcaaaagtaaatacatgggacctaatgaaaaagcttctgcacagcaaaataaataatcatcaaagtaaacagacaacctacagaatggaagtaaatatttgaaaattatgcatccgacaaagtactaatatccgcaatctacaaactcaaagaaatcagcaagaaaaaacagataatcccattaaaaagtgggcaaaggacctgaatggatatttctcaaaagaagatatacaaatggccaaaaacgtgtgaaaaaactgctcaacatcactaactattagggaaatgccaattaaaaccacaatgagatacgaccttcccctagccagaatggccattattaaaaagttaacaaacaatagatgttggcatggatgtattgaaaaaggaacacttacacactgctggtgggaatgtaaattagcacaatctctacagaaaacagtatggaggtttctcaaataactaaaagtagatctaccatttaatccagcaatcgcactactgggtatctatccaaaggaaaagaagtcactatatcaaaagacacctgcatgtctatgtttatcacagcacaattcacaattgcaaagatatggaatcaacctaagtgtccattaactgatgaatggacaaagatgttttatatatatatatatatatatatatatatatatataatcttgaaattttatatatataaagatgttatatatagattaatcttgtatatcttgtgtgtatatatatatgttagatatatatcatcttgaaattttcacatgcatatatatatatatatatatatacacacacacacacccccacacacatcgtgaagtactactaagccataaaaataatgaaataatgtcttttgcagcaacttagatggaactagaggccattattctaagtgaagtaattcaggaattgaaaaagcaaataatgcatgttctcatttataagtaggagctaagctttgggcacacaaaggcatacagagtgctataacggactcgggagactcagaagtggggagggtgggagggaggtgagggatagaaaactatatattgagtacaatgtacactactcagatgataggtgcattaaaatcctagactttatcactaaacaattcatctatgtcatcaaagtcacttgtacccctaaagctattgaaatagaaaaaattaaaaaatgaaaaaacaagtaacaggtcatctggacacctcctgaaggacctgcctgagctgttttacagttaactttttttttttttataagtagaaggagtagtctaaagtaattatgaacaattagtaaatacataaaccatgaatagtcatttattattatcacaagtattacatagtgtacataatgtgtgctctgctttcgtacactggcagggcagtaggtttgttatgtaagcatcaccacaaacaagtgagtcatgcattaagttacaatgttaggatgttgtccattatcacatatattagatgtatgttaaccattatagctccatcttaagggctactgtcatagatgtggtccatcactgaccaaaatgttgttatgcagcacataactatataacataaaatctggattatgggccgggtgtggtggcttacacctgtaatcccaacattttgggaggctgaggcaggcagatcacttgaggtcaggagtttgagaccagcctggccaacatgctgaaaccccatctctactaaaatataaaacttagacgggcatggtggcaggtgcctgtaagtccagctacttgggaggctgaggcaggagaatcacttgaacccaggaggtggaggttgtagtgagctgagatcgtgccattgcactctagcctgggaaacaagagagaaactccacctcaaaaaaagaaagaaaaatctggattgtgtgggtctatgtatactgtatgtgtatatatacaaacataggcatgcgtatatacacaagtatatacaaatacacacacatatatacattccagcaaacagggtccctgctgctccacagatgtaaccaatttctcccttcagcctttgcccttgctaattcatttgcctggaatgctttctccaagacgtatgcacaccttgctttcttacatcactgtatcctctgccaggcattatgttatatacccatctccatgtctttctcaagggaatttgtgctgcatgacggtgaactaatacttggtcttattcagagcacgcaggatgtagaacaattcttgacactagggagcattcagtgaaccctgctgatgggcaaatgggtgggtctggtcaggggcagccagaagacaggaggagattccaagggaactaagcagtgaccccacagtcaaggaccatatggcactcagacttctcagcagatgccagtgtggaaggtaatggctgattgagggttcagaacatcagtgccactggccacaggggaaggccatggaacagaaggaccttaaatcaactgaaaaacattgaaataggcgcaattaccccaaagttaaaaaaaataataacattttagttgcttggtagaagggtgcctcaaaacagaaggatgaagaggaggaggaggagaacagtggagtggaaacataagatttttactggccccagtaatttttcgaaaggctgtggtggctcatgcctgtaattccagcactttgggaggccaaggcaggcagatcaactgaggtcaggagtttgagaccagcttggccaacatggtgaaaccccatctatactgaaaaaatataaaaataagccaggtgtagtgatgggcatctataataatcccagctactcgggaagctgaggcaggagaacctccctcaccaggtactgagctccctgctgtaagccaccatatgtgcccaggtccgagtgctgccatccaccttcagctatcctcccacggagctgttctgccccagcccaaagcatgcactgcaaatccctatagcttctcaatccagatctaactcctcattcccccagagccatttatttcagcaggattaccgaggggaacactgtggctgaatcgcactccatgaattggagatgctgctctctccttagctaattagtttggatgcctccagctgcaaatgcaaaaaccctgacccacattggcctagacagcaaaggcaataaagtcccaggtgatctcatgtactgccagacatcatggggtcaagaattaaatgggataaacctcttttgcagagtcccgtattaagaatacggaaatcttctccagaaactcctcaaaagaattgtttttacgtttcattgtgcaaattctggttgtctgcccatccttcaatcaaagggagctgctgcgtttgatgggtcccggccagggctcacacccagtggctttgatggattcggactcttctgcttaggcaggggatctggcctgtggtgggcttccctccaacacaagaccgcaaaagagttctgttgtcactgagtgtatggtgtcccggggctgctgtaacaaagttccacaaactggggtgcttaaacaacagcaatttattctcacatctttctgggggccataagtccaaaatgaaagttctggcagggctggagtccctctgaagtttctacaggagaccccttccttgccttgcccagtgtctcttggcctgtggcagcataactccaatctctgtctttgcccagctatgttttccatctgtgtctgcacccagattgtccccttttaataaggacaccagtcatattggattagggatccggcggcctacttcagtagagcctcatcttcactaattatacctgcaatgtgcaagtacgctatttccaaatatggtcatataaggtactggaggttacaaattcaacatacaaatctagggggtggacgggaaataattcaatttttagcacagagaaaggagggaaattgaaactggagcagggatcaaattgcatctgctatatggaccctcctgttttacaaattccttttttaccccagagaatctttagctggtggaacttcaggctgacttaggaagggaaatgcatatgtttgggtggagctcaggatgccctaccaagggcgtggcagctgctgaggggtttccttcactaagcaatgtcccctccagcacacttacgttccctggattcttcccattctctgcttctgcctccagaaatttatgcttaaacaattctggggaccagaagtgcaaaatcaaagtgctggcacagctgcagtccctctgaagcttctgcgggagactccttccttggaaaaactcccagcaaagttgcagacgtatctggcaactggacttgagagtgaagcaggagggatctgagtgttgcatatgtgcaggataaattgttgggggaggactgctgggggtgctggtgactgaatttaggaaagtgcataagctgggtgttcacaaacctgggacacctcatattctatttcaggcactaatttgtcatgtttgggaaggacttaaactataattcagaaatgatgattgatatggtttggatctgtgttcctacccaaatctcatgctcaattttaattccagtgttggaagaggggcttggtgggaggtgattggctcagcagactgagtgatcataaagagcctgggaaacatgtggggttaattcaaggtggccaaagcttcaccatggggggcagcttgggggccgcttgggggcagcttggggctgggctacttcctcctccaagaagtatcacagagcaatgctaccgggactggagatttccatttagctaattaggggttaggataaagatttgtgggtactggtggcagtgggtgagggcagaaagtaaaggaggttgactatggattatccaggcatagatacacatgttttcaacagaaaaggagatgggttattatatgtcaggcccaacatatctgccctggcaatggcagggcttgagagtggcctgaggtcaaatcataacatggagatctgtccagaaatagccaagaccctgcagacggtcaggtcagagctgagtgagttggtgcatgcacatgtgtgcacttgcattctgacagtacagaaatctgatgggcacagcgacccacagaccttcctggattcagcatggaggagggagaccacattacataggctggactagagcccacgggctaactttgggagcttgggggttcactagattccaagagtaactgactctccagggaagcgcctgttcctgtttgataagcggtgctcttttgtcctgcatgcagggatcagaaaggacctatgcagagcagctcacaaaagcagagcggcttgttcactgtgggccacaggttcacgctgaaaccagtgttcccggaaacacgaggcttcagatcagccagtggcagaaagttgggagcggggaggatgtaatttgggcatctgagacaaaccttagggatggctatccatttaagagattcagtgggttttggagctgtgaaaggaaattaaattttgggaccccaaattcgtttagccaaagagaaaagtcaagctgggaactgggtcacgcaaatctgcctccaccttttggttcctaaacaagatggctacaagatgaaaagctacacgcttccctcatattttgcccacaaggaaattcctggtgagctgttaaagcttccccatggcaatgcaacttgatagcctatctttacaggtgcagtcgctctgcccaccagacacaaatgtataactgaacgttcccctctccattttgtctgtggtatgtaaaatgcacattccccacagttttcctctgccccttttgtttatgtgaaagctgtgtgcttctcaatatctcatcctttcccctttaaatttggagccctcaaaatcaccttcggagaaaggaatagacctgtctcctgggagcatcctcaactttggcaaataaatatcctaaaatgattgagacttgtctcattattttcctcgattgacagagctattttttttttttttaacataaagtcattccctgggcctcaaacagttcctggttgggggaaggggcacataagtggcatagcttctgtagcccccgatcggcctggagcatagggcaggatgtcatcaccagaggccaaatttgattgcaagcagagcctactccctctgccttttctgccaagcctcctaatcgttatctcacatgataattattttgggtaaaacataaaccagaattgtgatgacagtgtagactcacagacaggaaccccaacagagctggaaagatttgcatgcagtaaccttccatcccattgattgctttccatgacaattccatacatgcttgctggctttcttctttgcctgtggcttccttatgcttgattcaataacaacaacaaaaagatgtgtgtgtatgtggtgggtgtttattgttaaaatgctttatttttggagtgatgtttcttgaaagcagtaagaaaatttcccatataggagaaaccctctgtgcagggttcgcaggatctcacagtgagcccccagaagcaggtcctatccggagagtttgggtctttaaattatgtttacagccagcaccaggccatcctgggagtccagacttgctgcaggagcagctgtcttaatttcctgacatcatccaattagacagcaaggtctcccctattgaatttagaaatatttgcagcccattttttaaaatgacttacagaaaggggagagtacttaatgtgtttatttagaccagtaaactctcctttatatctattttttttttcagtttgagatcctaaaacactttactgattgttcttaaacaactagggttaggcaaaagacattggccattagagttgctaaagacaccactccagggctgagctttggacgagtattagacaaggatgaaaatacctccccatgggccatggaggtcctctttcttcttcccttttcctagcctctggccttttaattttttttcagaataactttctggaaatgctcctatgcactgtgccatcaatatacattttctctttctttccaaccaaagaatcatttactctatgtatgtattggaatacttatttagagtatcttatgtcttacaatgtgttttcacatgtgttaccctgtttaattttcatgataactctatgaagatggcatagttcttcctattttctaggcctagagagataaactaatacaaacagtcatgaagaggtgcatttaacttatttaaatccacctgtccatgactagcttgtattagtttaagaatctaaaatttggccaactctatcatctctctttgaagtgtgttcactttaaatgttctcctctcccatctcctccatgtactgtagaacattcgaacagagagttactcttgcctggagtctttcagtttcttgtatctggcttctctgtctcctgtccctggaataccctatctagcctcaacagtcctgccttttgaaggcccttgtgtctttaagaccgaactcagatgctgcagcttttcgttccgtagtttcttagtcaactggggctgctgtaacaaagtgccatacattggtggcttatcaacaacggaaatgtattcctcacagttctaaggctggaagtctgagatggggctgccagcaggggcaggttctagcatcctcctccaggttgccaccttcttgtatatcctcgcatggtggaaacagagaacaggagagctctctggggtcccttcgataaggacactaattccatccctgagggctccccctttgtgacccaatcacttttcaaaggcctcagattctagtatcatcacactggcggtaagatttcaacatatggactttgaagggacacagacattcagttcattccacacggtcactgattctacaaacagaagcaaatcataccctcttccatgaaccctggtgttctgggctctgttccaccagttgtgtattctgccagacaggaattggacatatatccactcaattatccccagagagcaaaagctcctagagggcaggggccacctcatctccttagtcctccctgatgctgcacaactgccactgagtaccgagatctggagagaggacatatgggggcatcgtccattcttgaagcctattttccatgaagctttccttaattcccccaagctgacatttccatcctcctctgaatgtcacagacatgatccatgtgactcttcaccctgcattgtaatcagtggcttctatcttcttcctggttatctccccttccaaaacatgaggcttgtcactcatgagggtaaggcccatggttgattgtacttgtatccttcatagggtcttatatatattgggtcctagatatgtgtttatggactaaaaaattgtcttatgcatttaaagtctattaaaataactgcaaaatacacccctttccttggggaaagatggaccgactctggtcaacattgctcctcagattttaggtttcctttataacttttaaaaattaccatttcagctctggatttaaacagtaccacaattcgttatcaaattcttgcacatcatttcctccagagcatacgatttaaaagtcaaaaactaggtattgagtatgtgcaaaatatattccaaaacaaccccatttcataattataatccatttcacaatataaaactttaataaataaacacttggattttttttgttctgttggaaatagtggactaactaaaataaattcttcgtgagttaggatggatacttgtctgtttagctagcctttcaatatcatacacacacaaatacacacacccctgaatgccacttttaaatctcattcttctaataaatcatatagtagagacttttccaaactatccatagcagaattaaagttaaaaaaaagaggaaatccaagggccaggcatagtggcttatgcctgtaatcccagtgctttgggaggccaagaggggaggatcacttgagggaaggagcttgagaccagcctgggtaacaaagtgagaccctcatctttataaaaaattaaaaaaaaaaaaagctgggctcagtggcatacactggtagtcttagctactaagaaagctgaggtgggagaatcccttgagctcaggagttcgagggtgtagtgagctttgatggcaccactgcactctagcctgggcaacagagtgagcctctgcctcaaaaaaaaagtgggaggggagtctgaataaagccttgtaatcaagaagaaatcacagttcattcgatggaaaattccataaatgggcataagccattcactgtaaactagatgcaccatcattttgttaataagcacaactcagtaaaactggttcactttatatcctttccttggttgccagttaccaatgtatgagaataatttcattataacgcacctttttctatatattgggccagcagcgccagcattaagcctagtcttacacatttctgtcttgtagttgttcgctagtcacttgattttaaaatgatccttaaaaggaaatccatggacaagacagcttgcaaataacaaaatgcatgacaaaaggctttgtaaagagcacatctgagaccatgtattgagtttttccacgggaaaatcaacagggtagcaatgtgggtgttaaaggcagagacctactcatctgctaggttgcccagagcccataccaatggctgtgagaaccaaaggaagagaagaatgtggctcatgctccacacacaaggggccctgggcacactgtcaacaattagctggatgtttaccatcctcttcaatcatgtttccagaacaacaaaactttaaacccagctatatcacaccaacgggtcttcttttgtgttgcttttaaacaggtatgtatggagacaattgaaaaaggaagcccccagagacctatgtatttaaactaggtaaaacgaagcatttcttctctcttacttttaaccgtgaggtacatggacttgctgacgtctgcgcccacatcgttgctgaccttgcagaggtagtagccactgtcttcctccacgacatgcttgatcagcaacgacccattgctgagaacttggattcggccatttagggcaattggctggaactggggaaccccagcacctgagacagaaaaagaaagacgagcaatgatgcaaacgagagtaagtatgggaagacaacgagttcaagtacacacagactcataaagagatgcttcacactgatcccataaggcagtcacgggatacaccaggtttttctttctttcctccagtattaaaattcttgtttagagagaaaagcatttatttaaaatgacagtatctcagactctgagataaaaactaacagaacttacagatagtttctctacataaaaagccaaatttgatgagtgttaagtagctgataaattattcaaagaaatcacagtagaacaaccacagaagcagacaactctcatggtgctaaataaattccttgtgttcccagggacttaatatgaatgtaaacaaggagtgctccagggacatggcatttgaagtctttgctcactgcacatgtctgaggctacaaagagaataggaatattgcaggtttctctttaacggtggttatattccggtctagacacacaatacaccattaatatcatttaatgttatttaaataaatacatcagattagtgcagtaagacagcacagaattaaaacacctctctcctcagagtgcttccatgcaaggagggaatggcacagatatgatatgctattataatgaatgtggtatgattcatatgaaggatttatatacaactgggtaaaaaaaaaaaggattttagaaataatgaaacagattatgaaggtcctagaagacttctgggaagatggtgactggatgaacctgccatgctgcctgcttctggcctggaggagttgggtgggctgggagaatgggattcaggccttgaaagactctcccagggcatttttcttctctggcctgagtatctggggacttgaggggaaagctctggggtgaggatcttcctggaggaagctcaacgtttgggccaaagatgtgttctagagagaaggtgctagcttcctggcccaagaacctacacgggagctgaacaagtcagacgtctccacaggcctcaagcaggaaacttcagactttgcatctgaggacaggagaatgggagacacttcctcttgctgtctccataccctaatgacaacttgtgtattggtctcactcgagctcacaatggcagagactgtggctgtgccttcctttcccgtgtttctggtttagatttctcagcaacttgtctctagccccactgaagagacgagagaaattgataaggtacctaaggggacctttcacattgaatgaggagatcaagtagaatccccacaacaggtggttcccatcaaaatggaactgctagaggggacatacgacaacctgaatttttttttttttttttttgagatgtagtcttgctctctcacccaggctggagtgcagtggcacgatttcggctcactgcaacttccgcctcctgggttcaagtgattctcctgctaatcccagctacttgagaggctgaggcagagaactgcttgaacctgggaggcagaggatgcaatgagctgagatcacggcgctgcactccagcctgggcgacagagtgagacttcgtctcaaaaaaaaaaaaaaagaaaaataataagaagaaaataaaagtacacgaatgtagattgataagaatataactgtatttactgacagataacatgattttctacatagataattgaaaagagtaaacaaaaaagttgctataactataaaatgagtttagcaaagtcatgggatacaacatcaatatacaaaaatcaatgtcaattttatttatgtataatagtaacaaccaattgggaataaaaattaaaaagaaaatatattggcaaaaaaccataaaatatttagaataaatttaacaaaatatgtgcaagaccagcccactgaaaattgtaaaagttgttgagaataactaaataagacctaaataattagagagttataccatgttcatgaataaaaatgcttaacattttcagaaagaggttggtaatctttctgtaaaggccagagagtaaatattttaaatttagcaggtcatacagtctttgtcacaaatactcatctctgccactgagtcatgaaagtagccatagaaaatacagaaacaaaatagcatgattgtgtttcataacaacttattggcaggccatgacagctcacacctgtaatcccagcactctcggagaccagggtgggggcaagacttgagaccaggagtttgagactagccagagtcacagagtgagccctcatttctataaaattttaaaaattagctggacatgttgggtcatgcctgtagtcttagctactcccaatgctctgggaggctgaggtgggtttgaggttacagtgagctccactgtactctagcctgggtgacagtgagatcttgtctctaaaacaagtggaagaggaggaagagaaggaggaggaggaggaagaggaggaggaggagtcttcaaaaatactgaatctgagaagaattgatctttgtcctagcatatagtgataaatgttggtgatcattatgaggaaataagatagtctaaaaaacttatttacaaaaacaaaaacaggatgtgggccaaatttgaattgtggcccatagttttctgatatctgttttaaaggtaattaagagaaatgtaaatgtaggataattgtacatttagaagagggaacatctactaacaaaactcacatgtttgcattagttctttattacatatctaaaatatgaattttcataaaatgattctaagtagaaaaagtttttaaaattcttcttttcataaggaattcaaagtcagggataaaaacatttaaaaacataacagtattttattatctcttcaatatgttttcctcacttgagctaatgagtattttataaagtgagactaaaaggacaaccatttttatccctaaatctgctccctccttggaaataagttatcaaaatgtacaaaattcagaattacaccagcaacttgtataatgtagataatttaaaacttaattcatatgagacttttatgtggccaagaaacatatgaaaaaaagctcatcatcacttgtcattagagaaatgcaaatcaaaaccacaatgtgataccatctcatgccagtcacaatggtgatcattaaaaagtcaggaaacaacagatgctggagaggatgtggagaaataggaaggctttcacactgttagtgggagtgtaaattagtttgaccactgtggaagacagtgtggcaattcctcaaggatctagaactagaaataccatttgacccagcaatcccattactgggtatatacccaagggattataaatcattttactatgaagacacatgcacacatatgtttactgcagcactattcacaacagcaaagacttggaaccaatccaaatgcccatcaatgatagacttgatcaagaaaatgtggcacacatgcttcacggaatactatgcagccataaaatagatgaaactggaaaatggatgaaactggaaatcatcattctcagcaaactaacacaggaacagaaaaccaaacacctcatgttctcactcataagtaggaattgaacaatgagaacacatggacacagggaagggaacatcacatactggggcctgtgagggggtgggggcaaggggagtaagagcattaggacaaatacctaatgcatccagggcttaaaacctacatgataggttgatgggtgcagcaaaccaccgtggcacatttatacctatgtaacaaacctacacgttctgcacatgtatcccagaacttaaagtataataattaaaaaaaaaaccttaattcatatgaaagttcacagcagattttggtgccttttttttttttttttttgagacagggtcttgctcttttgcccaggttggagggcagtgacaccatcatagctcgctgtggcctcgaactcccgggttcaagcaatcctcccccctcagcctcccaagtagctgggactataataccggcagacaccaccataccccgctaggcctttaaaaattttttgtaaagatggggtcttgcttggttgctcagactgtctgaaactcttggccacaattgatccttccaccttagcctcccaaagtgttgggaaaataggcacgagccattgttcttggcctcaaatgcttgagaaaaaataaatacatcagtataagagtggttgattttgaaaaataattaatgaaagctatttactagtttacttattgggatttaaagcatgagaattttggattagggaatctgaattttttgtcaaaaattcaaacagtaaaaaagtaaataccttcagagagattacggactttctaatatcttctaaacataaaataatgtagccttcgtttttatgcaaatggactttattaattactgagcacctgtactgtgacaaatactgggtgaggagctatggctaaaaagatcatgactgccatctctttttcttcttccctctctccctcccgctcagtcttaactctggggaattccagctaccatgttgtgagctgctctgtggagaggctcccatgggaaggaactgggagttggtcttcagtcaacagtctgagaaagtaaagcttatcaaccatcacaggagtgagcttgggagaagaccctcccacagctaagctttgaaatgactgcatcccagccaaccccttggctgcaatgttgggaagatggtgaaccagaggtctcagctaagccacacatgcattccagacctacagaaatggaagctattaaatgtatactatcttaagccactaaattggggtaatttgttacaaagcaatagattcctaacgtgtaaaattaggtaagttacataatatttcagcttcttaacttgtaaaatggaaataataatagaaccttcattatgggatggtagaagcactgaagttcttgaactatgtattggtatggcttatagtaagcaaacaacattgttgtgctttctaacattctctttttaattatttaataattttaagattatatggctgtctgtctttcccattccacaagaatagggaccacgttgcaatgaatgtctccactcatcaatcagtgcatcagtggagagaaatatatatatatagcggtaggcaatctgtatgcttaattcagggagaagaatttcggaccaaaggtgatgcatattcaaatcttaaaatatattaccatatttacaataaactgccttaaaaatgtacaaacgttatctccttcagtgctagctgagggttaattttttcctcatacatgtatgctattaaacttttaaatctgcatcaatgctatacatcactattttaatttgcacattttggcggattttttttgtatttttgtttgtttctgtttatagataattttgagcatcatgaatgtattggccatctgtatttgttctttagtaaacagcccatttatcccttacccatttttctactgagcttttgtctttttcttcattttccaaagcactttgggttataaggaagtgtttctatgtaattattttacaaaactctttttttgttctcgttgcttcaatcagaagaggatgttgaatattatcagctagtttttaaccatatattgagataatcatttttttctcctataaaattagactgcatttttaaagaatttggcttttataaattatcaaattacttcttgtggatattgtgttcattagtgtgaggataatagatttattggaagttaaaattaaggaaaaagccttcaacttttatttaagtgcttaaatttgtaacacactttgaaaatcagtaaaggctattaatgtcgttcccaaagttgactgtaaattgagaatagatttagtccaatacacacaacctgaaaactcaaccaaatataggattgaaaaaatataactataagataggtaatctaggccgggcgcggtggctcacgcctgtaatcccagcactttgggaggccgaggcgggtggatcacgaggtcaggaggtcgagaccatcctagctaacacggtgaaaccccgtctctactaaaaatacaaaaaaaaaattagccgggcgtggtagcgggcgcctgtagtcccagctactagggaggctgaggcaggagaatggcctgaacccgggaggcagagcttgcagtgagccaagacagcgccactgcagtccagcctgggcgaaagagcgagactctgtctcaaaaaaaaaaaaaaaaaaaaaaaaaaaaaagataggtaatctaaaaatttcaaattatataaaactgtatttaagaaactgaaaatcaaataacatgctggtgtggtttgaaaaatttacatgaatatccatgtcaacaacacattgttttccttttcttaaataattttcaccagaaaaatgcttgtaattgttgaaacatttatattaaagaatcacaacataaaattaactacaatgctaagtcgtctcaattaaatagcagaaaaggatgatctgtttattcctatctagactgaagtaagtttctttattactaaaaggtcctaatgaagatagaaataaagtttcaaatgcatttaagaaaacattaaatcttttcttcatcagaaaaatgaacctaagttgaagggttattgcatctgaagatctaattgtggttactaaatggaataatagtgaacacactgccaactgattcatctactatgaggactacagttccaagggctagcatttgtttaattggagggaagtagacttcgccagggtttgacagaattatttatcagtcatctactttagattcatctttattctaaagagtaaaatttaacccaaagcatcaatatgtaaaatcctgtaatcttcttagcacaaggtaagcactttaggtaattagctagaagatacaatgtggtaaccagcagtcattaattaaaacactgccaattttctgtggctagcaggggtcaagtggggacaatttcaatgctccgttacatgaaaataaaatgttaaagcattatgtaaggcacatactgaattgctagttatattaattctgggtcacctttcttatttattgcaaatatatgcatagctgtgttcacagggactgagagtatggggacagtggaaaaagaacggcagattgtcaccaaatgagcccactttgaaggcagcagcaaataagaaaattgtttcaatttttttccttcactgttaagtctttgctggtctgtagagagggcacttggataagagtcaaaagggttaggttctcatgctctctgaaactacccatgccttacagcaagtggcttattttctctgcatccttaatttcatcatatatgaataaggagaataatccatttacatatgatgtaggattgttgtgcacataaagtgaagcaagattgtatgaatgtgggtataaatgcctgcatgcaaggagagcttggtcaatgagctcatccagaggggtccccttgtagggtgaaataagactgaagagtcgcaggaccatggaaaggaggtctctttagcctcaccaatggtttgcacaatggtcaggcggtaagctgttctttcttttcaccaaggaatcaaacacaatccctttcatccttatggagagagtggtgttttcctcaagaatgcatttgtttttcttctttaggaaggggggtttcctctctgagaatagttgggggattgcaggaaagcattgggtaaaaagatagaggttgcaatggaaagataagagaaaaagcaagaatagcaacagcagttgcacctaaataaggtttagtagctgaaatacaatgcttattcagtgaaggagtgctgaagagttctgttacaaagaagaatcccgaagtggacagaggtatagtcctgagacaccactggcttggttccaggctggagagctatttccaatccctgagaaagaagcttccaccactgtgcaggtaatatttatgacactgaaagtttgtgtcagatgctgtatgttgatctttagcactaccactttccctctaaactctgccctaaattgcagggcttgaaagcctgaaaactacattccctggctttgttactagattctggtttacattttaccagtgagaggcacttaaaaacaattttgtaggtgcaagggtggaaaagccattattttgctttagaagcagcaaattgatgcatgggtcaaccccaaacatcaggtttatggctgcctgtgggagaactacaaatcactgcttgagcactagaagcagctgttagcagtgacgggagaagcatcttagttcctacacttctcaggtgcttaaagggccgcgcagtttgtccacgcttcaaaggattttgcatgcccctaattccctttattaaatcccttcttgataacacaccacaccatccaggtgtgacaccgtccaggttacttcttttgtaaatgtgcacataattgtgtccactgtgcaatccagtcatctttccttaataccttcatttctatgttgaagaaggctatccaatgacaacaatggaaatttcatggtctagattagtgtctaatcaggatttgttacaacttgctagtccactagcacttcaatgtctaattctgtaactaatacgtaattatgtaactaatacataagaatcctttttttttaaatcagccagagggaattggcccttcactcacttatcagataattgatccatgaactgaacacaattcagcactcgtcaaggggtcatgtgatattggaagtggttgaggtgactcaattatgcagattccaccagtgctttgccttgctcctgggaggagccctgcagcagtgtctaccattcaaggtctccagccaccgtttccctggagcaagagccccccaaacatttgtcttcagtgtgactgcctacacctagaagaaggcttccagaaagtttcccaggaaataaatgagggggaaagatggaggagtgctgaaaaataaagaaaggaagagcaagatgggccccagggttgactgtcctggtggctccaccaaggctcagggtaattacacttccttaggtgaggaccctgcagaggtcctgcagcagctcccagggccactgagatgctgattagggtagcacagaggaaggcaggttttctgctctgctaaggtttttcctaccatcaaaggaagaaaataaaacaatatatggaacactcactttctctgttcagcttacaacttgttttcaagaactcattatttctttgtgaggccccttgtctcttcttggggaacacacaacacacaagcagagctccttttgttgtgcatgagggatccatatcggactttgaacttgggtttatttttaccatgtgtgccatagagagatgttgccttcttctcgtttttggattatttgaattctttccccatattaattcaatatttgcatcttatcacctaattggaaatcggggtgctgggtgagagccaggacttgatagcctggatcagaggagtgcactggggcagagcaggggatcactgctgcttcaggaaatgaaggacatggaagaggtcaaaaccatgggtgtggagtcttggggtgctctaaacaacacagagcaagacaaatggtgagtctaggaatgggcatggtgagagcactgaatagtgtgcagatgcacaggcaggggtgggacagtgggagggcagcagcctccaccaggtcaggcttgtggtcagaagttttattctggtgatccacactaagaggattaagatagggccaggattggagccactggtcccaaggagatgaccaagacaagggtcagagacaatgcagagacccaatttctcagaacagggatgcaaaagagacacttgtctgagcaaagcctgtggaactggcattcaaggtcagagtgagtggcagcaagggcaaaaaaagaatgagacgaaatgccttggacactgaacctgggggcactcaggcacgaggctggcgcagagtgaaacatgcaagggcatacagagcaggacaaagggaccagaacttggggagaagccttggaggacctgaaaactcagtatcatcccaactgggccctatgaacgtgctccctattgagctattttaatataaaccccctgctttcccagaggaaaaacaaaagagaattttatttaagcaaatttctgtctcttgataatttgcttctttccagacttatcttttgaatgtacaacctgcagtgtgttcagcagtgtgatccacaggtgatcctcagtgtgatctgcagtgtcatctgcagtgtgatccacagtgtgatccatggtgtgatctgcagtgtgatccacaggtggatctgaagcgtgatctgcagtatgatctgcaggtatctgcagtgtgatccatggtgtgatctgcagtatgatctgcaggtatctgcagtgtgatccaaggtgtgatctgcagtgtgatccacaggtggatctgaagcatgatctgcagtatgatccacgttgtgatctgcagtgtgatccatggtgtgatctgcagtgtgattgcagtgtgatccacagtgtgatctgcagtatgatctgcaggtatctgcggtgtgatctgcagtgtgatcacagtgtgatctgcagtgtgatctgcaggtgatctgcaatgtcatccacggtatgatccacagtgtgatctcaaggtggtctgcagcatgatctgcagcatgatccacagtgtgatccacagtgtgatctgcagggtcttctgcagtgtgatctgcagtatgatgtgcagtgtgatcacagtgtgattaacaggtgatctgcagtgtgagccctctcttgactgctgaggaagggactgacttggtcatctcaccagagaggtctgaaactggtgttggcagaaaatctgctctagaattaacctgcttgagggacttaggcttgtcctttccctcatatttctcatggtcttctgagacataggccatgaggactacagaaggttccagggatgtcccctggacattgggagggaagttgtgggcaggatcaaggtgagcctttccagggcatgcccctaaagtaggaggggactccagagagggtcacctgagcagtttggccagtattgagcacagcatgtgttttcccctccatcttgcatggaaacgtttagttaactgtctggagtgcctagttttatttctatgaatctctcaacaaaagaatcaagttcctgttgccccctgtgatgagtctataaccacaggggaggatttctccaggtgggctgacactgagcagaagagggtgcttttagggccctagtggtaagggacagccaggccctctgggggactgtgcgtggtgagtgcagaagtgacagcctccagcagcttgtctgggtgcagtaggagaaggaggagctaaagcaaacctgtgtgtgcaccaaataatggtggattctctggagcctccagggaaatatggaattggggaaactacaatgagcagaaaggacacaggaaaaggggcagggagaaatacaatctcaagagagacaggaagaaatagagtcacacaccattgcagcccttagtatgagctacagagtggggaaaatagaaactcctctaaattaagaacagcattacccttgctgggagaagaaagagatgtggacagctacataaggacaagctcaacaaagattggctgtagacagctcttgacccctttccgcccagaaaaccaaggaggacaaaagaaaaccagatgccgtagcttataaaaattcactaccactgacaaatggaaagaatgcaataaaattattaatgttcataaaagaaaaacttggatacatgaaaggactatccatggtattggctgggaagactcaatattctaatgacatcagcattcttcacgttaagctttaaatttatgatcctccaaattttccagattttttggaaacttgataaagttatcttaatatgcatctagaaggaacaaacaaacaaaaatccatgcagaaaaagcaaggacatttttgaaaaataaaagtcacaaggggagtattgtcaaaacagacattaaaatagaaggagataaacttctaatacgtatggtgctgaacaggcaattgagtgtaacagagagaaggctgaaacacagactccagtattcacattttccccttagacaataaggtatcgcaaatgaaaaagtttgggctcttcaataaatggttttaggacaaatggctaaccatgtaagttcatgataatggcaataatgatattaataatagctaatacatactgactaatggctatgtgccagaagccataataaatgctttctatgagtcatcttactaaatcatcacatttatccccttattttatctgtttcagctgcaaggatgctgtggttcatatggggtaggtaatttacatgcagtcacccaaccagacagggttgtattatggctggggtttgaacttatagcccagtctcctaactgatgatttctactcctcctcctagattcctactttatttattttactaaaatcaagtccaaatttaatgaccctttgtatataaacaatagaatttcatatttgaagatggaggcataaaccagcacttcttctcttcctgggaacaacatgaaagcaaatgggagagagaagcctagaaaaatgtaacctctatttcctatgaaattagaaaatagctaaacttccagctacagaatgggtaaatgggcaaccaacagggtaattgagcagaagagcatgcaggaagatgagggaatcagggccaccgctgtgaacttcagaagtcccagcagagtgggtcacaggtgagagccaagcctccatcagtgaaaacagtgtgcataggtgggtgtgggtggcacttccccaggcctgatgtggcttagaattttagaagtagggttagctgaggaatcaggcatttgtacacaacaatctttttctggggacatggattttcttcaaatgtaagtacagtagttccccctcatccacattttcactttccatggtttaagctacctgaggtcaattacagtcttaaaataggggagtatagacacataagatatgttgagagagacagagacagcacattcacatagcttttattacagtacattgtaataataattttattctagtactcataatttttgtcaatctcttactgtgcctgatttataaattaaactttatcaggggtatgcatgtgtaggaaagcgcatagtatatgtagggtttggtgctccccaaggttcagtcatcccctgggggtcttggggctgctgtattcgaaaggaaaccaagacctagcaaagatacaataagcaaaatagaagaaaaaaacagaacaagaaaccaggtattacgacttagatgaagactgtgaataaaacagtcacttgtctataaagccatggctgaagaagggtgaactgtgagctggcagagctggagagaaagaaggagaaaaaatataaactcacagcagtgaaggcagaaccggagttggcacaaagaagaacagaccttgctggggaaaagacatggagaacagaaatggaaaaatatcgaacaaattaaaatggaaatcaatgagttaaaaaaccagagagaaaatgacagctacagagactaggtggcaatcctatggaaccacaatcagagaccctgaagaagaaaattaaagcagggaagagaacacttagagatacaattcatgggaaaaatattttttaaaataacctgaatctacatattaaatagatgcaccacatctatgggaaaattgaccccaaatggaaaacaccaaattatagactaaaaatttaccagacttcagggcaggtgcggtggctcacgtctgtaatcccagcactttgggagaccgagttgggtggatcacgaggtcaggagttcaagaccagcctggccaatatggtgaaaccccatctctacccaaaatacaaaaattagctgggcatggtagtgcatggctatagtcccagctgcttgggaggctgaggcagaagaatctcttgaacccgggaggtggaggttgcagcgagccaagatcgtgccactgcactccagcctgggcaacagagcgagactccatcacaaaaataaaaaaagaaaataaactaccagacttcaaagtcagctctttggtgcacagaaccaaaaagattaagttccttctacagggaaatcaggcagtctgtgctccctccaaggagacagtgtgagccgccaatatctgtcctttgggtgtaaaaaggcaaggaacaaaccattgcaaaccagaaagaggttggaatattcttcactatgtccaaataactcatactgagcacaaaatcaatctaacacagaactggcaattgcaaaagttgggcatatggctgcagaacagaacatagagggtctaagctctgacaatgcagaaaatattcatcaaaatctaggatatttagaaaatttatcattgcttatattggaaattgacagctgtatctgcatagagaggagcccaaaaccctgatcttaccccagccacaggtctgccctcctggagtcgtcctgtctgtcaccggcacttccactatcctcactgcctggggttctccccttttgtcacacccatagtatgtccatcactcaaagacattcagaatccatttgtccctcctccactgcagtcaccctggttccggccacatcccggccaaggccttagaacagctctccggctgaaattcctgtccttcacacagtctgctttcaaaacagcatgccagtgtgatccttttaaagcatgaggcagatcacaccatctctctccaattacccagctagcctcctagcttctggcttcagcacagcagcagctgaagagaccgcatcaccatcaccactctcattgctcaccatacccactccccacttgggcagagccaggtccttacaatgactgatggggacccagtgcaggagtctcctctcccaggacttcctttcactaactctgccacagctgtaatgtcctccttggtgtttctggatcattccaggcatcaacctcccggcctcgccccctacccccaactcttgggaactagctggcccctcaccttccggtctccctcggaggacaggagcacaggactcatctgtctttaagtctttcctcagactttccctactcctggggtattttgacaatgctattttaaatgcaaactactccccattgtcctccagcgtcaccccccaggcatgctctgactcttctttttggacattcccacaaccaagtttccctgaaggtcagagactctatggacagccagagagagcaaaggaggcccaggccaggccccaggctgatgcatcatctattctctcgcatttgcagtccctcttcgcttctcagcaggtaacaaggagatggccctgaactattttccctccagtataagtgacatacatgcaagagaatggcattaagctgtggacttctgggagtacaggtgagacccacctcagaatgaagccctgattttttttttttaaatctcttttaggcaagaggcctcatttgttcatgtaaataaataaatcaaaaaagagaactgaatgtctcagactttgtgtatctagacccaaggtcaaaaatgtaatgactttttttttttttttttttttgtagcaaagattgtttcatttctacaatagctacctttaaactgcagtgatttaccctggaattctgcctcccctgaattaaactgttgcatctctcaaggaaacaagctgaatctgttttgtttatacagttttgtcatttatgagggagctgcacttcagctcttagtgatcatttcattgaaagaaaacatgttccataagcaaggctaaattgttcttaagaaatagatttactgcttgcataattaaaataacaatataccatatttctctatcagattggaaaatgtcaaaaaaaaaaagcctaatatccagtattattttggttataagagacagacactactgcaaactgaggtgagttgtgtaaatgaataaaatgctggcaaattgtcaatacatattgaaagttataaaaattatttactccttgagccagcaactctacttatagaaatttatccccagggataaatgaacacatatacaaagataaatgtgacagaagtcattagaagtcattatgatatctttcttttccttttttttttgagatggagtctcgctctgttgcacaggctggagtgcagtggcgtgatctcagctcactgtaagctccgcctcccgggttcatgccattcttagcctcctgagtagctgggactacaggtggccgccaccacgcgtggctaatttttttgcatttttagtagagacggggtttcaccgtgttagccaggatggtcttgatctcctgacctcatgatccgcctgccttggcctcccaaagtgctgggattacaggtgtgagccactgcacttggcccattacgatatttttctaaaagaaaaactggcaaaaaccaaaaatatgacattcaacaatagtgttggagatatccagttgccaggtatccaacaccccctctgacttaggaaaataacacacattatgtccatgatggcttacggaccctttatagccaggggcgacccggccagcgatccagagagatgctggcaaaattgatctgtgatgcacttctggaaaggaccttaaagggaggtgagtcgtgtgggaggggcagccatctccctttgctcttcctcctacagggaaatgtgaaaggaagttgacactatagcttggtggccatcgtttgaggatgaagaatgctgctaggagaggcagaactcttcctaacacataaggagtttgggtgcctgatgacttagccaagccaacaaactagtcctgagctgtcgacatccagagtcctcttatgagaaaaataaacccttgtgaatttaagtggctgaactcaatcttaactaaagtaattagataaacgtaattattgatgtactacaataaacattacacagacattaaaaagtcacggagttcaaggccagcctggccaacatggtgaaacctcatctctactaaaaatacaaaaaaattagccaggcttggtggtgtacacctgtaatcccagctactacttgggaggctgaggcagaagaattgcttgaacccaggaggcggaggttgcagtgagctgagatcgcaccactgcactccagcctgggcgacagagcaagactctgtctccagaaaaaaaaaagtcatattaagcaccatatttgttgttatggcaagacatacatagtatattgttgactgaagaaagattataagccagcaacaatcatcaaacttttaaaaatgtataatgtgtatctatgggtatgcaattgcttggggacaggactgacagtctagagacaaaaaatgtttgcagcagttatctttgatcatctttgagtgatgttattggggggaatttaactttttaaaaaattgcaatttctaatttttttctttgatgacttgatattggatatgaaatttaaagacaaaaaagctactattacaacctaatttttaagttagtggtaagaagggataaaatgtcagtaacatccaagacagacaaagtattatttaatctatgtagaaacacttccaaataaataagacatagagataagcgtgcaagtaacatgaataagaaatttcccaaaggagaagtagaagtggtctgttaacataagataaaacatgttaaacaacattaacaatctaagtatgcaaattaaaatgagagggcattttcaaccatcaggttgtaaagactatttaaaaaaaatgttatctagttggtgaggatgctgggccacatttacccacccatactgttggtggcctaagtgcccttgggcagtacagagtaagagccttgtatatggctggtgccttttcacttcacttacacatatgcgcattgaattaacatacaggagtgttcatttgctggagtgtttatgagagtgaaaactgtaaacaccctcagggagagagagaacacctgcataacgacaggcattaaaaataatgttgaagaaggcaaatgtcatggaaaatgtccataatatcaaatatgcacttccatagaaactaaattaaatttatgatgtttatctgtttccatgtaataatgcacaatggagcttcaaatacggcaggaaataaaaagtcatgggggcagagactctgaataacaggattttatttttgaagaagtcctttgcacatggacagtggatgtggtgtgtggtgtgtgacaggggagttgcttcagggacttttaaaaatttagctattttcccaatcagacagtgtctagcaaccttccccacttctttaccttccttctcaaaagagagatgccaggagggttgcaacaaatgtaccatttatttttcctttggtcattgttgcttccataatgagaaaatgcaacatgctattttaaaaaagaaagatctagagtataaatgatgattaagtcaacacaaatacaaatacctcacaataattaaacctagatactaggtcttaggttattggaaaaaaaaaaaggtcatgattgactgattatttgatctcaccagtacatatctggccctcaactaatatagtactgaattcaagtgtctaaatgagaaaagaaagagaacttccaatatgtttgcaagtaccgttaaggaggcgttctgaagaagccaccctaatgaacagaaattgtttttccaaagtctaacatgattccactcttcgtttccatgtcatacatttctacttgcataatatctacaatgtcacctaaaacccaggagctactgttctgcattagaagaggaaacatgattaggggtgcaagcagggaacatgagacaatcgcaataggacattgggcgtgtttgtttttaaaaagagcacgccaaggagatgacgtgtaatctgtatattctaaggtaataaggggaataaaacaatcaatgatattatctttaactttctaaacccactcatctctctaaatactggggaaatagttttccagctatgagtagttctgacaatttaaactcacatctcttcatgtacgagtgtgcagtgatctctaagcagaccatggttatgtaatacaggtgggcaaggtaggacttcctaagtgctgaaacaatctacacaaaagacttccatccctctgtggcctttccaagggcatgttatgtacaacagacacgttgtgtgtctgaataaaaacacctaggtggacaactaggaatgtctatgagagaatgataggcttggtggaaacagagatacgtatctacttgcaagaaacttctctggaaatctagaaatgcttatctaatcctttagaacatagcaaatgtttgacaggtaacaagtagatcaagtaactccatacctttagagaatttccacacgatggtaggtacagggtaaccctcagcagaacaattgaggatgactgctttgccataaatcccgtcctggtcccgtggctgaaccacaaacttgggaggaactgaaaagagagaaatgtcaccagtaattaagactagaccagaaactgagtaaaggtatgattctaagaaactgaatcattttaatgaatattaaaatatgaagactgtttcatacacatgggacaataaaaacactattggcagtttgggacaaattaagggagtaatttcagtgctgaaaaattttctgattcatatcaatgagcttttgtcacaggtaaaagccctttgaactagggaaaactggcctcgagggaggaagtttgactaaatcaaagggatggaatattttgcttttaattgtgttatcaaaaatatacagaaattccctcaatggaaaattgaatcagaatcaccatttaaagaacagatcaggctgggcgcggtggctcatgcctgtaatcccaacactttgggagtccgaggcaagcagatcacctgaggcctggagtttgagaccagtctgaccaacacggagaaaccccatctctactaaaaatacaaaattagctgggtgtggtggcgcatgcctgtaatcctagctactcaggaggcggaggctggagaattgcttggacccgggaagcggaggttgcagtgagctgagataatgccattgcactccagcctgggcaacaagagtcaaactccatctcaaaaaaaaaaaaaaaaaaaaaaaagtagatcaaatatatatttgtgcctcaaatagtaattatcaaatataagtattcatcttggatgtgaactggtcaaagtattcgatgttgatttttcctctaccaggagataaagtgagaaataacaggcacctcgtaaaggcaatcgagaatacaatgtgggactgaacttttcccaaaattctggtgagaacacatagtccgttatgccagatgtcagcaccacggtgggccaaagggggactgtggagagtagttgcagtgaagtaccataaaggttttctagtgtgcctataaaaaacaagatattaagtgactgcttatctggtgaatgttgtgaggtgctgtaaagaaccatccctacctaaaacataaacatgatttcacttaaaacatatctccccaaagaaagcatattttttgagataagccattaggattttaatatgtatcacatctcttagaaaaggtagcatctgaaagtattctaatccccgtatctttcccagcagatcagcgattcattacagggtagactttcagtgaggcagtcataaactatgtgagaagagatgaattatctacaccatatagtagatacttagaaattcctggtaaggctaatctcatcagccttgcaagatacagaattcttaattttgagacataaatgtgagcctatgtgttacaggtagataggaactcagctgccacatatgatagactgagaagatggttagggcctaagttagcaaggggcttagaagcttgttacaatgatctgagccaacgtgacgatcgctttggccataaaataacaaaggaggaagggaaaatgtcaagacacaagaagcagccagagatggaattcaccgcagtgtttctggagaaaatattgcttttaattttctagctttactttctgtagaatgatttacacatgaagaagcaccagaaaataatgactaccagcataaagccaagtgttaaacacattggcttggtgtccagcttttctatttcctgttgggcaattttgtgcaaactgtaaaatggctcttggtctcaatttacttatctgaaaattggagatgattatggaactcattttaaggattgttaagatgatcaaataaattaagattagaaaagttctcagaactgtggagatattaactgctgtaagagtgttgattaatttagtaaatgcaggtatgtttagcttttacttttttttttttttttgagatggagtcttactctgttgcctaggtggagtgcagtggcatgttctctgctcactgcaacttccacctcccaggttcaagcaattctctgcctcagcctcctgagtagctgggattacaggtgcctgccatcacgcccaggtaatttttttgtatttttaatagagatggggttttaccatcttggccaggctggtcttgaactcctgatctcgtgatccaccagcctcagcctcccaaagtgctgggattacaggcgtgagccactgcgcacggcctgacatattcttgatgagcaaagttcccaacttgcaaatgaaataaataatttacacagccaatgggtttctgagatattgcttaagtgataagcaatgttacttcatgtagatggtattcggagacaaaatgtatttaagaaaatgaaaatatatttaaaataagataataaggaatgactatctctgagtgaggaaattatctctaagaaatatggtagagattatttagagctaagttttctagtaaaagtgaccaatcaactcaagagcaggtgacaaagttgaagacaccatgccaaaattattctctgcagggtggaaggaaaatctgcagccatccacattctgtgctccatttggctcaagttctgccaagagcaagaaattgctcatcaatggacagggtagaaaatctcttgcattccctctggaagcatgtctaatcataattgatccattactcctcccctcaatttggttctaatccaacgaaatgttccttaaaatctcatcaaagaagtgtatatgagaaacaaccatagaaatacggtaagtataaggtagttacagataaaaacggtccctaaattagtagaataattaccccgtatcattgaaaactgtttctgaccctggtaggagtagccaggggatttcccacgtacacctctttgctcatagattggaattctctcttcagataccccagtgatttacagtcacatgaagacctaagaaagaagcttctgcagtaagtgagcttcttaatttttatagcaaagagaataattaatagctcagatgtttggtctttggctgatataccatgcaacttgagaccaccttgaggaaaatgctatattttactaagtgcatgaataagccaaatcatatacatttcctttaaattttgacagaagactgtcatgaatgtaaatattcaatccctaagtgatttattatcgtgtaccagtgaatacgtaggtccctttcatgaaagtgaacttgtgagttacaataagaactctaagactgggaacatccatgtacttacatcaagaagacctgaggccacacccctcagatctgacaccttaagaatatgcttgggttgagttctgcctggcaaaattagaggtgatggattcctgggaaaagtagtaataagtttctaaacaaatttctttgcctgcccagagcctaatgtgaagacaacaggcatatggtcccctgggggttgtcatcactttgagacagctgcatcaccagctaagattaaaattccagggcaggggagtgtctgaatgaggacccagtgtttaacatgtaactaatgacatcattctcatatgctctaagcatatgagaatgaccattatccctagggacaacaaagttcccaattttttaaagtaagcagcagtttattttttaaaaagtgcagatattttttaaagaaactattaatattcgacctagatactttttttctacaaaatggcagcctaagaaattgtcctaaaagaatcaggagcccccacaaggagtcacttagtaatgaaagtgagcatttcctgagtactcagtgggtttcacgtactcctagttccatcctttgacccctcccagaattgccctcaagacaattcttactttgcttgcttattaaagagaggatcccccactgtggccctctccttcttctcagggtgttgtcttcaatcttctccacatcttactcaacaaacctcctgagctatttcacccactcccatcacgatgattgcctttatcttcccttggtgtgtagagcaccatatccttccatcattagcttatatcacaggtacctctaattcaagtttccaaaatggtacctgttcctgttcaccatccattaaggtcctcaaaaaagaaaaatggaatttcctttcatatcctcttctttcatttctttttatcaggtgctgatgattatttcttgaaaatgtatcctcaaattctctgcatctccactgccacaccccagtcacagtgagtagtctggttatgtgggaaaggggcacagcccctctgtccacccggcttcagcacctctgggaggacagctccacctccacacactttgccaggacactgcactaaggggatgcggccctctctttgctgtctcaggccttctcagaagtcatgagcctttacccaccttactggtgcaaccttgacatgtgaaaaacaattgtccatcactgagggacaggagtcagggtataaattctctgcctctgcctcagtttcctccgatccagtggggcaattatgaggcctgctctgtgcctgcgcttctcaaacattagagggcatcagaatcacctgaagagctgattaaaccacacattgctaaaccttgtctccagtgattctgactcagtacatctggggtggaatccaatattttgcctttctaatgagctcccaggtgatgctgaggctgctggtacagagaccacacttcaagaaccactgttctacgtgattccttagaaggctcccagtaggaatgagctccagttgcccatagcagcaaccagctcattaaagcaacttttactgattttcttttctccctttctaatctcattctttccattctgggatccaggaatgacatcccaaataaataacctgccagccaattctgtgcctcacactctactttcaagggaacccaacctaggacaaggcccatattgcctcttatttagatttctcagccccctaactggtctacctgccacgaactgtcccacttgaattcattcttcactcagggacctaaaggatctaagacacaaattggatgatgtgacttccttgcttaaaagcatcgcatattcccatggccctttggtataatccagactcttgggatattttaaaggatttttatgacttgagcccttggtctccagttgcattctgtgacattctcctcttgcaggctttgccccaactattctaaaaccccatctattatccagtccccaagaccattcttgctgctgggtcttcacacaggcttcttcatgtctgtttaataagttcccattcaccatttgcatcttagcttagcactcactcagtcaggcacatttgtttctgatgctgtggataagattaagtgcttctctgaggccttaattacttaccatagcctttattacgctcatctggtattgctgtttaacagtctgtgtcccataccaggctgtgcatgctatgagaacaagaaccattcctttctcacaggccatggcatgcccagcgcacagcacagatctgcagtacagaaagcactctgcaactatgcgttgaaaggacacatgaatcaatgaatgttattacttcagttttatagactagggaaacggagcatggctaagttaataacgcagatcagggtgacccccaaagcctgaggtctttgagaagagtggacccaatggaagtgccatctgagggacagcagaagacagcctcataggaggactctggccaagaagatacagagcctgagatggaaggatgtgaagcctttgggactgttgccgtttgggccaaaacttatgacagaacaaaaagaccaccagtactctatattgtctgggtgtataattccccaaggttgttggtttccttttttaaagatgatatttagatttccttttattagtataacacattatttagtatattgtggtgagccggcttgccaatatagtttgttttccaatagatcatgatatggtttggtagtgtccccacccaaatctcatcttgaattgtagctcccacaattcccacctattgtgggagggatccagtgggaagtaatttaaccacggggggcggatctttcccatgctgttctcgtgatagtgaatgagtctcatgagatctgatgattttataaaggggatttcccctgcacaagctctctcttgcctgccaccatgtaagacatgcctttcacctcccagccacctgtggaactgtgagtccattaatcctctttttctttataaattagccagtcttgggtatgtctttatcagcagcataaaaatggactaatacagagcggtttttctggtagggaggaagagtaattaaagagatgaataggttcaactacataattacatcacatctccaagatgcaatatggctaaacttgccaaacacttctctgaatcataattacgtgcacataaccagcactcctgtctccccaaaaagaacaatttgatatatattccaaaataccaaaatcttgtcatgggatccacataggctgagagtatctgaagtttcaaataggtttctttgaggaagtttactcctggtgttgcctaaaatgaaggttgtttaaaacacagaggtctttggcttgatctgcttattttgtgtgtgttggtggggggtggattacttctgttgtttcatttttaaagaaataatactatggttataataagacaggcatttttctagttttaaatgtagtccagcgttttatgtttggaagccatggcttctaagttgctatatatttccaaagaatgaatttaggtttccctagctgtaaacctgggcagaaattcagttttaatgaaagccatttggtggaggtgggagggggtgcatggataaataccaccattctctacttggtgacatttagttgagatgggacttggccaaagtctaggtaagatttaatttacgacactgacaattaaacctattgctttcccatcattctgagaatagatggcctggcctctgcttatatctctgccttacactttctgtcctctcttacttaataggaggcaccttgggcctcttgctgggctgtgaacacacaaaactcactccacactcagtcttcagacttgttggtctctctgcttggaactcgcttcctacaattccctgggacgtacgccttcacttcagtcaagtctctgctcaaagatctctccagaaagccttcccctgcccagcctacctaaaatactattttcatccccatctttctcaatccacgtacaacatgtttatttttcatagtccttgtagataactgacattgtttgttcattatctcttcccttcactagactttgaaccttaatgggcagagacttggtgtctttattttaatcaccatggtatcctcggcactcataacagcacctattataaaacaaatatttaagaaatattttgtgtaagaatgaatgaatgaagtaaaatcatagcatgagaattctatcaaaaattggatcaacagatggcaataaaatagcaaccttctatgattttcatttttcctgtcaactgacagtcaactattttagccaatgtgcttgtttctctatgtggcagttcaccattaaaagccagaaaccattgacccatcagaagatataaaaaagtgtgagaaaacggccctcctttggaatcacagataggaactgttgtgttggtgctttcctgtgagtggtctagagaccacaacaggaagcaaagggcaggagtgctctttcatgaagcctaatgcgttatttctaataccttaatcaatgccaaggtcactccactgagcaggatatcagggaaaccatcagtccactgtcataagagctatgagatttggctcttattggctcatacataacagctaagagatttttgcttttggggtgttgtttttgttttcttatattttcttcaagacaacagctaatttattttagatcaagtctttacaaatcttcccactaacccaggctatcaaacaatgtgctaagctttacaatgaccccaggtcaaacttttcttatgcagcttcctcacgtcactcagccttcatagaagagagttagggccttgccctgtatcaagcttgtacttaagggaatgtggtggctggtttggttttctctatccatactatttaaacgttctccatattagcaacgaggttgtttcactttaccatttgtgtgttcactggagtagcatttttcattgccctcaagaacttttcctttgtgtttacaatgtggcaaacagtttggcataggaagcccagcttccggcctctcttggctttcaaatgccttcctcactgaatgcaatcatttctagcttttgatttaaagtgagagatgtgcaatgaatgattcctcctctcactgaaacaccggagactgttgtggggccattcattggcctaatttcaatattgttatgtcttaggaagtagggaagctgagaaatggtcaatattgttgtcttaggaaatagggaagctgagaaatggagactgggaaatggttggttagtagagtggtcagaacacacacaacatttatcgattaagtttgccatctcatatggctactgaacaattataatagtaacattataatagtaacaccagagattactgattaccaatcaccataacagacataataataatgataaagtttcaaatgttgcaagaattaccaaaatgtgacatacagacacgaagtgggcacacactgttggaaaaaatggtccccatagacttgctcgatgcaggattgccacaaaccttcaacttgtaaaaaatgcgatatctgggaagcacaataaagcaaagtgtggccgggcatggtggctcactcctgtaatctcggcactttgggaggccaagtggggtgcatcacctgaggccaggagttcgagaccagcctggccaacgtggtgaaaccttgtctctactaaaaataaaaaaattagcttggcatgttggcacatgcctgtaatccaagctactcaggaagctgaggcaggagaatggtgtgaacccggaaggtagaggttgcagtgagtggagattggcccattgtactgcagcctgggtgacagagcaagatcccgtctcaaaaaaaaaaaaaaaaaaaggaagaaaagaaaagtgcagaagctctttagtttaattagatcccatttgtcaattctggcttttgtttccattgcttttggtgttttagacatgaaatccttgcccatgcctatgtcctaaatggtaatgcctaggttttcttctagggtttttatggttttaggtctaaggtttaagtctttaatccatcttgaattaattttttgtataaggtgtaaggaagggatccagtttcagctttctacatatggctagccagttttcccagcaccatttattaaatagggaatcctttccccattgcttgtttttctcaggtttgtcaaagatcagacagttgtagatatgtggcgttatttctgagggctctgttctgttccattggtctatatctctgttttggtaccagtgccatgctgttttggttactgtagccttgtagtatagtttgaagtcaggtagcatgatgcctccagctttgttcttttggcttaggattgacttggcgacgcgggctctttttttgtgccacatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagcggtttgtagttctccttgaagaggtccttcacatcccttgtaagttggattcctaggtattttattctctttgaagcaattgtgaatgggagttcactcataatttggctctctgtttgtctgttattggtatataagaatgcttgtgatttttgtacattgattttgtatcctgagactttgctgaagttgcttatcagcttaagaagattttgggctgagacgatggggttttctagatatacaatcatgtcatctgcaaacagggacaattggacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtgttttttgtctttggttctgttatatgctagattatatttattaatttgcgtatattgaacaagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgacgctggcctcataaaatgagttagggaggattccctctttttctattgattggaataatttcagaaggaatggtaccagttcctccttgtacctctggtagaatttggctgtgaatccatctggtcctggattctttttggatctaattaaactaaagagcttctgcacagcaaaagaaactactatcagagtgaacaggcaacctacaaaatgggagaaaattttcgcaacctactcatctgacaaagggctaatatccagaatctacaatgaactcaaacaaatttacaagaaaaaaaaaacaaccccatcaaaaagtaggcaaaggacatgaacagacacttctcaaaagaagacatttatgcagccaaaaaacacatgaaaaaatgctcaccgtcactggccatcagagaaatgcaaatcaaaaccacagtgagataccatctcacaccagttagaatggcaatcgttaaaaagtcaggaaacaacaggtgctggagaggatgtggagaaataggaacacttttacactgttggtgggactgtaaactagttctaccattgtgaaagtcagtgtggcgattcctcagggatctagaactagaaataccatttgacccagccatcccattactgggtatatacccaaaggactataaatcatgctgctataaagacacatgcacacgtatgtttattgaggcactattcacaatagcaaagacttgggaccaacccaaatgtccaacagtgatagactggattaagaaaatgtggcacatatacatcatggaatactatgcagccataaaaaatgatgagttcatgtcctttgtagggacatggatgaaattggaaatcatcattcccagtaaactatcacaagaacaaaaaaccaaacactgcatattcttactcatgggtgggaattgaacaatgagaacacatggacacaggaaggggaacatcacactctggggactgttgtgggatgaggggaggggggagggatagcattaggagatatacctaatgctagatgacgagttgatgggtgcagcacaccagcatggcacatgtatacatatgtaactaacctgcacattgtgcacatataccctaaaacttaaagaataataataaaataaaataaaaaaacacaacaacaacaacaaaaaagaaaagtgtgataaaatcaggtgtgcctgtgtttattgaatgcagtacattgtggatacgctatgctgttgggggtctggattttgttgtcttcctttttagtgtcaaatattgtttatgcacacaattaacttactagtggagaagttttatcttgccaagaatcttcttaggctcttttagggctggtctagagtaacccttatgctggggatagattagtcctactcctagggtgtggcattcctgagattgcggctgaattcccctattctggctagttagaactccagcattcccaagcaatgtgcaacttctgctagcaccctgtgcatgtgaagaacagtattcagctgaaactgcaaaggagccctgtacagatttctagagacctttctttgaatagctccctaatctccagtagcttgtccttcaatacccagtaatcatcttagtatctttcaatttctctctctgttttctccacctgccaagatcactgtgatctatttgggctctgcactctctgtcatgtgcagaaagtaccccaagcagctatctggggtgaatttggaactgacttcatgcactttgttttgttcctgaaagcagttcttatatatattagaccaattttatagttggtttgtagtaggaggataaatgtgttacctgttactctgtgatggtcctattagataatttttgtttttccacttctttgacccaaaacatcccccttccctataattttcaatcatttctgttggtgctacctactggagcttcacaccatggttgttattatactactttgaacgtactactgcactggtacaaagaattctggttgcattcactaactcaaggactttgatcctgtaataatctcctctttatcttgacacatatttttttcctctctactggcttattctcataagcataaagcaggctgtaaagtatccagtcttaaaaataactcctgcccttgccccatgtccatttccaactttgtctccattttactgcctcctgtgatagcaaaattcctaaaaatataaaaatagttgtgttttctgagttcctgcacattgaccttctttcttttctgaagctcctctaatcaagccctcgctgcaatgacaccaggtcataaacaatatccatcaaggtcataaacaatatccatcttcctaaaccagtgaccaactcttggttttcctctttgtctactttcagcaggattcaatactgtttaatattctctttctcgatttatttctgattttgcttctagagtgccacagtccactggattttctcctcctttacaggctgctccttttccctcttcgtctcttctgctgattcctccttctcttattctggggccttaaatgctggagtgccctagtgactgctgggacaggtgcttctcccatatcattgaccattattccccttgtcaataccgttcttcctcatttcttctctgcttctgctaaagacactttcattcaccttgttattaggcaaagcatgattccactaaaggttcttctttatctcatttgcaacattcactccataagcgtgttttatttgctttaccgccaaaatagattgtgaattccactgcttctcatgaccttaacattaacaccttcatccaaggcatttttatcttgtctgaatgtctgaaatagcctgttaactactcttcttgctttctagcccagtccattcttcagacagctactagtgtgacaactaaaaagatcaatcaggccatagtgctgtggtggttaaagtcaacagtgccaactctttaatctagaagaaaatccacacctcaaaatggctgcacgttctaattactcagggggctggaactgagacttggctacatattagaataaacctgtggattttacaaattattgatgcctgggtcccacctccaaagatggttatttaattgacaggagcttcatcctggtcatcaggacctttttagacctccctatgcaatctgaatgtacaacaaagtttgagaaccactaactagtgatttttgggaaaaaagaacaattccccagagatctggaagatggatttacccctaaagattatgatttaattggtgtagattgggaccaaaaaatgcacatcagtgttttcttaagcctcccaggagattctacagaactgtctggattgagaaccacagtcccacatcaccttgtccctgcctgtttctccagtcacactgacctgtttgtgaagcacattttcttcctctaggctgcattatctcactggtgatttaatattaatttaactaaagcttatttaacatatttgaagaacaatcacatggagacatcagtcatatcatgatcagctacattatcccaaatagctaggctcattttcagctcatctgattttgccttggttaaaaacttctggttgccttttctgcaagggcaagttgtacaaaaagcatccccgtacatttttatctgacgtttcagattcctggcctggatccttcagagcagattatatagaaagcaggctgatgtactattttgcccttcacaaacccaagagttaactctgcttataagaaaacgcttgggaaacagatactaggttggctcccttttttatttatctttcaaaatttgggaaaaaatcaagtatcccaattcttccactccaaagtgcaaggtggaaatgagaaaaatgtcatgaggctgctaagtttgtgtctaattgaatatatattttctaaattattcacctggaaattttttttttcagaaatacaaagttagtttcttcctatgacttctaagtctgtgtcacttccttttgctggcaggtagataaaaagtgcatttcttcccagctggcaaggaagaagaggtatcaaggggacaaggagtaaggaatgaagaaggacatgagaatctcctgctcaagaaagagctatctccactctctgggaaattacagaaatcctccccctcctaacaaccactctgggaccacaatctggggaattttaaaatgcaaataatcattgttaatataaatctttaacttcagacagttacttttgcaatgtggatgaatattgtaatggtagattaatgtatagtactcttggagaatcataaacatcacagaatgtctgtgtttgatatacattagagaacactagcagcttatttcatagatgaagagtgtgagccttaatgggaatttggtgacttgaatagaagttcaaaataagactgaagcttacagtttagatgtaatgagattactgccagttttctacaagttagcctaccctattttaatttttttgaataagtactaccatactctgcttaattttaaaacgttgcaatggcgtcccaaaataatgatagatttaatgctaaatagaatagatgggcaaagaaaaccacatttctaaaactaaaacaaacattatgaaaagctatttcatggctctttagaaaaactttgatacatagctttgagacatattttttaaaaaaccatttattgaaataagaaatactaaaaatattatatgaatacaataaagcaaaagctcacggacgttagtcctcaaaactcattggcttagcatacggaagccttatttcatgaattaaatcctatggttcccaccttcttagctattaattatttaaaacatattttaggtaaataaaaccttatcttggagtttaggggaattcatggttgggtttagagtcgtatttttttttttttttttttttttttttagtgagataaaactgaatttctaagttccagttattttcgaaatatttcaagccccatcatcttaaaccattgttaaatcaactctacagatgccacatggctcatgatcctttgctcacctctgacaatcaactggctttggtgctccacagcggcggcctcattccgggctatgcaggtgtaattcccattgtgcatgagcgagagattggaaatcctcaaggagctcgtgaagtcaatattgtcaatggtcaccccaaggctcccagggattggccggccatccttctgccaggtgatcgtgatgggtaagtcccctgagaccacaacacaggggatgaagacccgctgcccaatggagaatcttggaaactcaaagggttgtatgaaaggcggaactgcaagaaaaaagaaagataataacgaactgtgcttattctacatttgcttttcctttaaccctgtatacggcactgaaagggtagtacagacgatcatagatacagcatagaaatacaggaactgtagcaaatttgaaattctgcttctattatttgaatgttctcatcattttaaataaaaaccatggttcaatttgtacttcagcaagttaattttgttcaacaaactttaatttaaaaattatttttgaatgaaaacatttcagactatatctgtagtgtaaatagtgtgaaagagggatttaggtttggttttccttcaaagccttttaaaatgatgtatacaagaggaggtttctttcctactttgcgactatgacactacaattactgttccccttctaattgtttcctgccttgtaaataggcatattctaaacccactgaagaagcagaaattccaattttggctggatgtggtggctcacacctgtaatcccagcactttgggaggccaaggcaggaggaacacttgaggccaggagttcaagactagcctgggcaacataacgggacccccatatctacaacatttttttaaaaaattagccaggtgcgatggtgtgcacctctggtcccagctactgaggaggccaaggcgggaggatcccttgagcccaggagttcgaggctgcagtaagctacgagggcaccagtgcactccagcctgggtgactccagcctgtgtctaaaaaactaaaaaaaaaaaaaaaagtaaaataaatattccaattttattgttaaagttctctgttatgtccaactaataacaaccattaattataaattcttatttcatattagaataactacatctttactttgcatctcttagttttgcacactttacgtgtgtaacttttaattgtgaactggtccgtggcaggttatttgacttgctgatgtattgctaaggaggtcgggttatagccttcagcctggcctgccatggacactgcaagcaaactcagcctggaaagctctttcctgattcagctttgctgagtgatgcctgttttgtccaccttgccttaggaactctcttcctcagtgccctcctagatgatgtcatagggtattaacattctgaaatagttaaaatggagtcagatgaaccacatttgaactctaactgttacttgttagttatgagcaaagtaatatgctctttcatcagccttacggattagttatttattgctttactttgcagatgggaaaagtgatactcaaagatgttaccttgcccttttggtcttagaactagttaactattctcggagggcttaaatcatgtcaatataactaatatcagagcctgtaatgtaagccttttttgtgtttttgcatacattcttggaaagaaaaaggtttatttgtatgcaggggcttggaaatgactaagagtacaaactaagatgattaatcatgtgataatctaatataaaccaattattatattacgagtttttcctaatgaagttattaaagatttctacagtttattcaacaattgtaagtccatttcaactatcagcttaaggaagaggtaagggatccggctgagaaatttgaatagaaaaccattcattcatttatttgttcattcaatcaagtcatgtttattgagcacctgggatgtgtgtggcagcagtgaacgtgctgggcacacagcaatgagcataacccatcagcctctgccagtggagcttccatatatagccataggccgcagacagcaaggaagtgcagccatggcgcttctcttatttcgtattatcactatgacggctgtctgctttcaaaagcagttgggagctagaactcaaaattgcaagtacagccagaggtcgaagaagtaggtagctcaagttaggttttaccagggaaattaatttttttaaatggtcaaaggtaccgacaagcatactcaatgtcaatcctcctgtggattctccatgtaaagttagatctttgggattgaaaagggctgatctgatgctaagagataaaggtctcaggatgagattctatccagtgctggtggagagaatcgggtcagactgaggtatgaacgttctcagttggaatgtgctggagaaaatgtcatgttgtaccaaaggtgcttgtatttctttaaatctcttgcccccaagtggcataaatgctcactatatatgtaaatattattaatactaaattgctatgctttattaaagaaaataattacatttcctcccctttgatttcctggacacaaaaacctggttgtcagcatactcagacaaaccttggcttggtgcttactgtctgaattacagacaatttttctaagataagaactttggagccaggctactttggtttaagttcagctatgctacttactacagttacttaacccctctcagggtctcagtttccttatttataaaatagagtgctgccttgagctctgaatgagttaacacagtaattctcaaacttagttgtgtatctgaatcagtttcttagcatttgttctatttcacaagcctttaagatgaggaaaaaacaggtaagttgaaaggttactgggctaattttctctatcagttacaacagggagaaggaatacgtgaggatttactttctccaaatcaagaaagaaaggtaagacatagcatattttttaatctagctatttaataagaaggccgggtgtggtggctcacgcctgtaatcccaacactttgggaggcccaggtgggcaaatcaccagaggtcaggagttcgtgagcagcctggccaacatggaaaaaccttgtttctactaaaaataaaaaaaaaaaattagccaggcatggtggcgtgcacctatagtcccagctactagggaggctgaggcaggagaattgcttgaacccgggaggctgaggttgcagtgagccaaggtcatgtcactgcactccagcatgggagacagagcgaaactccgtctcaaaaaaaaaaaaggaaaacatagagtgtaggttgtaaataattgtaaagtattagaatgtccctttagagcataagagagttatagaatacaggaaatatatgcacatacaaattttcaagaacagaagtaagaggtagctatagaagaatcagcattaaaaccaaaacgaaaaccaaaaccctgtgttttctataattccaaaatatttgcaattcatcagtgtatggtatttaaggaatatttttatcattactttagtacaaagcaacagggctgaaaatcaagaagtacacttccaaagcactgaaaaaccagtgtcagaaagctaatgcactaaatctcatacacatcactccaaggataatcccttgctttgaacatcttattttaaatcattacaacactgtcagttatctgatatcttggcctaaatcagattctgggagttcaggcatattgaagagggcttagtaagaagccacaattggcaagcaaaaggaggagggtgagaaactaaaagtaaattataaagaacagacacaaaaacgcaacacacacagtagttggatgacattttgtttgggagcacattgcccttagtagtcagcatttttgtaattaatacaaaatcgtaatacttaattagcattctgaattataagtcacggttaacatattaaataaaaagatacatttaaaatattttaaaacatatctaccaaaaaaaagcctttccaaaatggttaaaataaatattaaagaaaagtttagtcataaggaaaagcgttttcccagaagaatgtcaaaattaggtttgctatgtgttgctttgcttgccacattatgtaaggacacattaggtcagtatgcacattacatcattgttaatgtaaattaaatcacaagacctatttgtcaatcatgtcaattctttcttcactgcttaagttgccttgcttgcatcagctgtgagttgcaagtctgctgcatacaaatgcataaaatttttaaagcgtcttaagccttatattttatattcataagacataagatcgatggcacaaagtaactccagtgattagaaaactcttctcatgattttgggaaagctgaacctcctatttgagacacactgattacctgattcatgatatcacctaaataaggtaaattatctgaatcttgctgacagtaaaagcttgtatatcataggagcagaaatcctgaatatgacacacaccgcttttgacataccctttctacaagaagtacgtaaatatctgataaaggtcatttattaccaggcttgtgtatttcactctacataatggcgggggtccttttcctaggcagctcagagccattgaatactgccaaatgtcaattttgactcttactctatctaaacccttaacaagaatattagatcagactgatatatttctgtcttgtctcttaaaaattaattgtatattcttcttcatggagggaaatgctttgatttctcctagagaagaggcgtataagactttgataaaatcatgggtggggtgctcgtcaattctgggtgattagcagtgttatcttgatccagtttatttagctctgcgattctatctcttcatgtgtaacgaggtgataatgaaacacagttcattatcagcttgcattgaaatagacagcaagtagctcttctgcgcagccacagggctatttactgtccagttcagtgcaaggcgtgactccgaaatgatgaggctgtgagcaggtgggagtttctagtccggggtataccttcaagatctcctcacccataagtctggttatctggtcaattctgctacttaacaacatcgtttagctaaattttagattactgacccagtctgatacagttctccacaatgtacatacaacacaagtaagcggttcctctactcactcttgttcaaaactcttgtatggaatttatcacattgatgactcaagtgagtacagtgatttatggacgtgcccattttcttaagtagagtgacccaggagggcaggagatctatcaagtttatcttttttatttcccacaactagtgggataaatagtgtcctgttctttttttttcttttctttctttttcttttttaaacggagttttcactcttgttgcctaggctggagttcagtggcatgatctcgcctcactgcaacctccacctcccgggctcaagtgattctcctgcctcagcctcccaagtagctgggattacaggcacacgccactaggcttggctaattttttttgtatttttagtagagacggggtttcaccatgttggccaggctggtctcgaactcctgacctcatgtgatccacctgccttggcctcccaaagtgctgggattataggcgtgagccaccgagcctggatgtcttgttcattttgattgaataatgttttttagaaaaaaactttcagaggtgatgatgaacatatgtttacactctgcactttagacaatcctgaagtcattaagaatgacttagtttactgagaatgatgatttccaatttcatccatgtccctacaaaggacatgaactcatcattttttatggctgtatagtattccatggtgtatatgtgccacattttcttaatccagtctatcattgtcgcaaggacaaaaaaccaaacaccgcatgttctcactcatagatgggaattgaacaatgagaacacatggacacagcaaggggaacatcacattctgggtactgttgtggggtggggggaggggggacggatagcattaggagatatacctaatgctaaatgacaagttaatgggtgcagcacaccagcatggcacatgtatacatgtgtaactaacgtgtacattgtgcacatgtaccctaaaacttaaagtataattaaaaaaaaaaaaaagaatgacttagaaaagaggagcaggcagacacttccaggacttaataatgacgacatggcagggacaagagtgaagctcctcttcatagtcttattagcctaggggccgaggacttctaactactgtgccaactctcccctctgctggcagggccagttggggagcttgagtcaatatctggccttgtttatttaggtacggtcctcgcgccaactctgaattgctatgtgagtttgtttccctgagatcggtgacttccaaccagcagcagccagagatgcacctagcttaccgtgacttaggctgctggtcccgtgacctgcacctgctttagcaggaagggcaggaggccaagatgcagagacatatgatgagggagtgataaggatattgctggagccggtgggtgctaaaagaaaccagaggctgcgtgggtcacatcaacttagattccattagtttcccttcttagcctctcactccaagctccccgcggggttcaatatgagctgatattaactgacattgacctaggcgaaaaaggcaagagtgagccagtggggaattctttggccctgccttctgggtgggaaggacagggaaggacaaggcattgtccttgcagtgtggtggagatgacttttaggatctatctttaaggtttccttaaagaactgtgtcttgggcatatttgtaatagcccaaatcatacaaaactttaaaaaatgtttcaagtatctgtttttctctagacatagatttgaaataccacatttgaatttctgtggatgaatgaagtaggagttttgagtatattttgataaatttacatcttttgaattatttaaggtgtactcaaatgagaagtatacctcctttaggggaggagttataagtaaaaacagcagaccaaagttttctctggccacattctccattctaagaaaacatgttccccatggacagaaaaaaatagctggacccaatcatccatgtcttccttagtttcagaaagtgtcaaggcactgaacctgctgtgacttggagaaaacaaacaagaaaggctaaataatgttcgtgtgtgcatgtgtgtgtgtgtgtatgtgtgtgtgacattctctttatccattcatctaccaatggacacttaagttgtttccatgtcttggctgtcgtggatagtgctgccatgaacgtgggatcacaggtacccccttcacagagtgatttcatttcctctggatatacacccagtagtggaattactggattatataaatttttttaggaaacttcctattgtttcctatcatgtctacactaatttacatccccaccaacactgtacggggttccattttctccacacagccttgccaacacttgttatcttttgactttttgaccacagccatactaacaactaaatcatgcaggccaaatttcacaattctcactcagagtgggcaccaagagattaaaggtggtaaaaataccccatggaatactttgcagccatagaaaggaatgagatcatgtcctttgcagggacatggatggagctggaagccattatcttccacaaactaatgcaggaacagaaaaccaaacactgcatgttctcacttataagcgggagttgaacaatgagaactcatggacacagggagaggaagaaagcatgtgaaagcatgggtaaggggagggaaagcatcaggaaaaatagctaatgcatgctgggcttaatacctaggtgatgggttgagaggtgcagcataccaccatggcacacatttacctatgtgacaaacttgtacatcctgcacatgtaccttggaacttaaaattaaatgaaataaaatagaagaacattatgtccgctatagttactgatgtgataaaaatctttcctcatattatattgtaattttaaacagtggattgaattattttatttcctggtattatttcataatgcatattgtttttcctatatagaattattctttattttacacaataaagattctaatatggccattgcagtgttagctttgttccattattagaattgtatcacacaatttttttatagtaaatatgatttgaaattatttctaagttaattaaatgggccagtaatatattctttaaaataataaattttgtcactgtgttagtccattttcatgctgtggataaagacatatccaagactgggcaatttacaaaagaaagagtttaattggacttacaggtccacgtggctgggggagcctcacaatcatggcagaaagcaaggagaagcaagtcccaccttacatggatggcatcaggcaaagagaatgaggaagacgcaaaagcggaaatccctgataaaaccatcagatctcataagacttattcactaccacgagaacagtatgaggaaactgcccccatgattcaattatctcccaccagatccctcccacaacacgtgggaattatgggagtaaaattcaagatgagatttgggtggagacacagccaaaccctatcagtcaccatctctgttcatttatgtgtatttactttaaatgtctaaaagatagataagtaccctacaagagtttatgagagttcatagatcccatggcaaaagttaatgagggtggatatcacattcatttgaagaatcatactacacattacaaaattgaattatgagattgaaaaccatgaataaatagttcaacaattcagatggaaaggaatgtctcttactaatcatacgctaatggaaccattgttcctcagtgtcctgacctggccttgttcttccttctctctccctgatggtctcagcacctcctttgccccagctgtcagctcaatgctgttgactcctaatctaaattttcaaacaaaaactccttctcaagattcatgcctgcttgttcagtagtatgtcaatatcttcatcttgatgtctcagaagtatctcaaatcccaaaccaaacatagcaagtttccccttaatctaagcttcttcaattctctgttcttagtagtgatagcaaaatattttggttgcaagaagcttcgaataataaaagcgttcctagttgtgcatttctttttgtgtccagctgctgagagtgtgctgctatgtattgtctactccaattctcaacatgtcttttgtgtggtttctctttttccaaacacagtactatcacctttttaattacaactctttcaattgtgtcctaactggtcattcttttttttttttttttcatctttctgcactgtgatataccttacccacctcaaccagattaatgtttctaaaacattgctgcgagcatttacctctgctccaacacctttaggattcagcaggatgtgctaactctccgaggcctggtcctctctgtgcagatgcagaccttcgcttactgggagtatcctttgtgtcagccataggggctcttacatgtgagcaactgcacctgacccacctctgtccccacaccctgtccgagccccattctcactctgatcatcttataatggcaaaactacactcaattgtttctgcttttggaaaccgtttcaggcgctagacccttttgagattcaactcagcttttcttggacattcttttttggctcctcaagacttctcagcctaccctatgcccagaattagataaatgtccacttcctctgctcctaaaacacatactgcatatttctctgatggtattgtgttgatgtctgcatttgtcttctttgtctccctgctgttctcctgcgccaggtgtcatggctgctgttttggaccttctgctgcccctcgcccaggacatttgctgcttcctgtcgtgtgttgccatcatttgtctgtgggttctcccacagaccccaacaccttgctggcagtgaccatcctattattacttgatctcattaacagcagacgcacaagtattacctgaatacatttttaaaaaacatcttagcactcacaaaactaaagagattttttgagttgaaacttgttctgatgacaaaggtccaattgagctatgaactacaacacaatacactatggtacactgtaatatttctcatttctaatttgaaatattggactcatgtcattatagaaagcgggagcaatttttttttttttggagacagattcttgtttcccatcttgttgcccaggctggagtgcagtggcatgatctcggctcatggcaacctccgcctcccaggttcaatcaattctcctgcctcagactcccgagtagctggtactacaggtgcccgccattacacctggctaatttttgtatttttggtagagacagggtttcaccatgttagccaggctggtctcaaactcctgacctcagttgatttacccgcctcggcctcccaaagtgctgggattacaggcgtgagccaccacgcccggccagtgggcgcaaatgaatgaaaaaatgtgtttaggaaaaggtgtttaagacccacatgtatagccatttgacatctacgtaagtgggaggagttgcactgaccagattcctttcaagaaaggacatgttaccaccaattcatggggtgatgtcatctggaagttattggccacctcggagattgtctcagctgcagaggcccacttcacccaaggacaggctcttttttggagtgtcctcaatctagtgactgattgaggagcaattctgcccaaactcaggacaaccctgaaggactgttcttgctccagagctcactgtcattggcctgcatcccagctcactctttcttcgcccagtccttcttcctgtccttccctcctcggttgttgatcataaggcactccttgataaacactcttcacactagcatccatctcagagtcagcttcccgaaaaacccaaccacaatggtttgtttcatctacagcaaaaatgcatgcaccattaataacaaaaccaggtctgtgtgtgacacactctccatatacttcaaccatccattcacattactttaactcatctgggactgggactagaagagaattagtgctgagttctctttcaaatatacccctctatacatgatgaaaagtatcttgttattttccctcagaacaaggaaaagatagaagaagaataaaaaaagaagcaagggaaaacgtttaaaaggtgaattttaaaattgttgctcactaacttaaaaaaaatgctgtgtttgttttgttgtttttgctcattcagctggcccaagtttagctagtgttctgagcaaaaattcagtttttctctctaataattggaatatatcaggaataagagtagctaacttttctacaatgattttaaacaaagtagttcttctataggatgcttattttagactgctagactgtgaaaagaggtaaagagtcataaatataacaacgaagtaagggggctgggtgcagtggctcacgcctgtaatcccagcactttgggaggctgaggtgggcggatcatctgaggtcaggagtttgaggccagcctggccaacatagtgaaaccccatctctgctaaaaatacaaaaattagctgggcatggtggctcacccctgtaatcccagttacttgggaggctgaggtagagaattgcttgaacccaggaagcagagattgcagtgagccgatattgtgccattacactccagcctgggcaacaagagtgaaactctgtctcaaaaaaaaaaaaaaaaaaaaaaaaaaaagaaaaaaaaaagagagagagagaaaaggaaataaaaggaaggcaaataacttttttcccaaaaattgtttaaaattatcaagtaagtccatgggaggaaaaaaataattaaaatgttttaggaacaagaaaaagatatcccaaggcataaagtagaattataataaagagaaacacaaaagatgcaagttggatacaataaagggaaaaaataaactacttgaaatttgggggcgtaaaagagtaaaacaaactctgagaagcatggcagtgtctccttccaatgcacttccaaaaaaaatggatgccctgcaatattgtcaaccagatgcctaaaggggaatgtggtggaaagaactggataatttcttggggccatttgagtcttcaatcatatgaaacatctcttgaaagttatttttatggagtgtattgtaaagccataatcatattatgttgaaatagtttctttaaaagattaaaacgaccaagaacttaaaaacttatgataatatctatatgtaaacaattagagtcaccatggtctgagcaggatgacaggttatgtttcccctggttgagagcaataataccttcatacagaagactgtaataaaactgagttacttttctgcatttttaatatgaaaagaaaagccatttgaatcatcaaggcatcaagaaaatgaaacatatctcatgttttacttatttagttagagaaaagtgtcatctagatgaggtacaattattttatttttgtttatatggacttctgatggaagcaaagccatgtgaccccaaccagaggtgacgacaaccaggcttaataacaaaagtaaacaagattcataaaatcactggtattcattttaaaacttggcttatttttccaattagtttttttacaaggattgttagtaatagattatttgcttgagaagtatttttcatgacgttggcttagaaaaggtcatagctctttagaagcttggttaataataactgacttgaagaggcttttttttaagtaaagtgctgaaatatgttacagtgagacaagggtataaaaaggtagtcaatatatttcacagaactaagactgcctctgacagcaccatcatggtatcttggtagatggagaggagaagaaaacatgggtcatttaataaatattgggataactgactcgatatagatagaaaatatattggaccccagctttactatatctgtgaagctcagtgtgggttgaaggcctaaatgcaaacagcaaaaatagagacatagaacaaatacagaaaaaaataggaatgcatcttcatgagctcataaatttcttaaacaaggtccaaatgaagacaaaggcaaagttaagagagaaaagacagccttggaaaagatattcacaatcatttctaagtaataagagattcatatttatactaaagaactacagcaaagcaggaagaagtagcaggagtgatagcaaatgcacaaagcaatgcatagatgaaatcctcagacatctcctgagagtataaaaagacattcaagcacaatagtaatgaaaagaaaacaaattaaaacaaagagctcctttacatcaatcagctttgtcacaaatagaaacacaggtaccaggatgcggggaactgggacctctaatgcatagctggtggtaaagtaaactggtataggaattttggagagtggctatgcaattattagtgaagttaaattctatgacctaacaattctactactggccctctagtaatattaatactacacatggacacatttataagatacccatggtagtatttgtacagagtcaaagggctgggtggggggcaaactaagcattcacttttgtgctgttattgtatatatttacatgcatgtctaaataaggatgccagaaaattaatttaaaataaatatattaagtacacataagtctgtgcctatgagacagggacaaacgataccagaattggtggatggttgaaaaaaggggggacaagttaaaataaaacaaaataaggatcttgcatggacagatgataatggtgtggtgtcagccaaaagttgacaaaacaaaaacaaaattcaccattgggatttttgttcatgagtcccaaaccatggctcaacagtgggacatgggctgcaactaggcgttcttgtcttcaggacagaggtggcactctcattcccctcttttattcattagaaaatgcccagagggctatgtttcattgagacaaaatagacacatcagtgtgtccttcaaaggaaaggagctgctgaacttcgttgcatacaaagtatttaaacaaatggggacgctagagatggttagccaggaagacaaagcttagtcttttgcacgactgggagctttatgtggagaaacggggaactatttagtgttgctctagagggaatattcgaaccagaaagaagagaagagctagagaaggcatatttgtatgtatctctatttgtatgtatgtcagacagaggaagaactgtctgacaatcacagccatgtagaaacagaaagggctgagagcttagtgaaccactgcacagatcgtgcaggaagagtctagaaaaatgtggggtacagtccaggggcatgttgaatatcacatgggaggctggtctagatgaacttcaagctgatttatagccctaagattctaagagtctataattgtatcatgcatctatatatctgtaaccacatatatatgtacttatatataatatacatatataactatatgtatatttatatttgtgttttatatttatatatctttatatttaaaatataatgcatataaatgttatataggtgtatgaagtacacaattttattgaatttatatatttaaacaatttacatgtgttttgagtcaatgcatataaaagatcctaccgcatggttctgaataattgagagttgttatttctgacttaaaatgtcattatcacggcattatttttagcactgccaaagagtttttccctgtggtgtgtgcacaaacgtgtgtgtatttgcagattaattatgaattagacagcaaaagtgttagtaatttgcttggcattcttttccctttcttatctctacataattctctccttctctaagtttcccatgttcagcaagtgcaacaagtattataaaacataatttatcttgcaattttaactaaataaaagaattgtattcttatatgttgattttgtatcctgcaactttactgaattggtttattacttctaatcctttttggtagtgtcttagggttttctatatatatggtcatgtcatttgcaaacaagttaatttcttcctttccaatttgaattatctgaatgccttgtatttctttctcttgcctaattgctttggctgagacttccagtgacatgttgaatggaagtggcaagagtgtgcatctttttttttttgttcagaatcttaaggaaaagcttccaacttgtctcgagtacaatgttagctgtaggtttgtcatgtatggcctttattatgttgaggaacattccttctgtatctaaattgttgagaatatttatcatgaaaggatgttaaattttgtcaagtatttttctacacctattgaaataatcatatgataaagctacaaggcaaaaatcagtagtgtttgtatacactaatagtgaactatctgaaaaaaattaaagaaaacaatctcatttacaatagctacaaaaactaaaatacttatgaataaattaaccaaggaggtgaaagatctctacagtgataagtataaaacattggtgaaagaagttgagaaagacagaaataaatggaaacataacttgtgttcatggatgagaagaattcatgttgttaaaatgcccatcttacctgaagtgacctacagagtcaatgtactttctaccaaaataccaatgacatttttcacagaaatagaaaaaaaaatcctaaaattccaatataaccaaaaaagagccagaatagccaaaacaatcttgaggaaaaagaacaaagctagaggcatcacaccacatgacttcaaaatatactactgagctataataaccaaacagcattgtacttccataaaatcatagaccaatggaccagaatggtaaatccacacatttacagcaaactgatttttaacaaaggagccaagagcacacaatggggtcttttcagtaaatggtgttggggaaactagatacccacaagcagaaaaatggaattagatcattaactttaatttatgatgtctctaatgccatatacacaattaaactcaaactggatttaagacttaaatggaagggcctaaactatgacactactaggagaaaacatagggaaaaatctcctaacattgctctgggcagtgacttttggttattaccccaaaagcatggacaacaaacgcaaaaatagaacaatgggattacatcaaactaaaaaaacttctgcacagcaaaggaatcaatcaccagagtgaatgaagtgacaacctatatatagaaggaaagaatatatttgcaaaccgtacatctgataaaaggttactatccaaaatatataaaggattcaaacaatgcaatagcaagaaaacaacctgatttgaaaataggcaaattgaatgaatattaaaaaatgggcaatgaacctgaataaacatttctcaaaagaagacatacatggctaacaggtatataaaaaatgctcaacatcgctaattatcagggaaatgcaaactaaaaccaaaatgaggttatcatctcacacatgttagaatggctattataaaaaacatgaaaaaaacaagcatcggtgaacatgtggagaaaagagaagctttgtactgtattgataggaatgcaagttattatactcactatagaaaatagtatggaggttcctcaaaacattaaaaatagaaccaccatattttctagcaatcccattactgggtatacatgaaaaggatatgaaatcagtgtgttgaagagatatctacacttccatgttcattgtggcattgtttacaatagccaagatatggattcaagtggctaaatggtcaccagcagatgaatggattaaaaaatatatggtatacatacacaatggttgccaaaaaaagggacaagttaaaataaaacaactgtaatccctgcactttgggaggccgaggcaggcagatcacgaggtcaagagattgagaccatcctggtcaatatggcgaaggcttgtctccactaaaaatacaaaaattagctgggcatagtggtgcacgcctgtagtcccagctacttgggaggctgaggcaggagaatcacttgaacccaggaggcagaggatgcagtgagccgagatcgcgccactgcactccagcctggccacagagtgagactccgtctctaaataaataaataaataaataaataaataaataaataaataaataataaaaataaaaaataaaataaggaccttcagccttaagactattcaaccttaagaaagagtgagctgtagtcctttgtgacaatatggatgaacctggagaacattatattaagtgaaataagccaggcacataaaggcaaataccacatcatctaactcatatatgcaatctaaaaaggttgatcttatagaagtagaaaggagaatggtggttcccaagggctggagttactggggaggtgtgtgtcaaaggacacaaaatttcaggaggaaaagtccaagagatctattgtacaacatggtgactgtagctaataatttattgtattcttgaaaaatgtttacagtgaatgtaaagtgttcttaccacaaacatgataactatgtgagacaacctatatgttatttgatcagatttagtcattccacaatggatatatatttcaaaacattatactatacacaggaaatacgtatcactttatttaaaatgtaaatacatattattttatttacaatgtaaaaaatcatgtatatacatttaaaatcaatatgtaatgtaatatatgcaatacataacatatatttatgcatatatttatatatatcaaaatatatttattatattatatgcatatatttatatataataaattatatatttattatattatatgcatatatttatatataataaattatgcatatatttatatatgtattatataataaatatatattatacatatatatatatatagcattctttcataatgaaaccaatcttacacatagtctttttttccctccaattagggtaaagtaatttgagatatcgcttataaaacacttaataaaatgccatattttaaagaaaggtgtctgcttcgatttctagaatagaggaattttaagtcattccacctccaggacaaacctgtctgaaggaacccatagaagctgagtcctgcactcaattttgatatcctacctctcttctgcagacacttgagagcataaacccccagggtagctgagccaatgcatccatttaagtatattgaagcatgagtgctttcttgcgtcatttaaaaagggaggacagtgaaagttcccacttcattagctttcttttctcacattagggtattaaattaaaaagagagtataaattctcattttaaataataaattaacataaaaggattatacatttaatacgttaccattctatttttccccaggtctatatttctcgtgtattattcataatagaagctctgcaattcccaagtcgttgttgaaaaataaatatgaaaatatgtggatgactgcagtgtatggccacacacaaaagaccccagcaaactggagcttaagttaaccattgctccactttaatgaggaactaaaatggaaaaataaactcaaaatgctgtcctttccataaacaatattgcaagtaactccagtatctagagagatagtaggagaaagtggaagaaagtgacagattaagaatgaaagacctttccttgccaacagagttgggtttggaattcagtggaagctgatagtgccaaggttggaacagctaatgagcaaatgtctgaaagcaggagtggggaaactgccaaggctgtttctgtgcacaaagctgtccctccacctaggcgagatgacatttgttcccagcctttgaagaatgatgtcattagaagacggcatccccggccgctcacctcgagtggaaggcgagcagacacactcacagcattatttttaactcagcattcatttccccacttgcaccaacagcaatacagcaagacattacggtgacagacgagacacagcacaggacaaaaagctgcagggaagcaggattttaacgtcaaaatgtgcagaacagtgtccctgttgggctacagtacacaaagtaccaccaacacaagagctgaaaaccctggcagtgacatctaattctcccttcaatttgaaggaggacatggtaaaaaaatgctggtacattaaaatgagaaatcgccacaaatatagaaatggaatgaaatatgtaaaagcgaatgtttctgttgttctctgcattcctagcatggccatttcatctcactattggcaaacattcacttttaaaaatcctcataaaatatgactctgaaagcttggtgcttcttagacatttatttacctgtgattttaactacccttctctatgaattttagtttgctttcctgtctatttttttaaatccccatggtctgaagccagaatggtgatccacaggcacttaagaccaaccccgccatccaaaggctttcgccaagacactcaggtgccacatcgctcctctcagcctctccatctcccaagcaagagcttctggagtcctttcttgttctgacctgccctctttcaccaaatccattctctccttttcctctctccaatttaacaaatgctatctctcttaaattagtccctcaatatcttttgccctacattttaacatgttgtctgtcttgactttttaaatagctttattcctgggttctttgtattcatttctccccactcctaccctggcttcccgctgcaatacgaattattcttctgagagtcaccacgggttgtgttggaatcaaaacatctgcgtttgagtcttgaatgtattactgggtgactgtgcgcagcctcatctctcttctattctttccctgattatgctttatctacgttacagagtcactgtattaattaaggtgacacagatgaaagtgttttgtaaactataaagttttatataaatataaataaaaggtgacatttttatccagcagccaattaactttcctggcagtgttgatccccagcaattagaacacgcaattaagcaccgttcaagttcaatgtggcacctaaaatgggaaagacaaagcttgaaaatgtgttaaatataaaactgcttgttaagttgaaatgaagtgaaagaagggactttgacttttacttctgcctatatgtttgaaggcagcaaacttgcacttctggatagttacatatatttcagaactgcttaagcttcaaccaccatcaataataagcatattatttatatcaatctttgaaataaaaaaaattgcaggcatatgctccaaaataagcaaagggttatgactattgccaggaaaagacatgatgaaaaaatagtattgtttccaaatatcatctaaacacatatgcacacactttccgctatatccagtatttaaaacgaacctcctggggacaagataacaataatttggtttccctgttagcagcattattgccgggatcaagtgggccacttccacttcccaaggaagccaatttttaaggcttcaggtttgctcttccaaaattagctggctgaaatattcactgtgtggtctcccaggaaaagtagtggagctgcatttacatgaacaaaataagaaagtctctttcaatcctaatccacagggaaagccaaaattctaagtcttttcctaaaatttagctaatttcttatctccctcccctaatacttggtaactgaaaatagtaaaggttaatttttaaaaagccttgataaactacaatcctgaccattggagtataatttactttatatattaatatttcatttaaaaacattttactgatcgatcgattgattgattgagacagagtcttccctgtcacccaggatggagtgcagtggtgctatcttggctcactgcaaactccgcctcctgggttcaagccatcctccctcctcagccacctgagtatctaggattacaggtgtgtgccaccatgcctggctaatttttgtatttttagtagagaccaggttttgccacgttggccaggctgatctcaaactcctggcctcaagtgatcctcctgcctcggtctcccaaagtgctgaggttaaaatattttaaaatgtaaacttaaatgttcagaagtcattttatttaagacccttctaagttctgagtaaaggctaagattgcgaatggtgtaaaactgttactgtgttttggaagtagttcaccacagtcttgcactcctggcctcaagccattcttctgcctgagtctccggagtagctggagctacaggtgcgtaccacatcacacctaggcctcccaagtagctgggattacagcagtgagcctctgcacctggctgcttaagcaaaggtaatttgggttctcgcaccttgcaaccaatggggtcatagtcaatacatggatctgtgccaatctgggaaatctaaaaataggtaaacttacatttcaaacagtccttgtttgaatttttgtcagactttattttcagatatttggtgaagggttctaatgtgagcctgactgggggctggggaagcctgtacatatgaagttaaaatctgcggtgtagtgcacaaagtcccctgagggtcctgttcaggccttggtgttgaacatcatctattcactgatgtcaccagatctgcagcctggattcctgaactctactctcccatatctaatttcctactgacagcatccacttctttgtttagtgtgtatttcaacctcaacacatcgataactagactcctaatcgccttcctcaaacggctccactgcatcttctgctgactcagtagaaagcaatgccattcttcctgatattcaggccagaagcctgacctgatccttgatgtctttattttcctcacacctgtatccaaccactaggaaaaccgactgaatagaccttcgaaatagatccggagtctgtcttctacccccaacctcctctgctctccccctggtccaagccaccatcatctctcacctggattcactttccaacaggtcattctacttgccccctttccccgaatagaccattctcagcacaggaatcagatgcgtccttcttctttttagagatggggtctcactatgttgcccaggctggagtgcagtgtctattcacaggtgcaaatatagtgcaccacaaccacaacctcaaactactagactggaagtattctcctgtctcagcctctggagtatctgggactacgggctcgtcccaccttgcctggctaaaagcatccttttaaaaccttagtctggccatgtgacttttctgtttaaagtcatccaataaagcccccatctcactcagcagaaaaccccacgtcctgaaaaccgaagtcctgatctagtaagtcccccgtgaaaaggttctgctccttctgactcagggccttttagtgttttcttgttcacttggctcccaccacaccagcctctctgttattcctcaagcttgccaggcaaactctagacaccgtggttgtatctcttccctttacctaggatgtcccttccccaggtatccatgagctgtcttgaaccccttcacatctttgctcaaaatctcactttttccaggcagcttttcccgactattctgaaaaatttggcaagccccaaatcccaacaactgccatttctctccaggcaataaaataccacataaaataatattttccttcttttgtttgcaagtacttgcaaaggagctgacaagttttatactatatgataagtattcagaagaaaagaagctcctgaagaaaaaattattcaatagaattatttcctaaaatcataaatatattgtttataagagacaataaattattcttttggccataagctagtttgagttggtttctgtcacttcaaaaggattaagatgaatacattcatttatactgatctggcaaatttaaagaataaatgttaatgattcaaagggctttcgtttaaatctatgtctcctaaaaattacattaaagtattatacctatttatccaatggtcatacttctggaaatttttctcgaaagaaataatcttaaaatcagacaaaggccaatgcataaagaagttcatttgatgcctcatttgtaatggtcaaacattaaaaataaactaaaattttagcactgtattagatgttttcaaaatgtagctcacagacctgtagggatccctgagacaattttaggtgatctgtaagaagaaaatcgttttcatgacaatgctgaggtgctgtttgcctttctcatggtgttgacatttgcactgttggagcaaaagccatggtgggtgagactgctgggcgttaccatgaatcccagcagggacactaacaggatgactattcattgtactgtttaccgatgcatactgtgagttggttttttaaaaatgccagattcacttacagacacttgacgaagcaggaaacataacagttttattacatctttaccctaaagctcacgttatttttaatgttctatgtcctgtgtaataaaatgggaagaaggcacagtgtttcctccacctcctgagcagcacggctattttcaagcagagtatgtctgtgcttgcttgagttgcaaattcgaccagctgcttttcttcatggaattccatttctttcttaaaagaatggctacctaaaaacgatggttatgcggtcttttctatttgtcaaacaatttcttacagataaatgagcccatcactcctacaattacaattgatggtgtttattataaataataaaattgaatctttcaagaaagaatagaattttagaaaacttgcatccatcagcatgaacttgacagtttacttgaagactttctgatgagatcatggtaatgttagtagttgtgatattttgatattgtataacaaattgtatcaacatttggaagatctgtgtaacacagtgaaccaatcatttccaaatgatcaactttttatgttacaaaatcatgtgtgggtaaaacattccttccaagggtatgatagaccaatgaattttaagatgacagagtacagaaaatgtgttgatatggcatctgactattgcaatgaaccattaagatactgccatgttttaattctctgcatagtatggagtaccattaggtgttttctggtttattcacttgttttatttgtttattgtttgtctctcctgactgagaagagagtcaatgaaggaaaggaccttgcagacctttttcattgttgtattcctcagtgtctagagtagtgcctggcatgaagcagatgttctgtaaatgaggattaaataaataaacacaaccaccaaatgaacctttatgcagcctggtttaccaagaatatctagtgatttgaggaaattctcaagacatatggttattaaaaaccgatttataattatgtgcaggcatatctaatatacaatgcacaatacatattctataatatataatgtaatgcaatatatatgccccgtaataatagtatacacatattattatttccatgtgtgtgtgtctgtatgcgttctcacaaaagtaaaactcacagggttggtgggaaaagaagcttggggaagaccacaggaaacctatgcaactttgtaacaagggcaactaaaagccacttattggttcctggagagagaacttggacacctcagacaggcagctcaatgtggctagaagcaacacccacaggtttcggaaatagttttataacatattagttctattcctaggacccacctcaggtagattccttacataattaaaacaattttatttcatattcagctcaggaaactgacttgtagaatagaagaaatgagtctttctgaggctctgccactaaaagtctgcgtatccttggatgagtctgatcaccttattgtttttttctggtaaggagattgtagtcaattcaaattgcaggatctctaaagatcatcctgacaggtagattccatgacagtccatgtcatgatgcaaagaataatttaatgaggaaaacgttctgtggcatcctttaaacatataatttctatgttgttgctttgacctgctcatctacagaagataagacgtttgtttgaaatcctcatccaatacagaaaatcccttccagtgaagttctaagagaccttgcttttaggaggttttaggaaaagaaggttatttatttaaaaattatctgagagatgactagataatgaagctaatgatgtgctccttttttttctgttgtattgttaacaacacatgccctctggaaaaccaagccaaaattccacctggagagaaaatcagatcaactaaagttcctgtgaagattcagtcagtagtaaagaggacatctcatgttccctgtcattcttcagcctgtacaattatcctgctctaaataagcagatcttggattacccgacttcaaatcattggtctgggaagtagtcgggctatggaatgagttgtgtgggaaccaggagaacagggcttacctttcacggtcacgtggacgctctggctggtggagagttgtggttgaaccaacacgttgcacgtgtactccccctcgtccacttccttttgcacatctgaaagtttaagagttccattgttctcaaatgccacttggcggtggttgaaaggaagcaggttagagttcttgtaccatttaatggagtaatacggatagccaatcacacgacagtgaatgtatgtgtcccgtcctgctattgctgtgatgtttttcattggtcgaatgcttgcaggccctggagagacacaaagaaactcttgaaaataatttaagggtacatctcatgtagggaaatgggtacacttttccttgagttaaaaatgtagattatattcatgtaagcacatctttttcagttaaacaaatatttttgcatgtggcattttctacaacaaaggtttttctttccttttcttaaattcaaatgtataactgtgaaacactttatctgctacttctatgaaaatgttttgaattaaaaattacaagataaaaggcaatttaattaatagaaagtaactagtctatactggacaatcacgcacttttggtgaacacactggcagcaattgatcaattgtttaactctctctgtaaaatctaggacgacaatggaggttacatcacgttgcagcatgaatgtaagtttaataccatgtacatgaaggtttaccatgaatgtggaagaaccgaagagaaggagaagggaaagggcatgcagagcataaaccaggaaaggaaacatcaggtgaacagatctagagtaaaaaagaacaagctgactacagaaaccaaaatgccatttccaacattaacccagtcagtgccattcctgagtaggaaggagagggtaggaaatgggaagcaacagttaatccgctctggcattccaagacccagctcggtgcatgcagaaatcttcttctccactataatgagttatgtgtgtttttttgaggagctgatttgacaagcacctcttacgtttattcgagcctggtacaggacgactcccgccgagttgttggcagtgcagcggtagactcccccgtcccggacctgggagctggagatgttcaggtagctgaccacgttcccctccgacgtgatcatctggctgatgcggtgactgccacccttgagaatcgggtcatcgtccagggtccacgtgatcgtgggcaaaggtgttcccttcacgttgcacataagggaaaccggctctgctggactcaccaccttttcactaaaggcagaaataattttgggagttccatctgcaggaaaacaaattatggaagaaagtggcacatacaaataattaaacaacttccaagtatatgtctttcatgtctagggggtaaatgtcgtagttgttaaacattaccaaaaaggtctggttttcctgataaagcaaaacgttaatcagaacaagagttcactgttttcaaaacaggtaagcacagtgttagcaagctttcatcaactgtttctatatttcctgattgacttaagaggaatggtaatacaactcagatgttcaggttaaacaatgacagctcctaagaagtccttaatttaaaactggtgtttcctcacacaaagttataaacagacggaaaatccacacccgctcactcccacaaacagtcactttatctgttaggttggtgcaaaagtgattgcaaaaagtaatggcaaaaacagcaattacttttgcaccaacctaatacttcctcaagttatttggggttttctcactagggaattctttacaggaataaaggaaactactgagagattgatgacctcatcttcatcattttctcataagaaatcctcttttaataactttaattacaaatagtaattgcatgcaaacttccatgaagtctctgagaatgggtagaagctaaataaagtttgtattaaatgccgtgtattaaaaacctctaaagatatcttaagtagggtacttaagcatgttttaaatctctctaaaagtatcttaagtaggctggccatataatttaacatccaacctgggacacttttgaggctgaaacagaaaggactaataattatgccaagagaacaggcatgacccagaactatcgcaggcaaactaggatcttaatcttagagaagtctccatagaaattttcagtatgtttacatagatcaaattttcatattccattatttttctatcatccatatggttttttctcttatatagtaatagttacaaatgcatgtttcttttatatatgtttttccatttataaaaagaaatacatgcatattaaaggaaatgtatgaaaatcagaagaaaagttaccaataggtcagccagcctcaggcatacaaatcaacactgtgacacattttttctaggcataagtgggtcattttgacataattgcaatcacatgccacaggatttctgagtctggtaagagaccttgctggaggggacatcttttgttttttaaaagaatttttgtgttcaattaaagggttgtcccataatgaaagataagaatgagtagattttttttagtttttgattttattataaaagtaatgaatctccattgttgaatatcttttttgttgaaaattggaaagtattataaacaaaaagaaaggaggcaagcaaaattaggatagcttgcaattccatcagggaaaggtgacagttaatggttaatagtaccagacacctttgaggaaagtgccactcattcccccagaaccttggggcctagttcttggtcagggaggccagttatgtagggtcttcatggtgatggggctgtgctgcagctcttccctccaccccctactcctttccaaattcctgaatctcacttcttcattccagctcatgtttcaggtggctggagaagtccctggagtttgtttcctccaggctatgctcataagtagcatattgcagtgtccttgggttgtaagcattttgtctcttactatcagagatgaaaaagacaactttaaaatattaaaatgaaaaattgatgcttttgtctttaacgcactgcagacgttgcctcatcacatcctgtgtttaattttacagagaagttagatgtcatcatgattgctattcattgtccatgatcagtcattaatacttaggagtactggagttatttcacgtgtcctttataattccatggtttttgtaaaatgtgtttagctgtagatttcttttcactggtttttacattaagctctgaaaactcaagtgtttagaaaaatgttcttcagttatacttctctttttgtaggtaaattttacatacagtgaaatatacagatcttaagtgtacagcttagttttgctaaatatatacacaccagagtaaccacaaaaacgatcaagatataaaacatttccattaccaaaattccttaagtgctcctttcaataaatccacatccaacagagatcactgctctgattcctcttaggatgtgctggttttgcctgtgcttgagcttagaagaaacataataatagagtatgcacgctttatatgtgcatatatatcatcataatcagagtacacttagaatataattagaagatgtaactttggaacagtactattatctaactcactgtccacagcaaaattctgtccattgaccgctaatatccctcgtcactgttttttttccagagcagtccgtatcacccattatttatgtttcatgtcatttcagcctcttttcatctggaacattcttcagcctcttttgtgtttcttgacttttacatttttgaagagtaattttgtagtcagttgctgaaattgggtttgtctcatatttcctcatgactaaacgcaggttgtatatttttcccagaaataccgtggaaggcacgtgttttatgtgcctattggccatccgtgtgtttcctttagtgggtgtctgctcaaatctttggccattgttatattagactgtttgcctttttgtttttgatttgttgtggaatacaacaattgaaatacaaggaaatatatatatagtatctatgtcagatatcttataatgatctgatacatttgtaagattcctatagagattatatataatatctgtcaacatatatatgacacatatatttgtgtgtgtataaaatattttatcccagtctgtggttgcctttttcttttcttaataatgtatttgtgttgacatttaatgctttctgtgtcctaagaaatcgtcacctattcgcaaatcatgaagaattattctgttttcttttggagactgtgttgctttatactttatattcaattctatacggatagcaacttaattttgtgtggatatgaagtgtgatgtagggattaatactcatttttttgccatacatttattgagttgtttcagtgttaatttgttgaaaaggtacatatagtatgtgtatatgtgtgtgtgtgtgtgtatatatatatatatatatatattttttttttttttttgagacagtgtctctctccctctgttgtccttggtgtggcacaatctcccaagtagctgggactgcaggtgcacaccacgccttttttttttttttttttttttgtagagacaaagttttgccatgtttcccaggctggcctcaaactcctgggctaagggcctcagcctcccaaagggctaggattacaggcacaagccaccatgcctcagttttgcttgaaatcacattaatcgttttagagagaattgttaacttaggaatatttagttttctaatccttgaatatggtatatcttttcaattttttaggttatttcaattttatattagcagagttttgtatttttgtatgttgaaatctttcacgtttgtttaaaatatattcctatcttatgttttatgttattgtaaatgaaagtttcaaaatattagtttccaattgtttgttctgagtatatagaaataaaattgcattttgtgtatcattcttatatccaatgactttttaaactctcttttagaaattgctttattgttttcttggcatattctttgtaaacaacaatgcctgtaattaagacagctgaaatttttcctttccaaactccatccattttatttctactcaagcctaactagggctgctagtataatgttgaatggaagtggtggatgtgggcatccttgatttggtctcaatcttaaatgaaaaacatttagtgtttaaccaggaagtatgattttagctgtagattgttcaggatgccactcattaggtcaaggaagctctctagagtctcagtttgctagaaattctttatgctgaatggatgcaagtttcatcaaatgattttttctgtatatattgagataatcaattggatttgctcccttattctattaacatagtgacttacacggattagatttttaatgttcttccaatcttgcattataagataagctccaattgatttacacacacacacacacaatctatatgtatatcaatgtgtgtgtatatgttttaaattatctctgctaaaagttaagattgcagtactttatgtgaaatgtaagaaccctgcaacaaataattctgccctttgtgttattacatctattatatttactctataataaagtgttattttattttactttattttatttattattattttatttcattttattttattttttattttattattttatttcattttatttattttattttattttatttttagagatggagtctcactctgtcacccaggctggagtgcagtagcaggatctcggctcactgcaacctccacctcctgggttcaagctgttctcctgcctctgcctgtagctgggattacaggcacatgccaccacacctggctagtttttgtatttttagcagagacaggattttgccatgttggccaggctggtctcaaactcctgacctcgagtgagccgcctgtctcggcttcctaaaatgctgggattacaggcgtgagcgacagcacatggccaagtgtggtaattttataatgttataatcatcaattgtttaaagaaattaaaaaagaaaacacaattttgctaaatatttactaatatatttaccatttctcatggtatttgttcttatagatatgtctccattttatgttccatttctgttccatgttatctatatcctgtagatataaatgtccattctctatatccggcatgacttcatttatcatttattaatgtgcagggctgctgacattatattctttcacctctttattactgaaaatatctttatttttccttaatttttaaagcctgttgttgttgggttttttgctacagaagtctgcgttggcagggctgtgtctttgtttttcgttttcttttcaacattttaaagatgttgctccattgtctcctgtcctccaaaatatccgatgaatcatctaccatttgttattgatgtcctcattatgtaatatttttcctccctcagatttttaagtttttctctttatcttcggttttcagcagcttaactctgatgtactgacatagaattttctttgtgtttatttttggagtttgctgagtttcttagatctgcaaccttacttttataccaaagtcgataaaactaaggtcattatctctgaatacttttttcttctgcattccgtatctcctatttttctgggcctctagtcatatgtgtgtgtcacgttatctgatgatgtcctacttgtcactgaagctctaatcattttctttgcagtcttctttctctccatgcttcagattgaataattttctaagatttatcttcaagttcactgatactttcttcttccttctctaatcttgtattaaacaaatatggtgattttttttcatttctacagactgttttctacagtttcaatttctctgttggtctttcccatacgttcactctttcagtccatattttcctgtaagttattgaacatattttaaatagcatctgtaaagtccttgtttgccagttctaacatctgggtcctctcatgatttgtttctatcgtttgctttgtcttttgtcctttgggtgcagagtcctgttttttgtatgtctcatttttattgcacatttgtattctcactccccatttttggagttcagatgtgtcctcagtggaagaggacactccccaacttgattttggtgtctctcaaatgtctatatatacttttgcttttcccaaagtttcttgtttttatcatcttgggagttaggctgatatatgctattttaccattcccagaactggaaacttttattattcttttttaaaatcattccatttttcaggtattatggttttatcctgaacttataattattaaattccattttatagcctcataggaaatattctcagattctccattgtatctatcctcagtcctagttcacagtattgcaaatttttataattttactttaatccatcgctatttcagtgagaataatgggagtgtttttgttttccagaggaaattagccagacactcttttaaagcaggtactagatatgtatttgtaattccatttctgctttctttgctacattagcactgtcatctctcagaagagagaaaaaaaaaagtgaagcttcttgtcctgaatggaagctgacatgcgacaaataaatctgcgagtgtgctggcggtgcgcctcggccccctttttagttcaagtgacaggctcttttggagatgaaagcagacattattttcccagggagacctgagtgtctttgaaatctttcttgctgtcactctgataacctgaactcttctgacatcgttatggatcatcaatatggtctttaggttttcttagttgcaccaaatggttgccggggtaactgggcctagacaggtaatttctcctttttctacaaagaatctaaaaatagtgactatgtaaggactagagtgcatcatcattagcaaactggttctgcacaaattgattactttctgcacttaattattatacggaacacagtgtcaggcatttaatatgaataccatgccttcagctaatttcacctctgctttaaaaatctcactgtctgcaatgaaacgattgaatcaaaataggaatctcattgctaaacctgctacttcttaaaaaattagctaaggttaaaaaagaatgacagaaatatggtcttataatcaagatatatttaaacttactttcacatattagtgtgttttctttgtactccctttaggctatatcaaaatcattttattattttaatcaattgatatcagatgaattttaaattatatatggacataatttccaacaagacacacaaatacatagatagaagctagttcaatcaggtagtgataaatatatgttgcctgtgatagcttctttctctggctgactgataagctttaagatttagtatgcagtaaccagttaaaaaaaagcaaatcgtatcacatatccaaaacctgttattataccacaaaataattcctcacaaatttcatttacttaaatctgagaacatttggatggaactagggacaactgcaccaaacagatgccatattttcattctaccaaccactgtactgacattttgctctgcattttcaatctgaagttgtacttctccactggaggctattgcccccaccccacccagcaaacacctggcaatgtctggagacatttttggttgtaacaacttggaggaaggtgctcctagcatacatctagtggaaaggggccagagatgctgccaaagatcctataacacataaaaaagtttcccaagatgcctgtaatcccagcactttggggggccgaggcgggcagatcacctggtcagaaattggagaccagcctgaccaacatggagaaaccccatctctactaaaaatacaaaattagccaggtgtggtggtgcatgcctgtaatcccagctactcgggaggctgaggcaggagaattgcttgaacccgggaggcagaggttgtgatgagctgagactgtgccactgcactccagcctgggcagcaagtgtgaaactccatctcaaaaaaaaaaaaaaaaaaattccccaagcaaggcattcttgaaagaccctggtctagagatgaataatcaacaaaactgttaagtgtcaagtttcttctaagatttaaaccctggcagataacttctaatgcacaagtgggcaacatttatgttactttacattacttctaatatgaaacaattttattttcgtcagaactttctctcccatttgcctgatttagcttgaaaaattagggtagagtactagctggtgagacagagagcctagaactgagcgatcagcactgcttcaccctgtcttcttcttttctgagtgctctgggtttgggttctttttcagccataccctgaaacgaggcccactgaccttcaaggaccacctgcacatagtcttgagcggacagcttgtccttgcgcacaaagcactggtatgcgcccccgtcacttttgaccatgtgatccattataaggttttcgtggttgatccctgtgatcctcacattttttccagggttgaggatttcaccattgcggtaccaggagagttcctggtcctcagttcctgtcacgctgcaggacaaggaaacttggctacccacgctgcttttaaccttcctgggactgatggtggctttcagtggctctggaggttttagtaagagagagagaaaaaagataaaaacatcactagatagcatttcgacaacaggctggactttcaacaaagcaagtgcatcacgcaatcatactccacacagttcccatcagccacattattgcaatcatactccacacagttcccatcagccacattattgcaatcatactccacacagttcccatcagccacattattgcaatcatactccacacagttcctatcagccacattattgcaatcgtaccccacacagttcctatcagccacattattgcaatcataccccatacggttcctatcagccacattattgcaatcataccccagagagttcctatcagccacattattgcaatcataccccatacattttgtatcagccacattattgcaatcataccccagagagttcctattagccacattattgcaatcataccctagagagttcctatcagccacattattgcaatcataccccatacggttcctatcagccacattattgcaatcatacccacacagttcctatcagccacattattgcagtcatatcccataaagttcctatcagccacattattgcaatcatactcctaacagttcttatcagccacattattgcaatcaaactccacacagctcctatcaaccacattattgcaatcatactccacacagttcctatcagccacatttttgctatcatactgcatgcagttcgtatcagccacattatttcacagaggagcattttgtttgggaacatcctcttcgctattttttatttctggctttatttctctttgcaacaaatgcaataatgttggtcaaactgccttctcaggagtctctgtgaggatgttgatataaatccactgacaataagagatacaggccaggcatggtggctcacacctgtaatcccagcactttgtgaggccaaagtgggaggatcacgaggtcaggagatggagaccatcctggctaacacagtgaaaccccatctctactaaaaatacaattagccgggcgtggtggcgggctcctgtagtcccatgtacttgggaggctgagggaggagaatggtgtgaacctgggaagaggagcttgcagtgagctgagatggcgccactgcactctagcttgggggacagagtgagactccatctcaaaaaaaaaaaaaaaaaaagaaatgcaacatgctggctaccaatagtgacctaagtattgatcatataaatcctaatttgccttgtcccaaggtggcactggtgggtttgccctgggccattctcacacacatgtatgacatatgtggtttacccagggccaataacacacaattgtgaggaaaaaaaaaacaaaaacaggttggtattagaatttgtgaccacgaaacagagtttttctttaaaatggggctgagtgatttagacagggaagaaactctcatcctcgccttgctatgttttcaattcaacaaccttaatccaatgtagaaaacatttactgagcatctgtcatatgccaaggatgaggttaaactcacaggcaagaaaaatggaataatatttgtggtgcagctagcttgtgctataaaattatcgactatctttcatacatcatttaagtcagtcttctcctaatcctgtaatttttgtgttatctctattttacaaaacagaaaatagttattgagagcgcttaaataactcagccaaatccaatcaacaggtaaatggcaaatcaaaacaaaacaaaacaaaatttttggtgaaagacctacagttacagatttttaaaggtcagaaagtgctgagcagagaaaatctgatgaaaatcctgtctagtcatattacaaattatggaaaacgaaaaataaagagaaattctttaaagcagacagcaaaaatggcaaatgacatacagagaaacaaagatctgaatgacctctgattgtttagcagaagcaaatggaggccagaagacatataaatatatcttttaaattaacaaacatctcttgtagatggcagatggctaagatttgctttttaatccattctggtaatcttctcctattattattattattatttatttcactttaagttctgggatacatgcgctgaacctacaggtttgtttacaccttatacgaaaattaactcaagatggattaaagacttaaatgtaaaacctaaaaccatagaaacgctagaagaaaacctagtcaataccattcaggacatatgcatggacaaagacttcatgactaaaacaccaaaagcaattgcaacaaaagccaaaattgacaaatgggatctaattaaactaataagcttctacttactcagcaaaagaaactatcagaatgaacaggcaacctacagaatgggagaaaatttttgcaatctatccatctgactaaggtctaatatccagagtctacaaggaacttaaacaaatttacaaggaaaaaaacaaacaaccccatcaaaaagtgggtgaaaaaaaagcttttttttaccccagttgttcctaacttttcatctcaccacactttgttttcaaggagctcagtcttctaggttgataagacaaaggcaataaatggctgtaataaccaaccagagtgatggaggggccattagagacatagcacatgtggaggagggtggatgggaagagcaggaaatccacagatatcaagggtgcatagaactgagatcagtcagaatggaaagagggaatcacagagattgggaaccacatgaattaaggcagggagcaggggcatgtctgagaatttctgattcattttggatgcaacagagagtccctgagattttggaattaaacaaagataactaaagaaggcattcaaaagtgtttagcaaataagtcatacttttttttttttttttttttttttttttagaattggggccttgctctgtcacctaggctggagtgcagtggcacaatcatacagaggagtttctgtagcctgaaactcctctccctttctgcctcagcctcctgggtagctgggactacagacacaagccatcacacccagcacaaacatacttttaatggaatcactaggtcataggtcttttgacaaattagggtgaggaaaacccgtcattgaagacattacacatgtctagtgtaggtacaattaagatccaatctaggacaggacagaggttgagaacagagctgagtaactgtgagattcagtttgtatgacttggcaggacatggcaggacttggcaggatgtagaaaggaaaggcttaaagggcacccaacatttcatgtttgcatctgagggatgagaaggaggaagatgttgataataataacaagagccatttggaaggaagaggtggtggagagttcagtttggtatccgaccctgttgttttgaagtgccaactaaatttctgaaagaaagctggttgacacacttgtctgacattcaggaaggacgccaaggctgtaagtacagattcagagcttattttcaggggcaaggaattcgaagctctacaaatgaaacagagcctaaggaaaagggaagagcttgacaagaagacagttctgaatttggagcccaagagaatgccttccaatagagaagagagataggaacgaagaagctgttttcttctgcagttagaagaagcagtcagaagggaggcagagaatattccagaagcattggagaatcacctagatgtggaagaagggaacaatgataaaaataagcacattaagaataaaggcttttaaaatataggtagtgataaacgcctttagagagaaagcagtaacatactctgagttgagaaggagacaggagaatggggaacaacacatctttgtggatggaggctaagagagttgggaagtgttagataaccaagtattgggaaataatcttccatgtggaggaagcaacataagtaatgtgacttgcaatcaggaaaggaataggtttgtgcagggattaggaagaagttagatttagcaggaataggtttttattaacccatttatgcctgaggttgcaattttttttgaatttttgcaatcagaccttggtgatgaccttgcacagtaggatgtaaataactcccacatgcttagtgttccaataatggaacactagtcataagtgggttttaatgcaaaacaatgggaaatacaaccagacagatttgcttgagatgccttcagtactatcctaagatataaactttattcaatggagaacagggagctaggagaggtctttaaacacagaagagactttgagcccgtgggaataattcttactggctgtccaatgctgcattattttatccacatgattcttcagctatagaagtgtgactgtggattttatcatccatttctttctaatcccagactaaacatattcaaatatttgcaggattcaggctggacagcctgttccagatagagagtcatttggatatttaatataaatatattctcttaggctggtgttgcgctaaggcagtctacactcaggttgacactgaagagaaagttccataaacagggttagggctgggtggggaggaggaagtaagaaaacacttctattgtcactgtgagattcttgtggttaaatttgttcaatttagttcatcaaataaaaatatattttcaaaaaaggagcattatattggcaactaagacctcctctctgaccaatgctctgcctcccttttctggccatgtgatcttgggtaattcactttaatttggtttctgcaagagcaaaattgagggtggttgagtagattagattgtgaccctgcgatcacatccctccttcctccaaatctgccttcagtatccttctgaacacattcctcaaggcagccaaggcaatcaatagaagatcaaataaatccattatatttggagtagatgatctataatactaggcacaagtctaatatttgggtatgtttgagccccgtactttgggtgataatagcctcatttagaaatttaatggagaaatggtctggaaacagacaaaggacaactgctttgattggctaccatcacttgtgctgaaagaacaatcctaccctctctctctgttcatttttagagagactggttgttgtgaattcatcagctaggaagtgttatcttgaaatcatatcttggaaatgtaatagtctgtggcctaatggaaatcacagaggtttggggatcagaaagatttcaaatcaaatccgacagccaagactctccagttgtgtaaccttggggaattcatctgagcattaattttcacatctgtaaaatgaggtttctgttgatctcagctggactgttttgggagttaatggaaagctacagagaaaacatggagatttgcttataacaggagctccatcgatggaagccaacaccacctttgcaagttaccgtccaacttacgtttcacgtacaggcggcctatcaccttagcagttccgtatctgttggacacttcacaaacatagctgcctgagtccgaggggcgaatgttctcaatgagcagccccgtcacggtcttctggaacctccctgaaagttccaggggcatgttgtccttcagccagcggtaatctggctcagggtgcccgagcgctttgcaaggcagctccacacgctgcccagccatggctttgcgatggtcaaacccatccagtatggatggggctgagttcgctgggtctgtagaagaaataaaaactcttagaggcaggaatgaggagttgaagtggtcatttagaattgtaggacttcatgtataacttaaatacggtgcatcataccaactattgatacagatctttaagattttataagtgaacagaaaaagaagtgccctattcatacaatttattttctgctcagaatttacaaaaggttgaacactggtcagagcttctgttggtcattcctcagtaaatgaataaaagatccagaatgagcaggcttcaacaagagctgtcagctcaggccaaaaatcagattgtcttttcataactgggaatgtcagaattctctttaaaagatccttaatgggtacaaatatgcaatttgagataagaaataagacctagtggtagacagatcagtggaatgactatggtttgcaattatgtattgtatatttcaaaatagctaaaacagaagaattgaaataattatagcttaaagaaaagccaaacatataatgtgatggatatcccaagtacactgatttgattttaacaaattatatgaatacattaaattatcacatgtaccccaaactatatatctattatgcatcaataaaatatcataaaattaataaaataaatattttttaagttagtggctcactctgtagctcaggctggagtgcagtggtgcaatgattgctcaccacagtctcaaactcctgggctcaagtgatcctcctgcctgggcctcccaacatgctgggattacaggcatgcaccaccacacccagcctaaataaatttaaacagaaaaaaagagcaacactaggccgggcatggtggctcaggcctgtaatcccagcactttgggaggccaaggcaggcagatcacgaggttaggagatcgagaccatcccggctaacacggtgaaaccccgtctctactaaaaatacaaaaaattagctgggtgtggtggcgggcgcctgtagtcccagctactcgggaggctgaggcaggagaatggcatgaacctgggaggcagagcttgcagtgagccgagatagcgccactgcagtccggcctgggtgaaagagagaaactctgtctcaaaaaaaaaaaaaaaaaaaaaaaaagagcaacataagcagaaatagctgtttaactttagtaaaatttattgcacaaaagagttttacacatagcttttgaattttaaaacattttatttattcatttcacaaatatgttttgatccctcagtgtagaccagcacagagttagggactaaagggagagtggtggatgagacaggtgtcttcctggagctcatgttctgttgggcgggtggtgttggggagcaagcaacacattagcaagcaaataaagataatttagtttgtaataagtgtagttaaagaaagaaaaagagggcataacagagagtgaagtccacgtgctatgggtgtggaggcagccaggaggactcaagatatggtcctcagggacagactctctgagaagatggtatttgagataaggtgaatgagcactaccgacagcatgtggcgtagcaagacaatggattaaaaagcagcagcttgcaaatgatcacttatgacagggccttgtataattttcctgttctgtgacatcatcttgaaccaggtgaggaaattgataaaatattctcaagaactgggtctgtggaaaccacgcagctcaatgtccttcaagtttgtttgaatggagtgatgttcccaaggtcataatctttgcatgactatgaagaatataaaatacagcacctgattggatgctaaacgtaaaactcagtgttctcaccctgctctctcttctaattcaacctgtttagaacttgcatgaaacaatacccttgcattccacatggatattacagaaacgttatagactcctgctacctgaaattttcttgtctttgcctcagtgagaaaaatgccatgactcttttgatctacctgcaataaatctgatggccaaggaatggatattcactgtcctatcaaatgagagccatctggaactttgtaattttgacgaacatctctattccctgcttctctgagtttgacttttttagatttcacatgtatgtgagaaaagacagtgtttgtctttctgtgcgtggcttacttcactaagcacaatgcccttcaggttcatccatgtcattgcaaatgggaagatttgcttccttttttaaggctgaataatattcctttgtgtatataggaatgatattcctatgcatgtgtgtatatgtatatcaacacttaagtttttttcatattctggctgttgcgaatgattctgcaataaacatgggagtgcagatatgtaatttcatttcctttggatatatacccagagtgggattgctagatcatatggtaggtaaaagggtacaaagcttcagttatgccagatgaatagattctagaggtttactatgcagcacagtgactacagttaataacactatcttacatacttgaaatttgcaaagacagttgatcttaaacattgtcatcacatacacacacatacatacatacacacacaaatgttaactatgtgaggcaatagatatgttattttgcttgatagtgatatatatatatatatatatgcacattgtacatcacattgtataccttaaatatatacaattttcatttttcaatacctcaattaacctggaggaaaaataaactctagccaaggagatgtaacaggcgaaaatgtgtggatttgtaggaaattctgcttaaaggcgacttagctgggaggggtgtttttatgcatttttcctttgcttctttacatcacctggaaggtggatataaaggtaggagctgcagcaatcactttggactttgaaatcatattgagaatggaactgcacgtgaggataatggatcagaaagataaaagcctggtcccttgtgaaactgaagctggcaaaccagcttctggacttatatacaagagagtaaatttctgttttaataaacaataacatcaaaaaatcatttattagtaggaagacttctttaagaggctgtgattccgtagtcagccactgagggcagtcagcaggcactgttgaaaatagaacaaaaacatttagctgaaatgtcttggctttctatttcttttgtgatcatcagagataaaacttcattatgaacttgctgctctttttacttcactggtgtcttatgacagtgatataatgagggaacctaaatactcttttaaagaatacttgatgagcttccaggactcctctaattcttcattaactgaagaattctatattccagaattacagtcattcatatgcatgactatagggctccagaaggcaagagagatataaaagtttcacaatacccaggtacagagcctgtgccagcaaaaacttcattgcttcatttacctgcttctaaaggaaattacaaacggactttgaaaagtattggtttgaagatcaagttatgttcccatagactgaataattaagtggagacaggcctaaccaatgatgtctcactgatctctggcatcttctagcatgaaccaagaatccagaaaaatggttagctgtctgcatccatgttactggaagtatcatcacctgcacacccaatgggttcagtgaactagaagacacaaagttgtgcctaaagccagctccagaaatggtcctggacatccttaaccacatgggattttttaattcctagtacactaacttgcagaccatataaacaccattgcaatattgtttagtaagtagaaatcacatccaagataatatgtattacttggggtaagcttctctattattctgaactctgtcttcatttaattaagaaatgtgagaattggacacaggaaggggaacatcacacaccagggcctgttgtggggtgcggggaggggggagagatagcattaggagatatacctaatgttaaataacgagttaatgggtgcagcacaacaacatggcacatgtatatatatgtaacgaacctgcacgttgtgcacatgtaccctaaaacttaaagtataataaaaaaaaacaaaaacaaaaaatgtgagaatataatgatagctctcgttcttcagtaatacagattttagttacactagagtggaatattgaagatattagaaagtactatgaaaaaatagctgcaaaatctgtcattttacttagagtaggaagtagaagtagagttggagaaggtggcacaaagatgtcacccctttggcaggggtggctgacaataaacaccacagtgtgcacctctgactttctttgcagaataatcccacaatctctgaaaatgaaatgcaccaacttctaatgctattcataaaaaatcaactctcaatgactgcacttaaaaagttttattctaactgaaacttggcagaaatttctcaaatatgcttaagatagtgctatgtaattctaatgacatttttaaaaaatggctgagacaactggatatccacatggaaaataatttagaaccttgcctcacactacctacaaaaattaactcaaaatggattatggcctaaatataacagctaaaactataaaaacttttagaagaaaacatagggaaaatatcttcatgaccttgaagagttcttaggcataacactaagaaaacaagcaaaaacagaaaaaatcaacataataaacttcttcaaaattaagaactggcccagtgcggtgactcacgcctgtaatcccagcactctgggaggccgaggcaggcagatcacatgaggtgaagagttcaagacgagcctggccaacatggtggaaccccgtctctactaaaaatacaaaaattagccaggtgtggtggcatgagcctgtaatcccagctacaggcagaggcaggataatagcttgaacccgggaagcggaggttgcagtgagccaagatcatgccactgcattccagcctgggcaacaaagcaagactccatctcgaaaaaaaaaaaaaaaaattaagaactgtagcattttcaaaggcaccatttagaaagtgaaaaaaaattgaaaatcatatttctaataaagaactcaaatccaaaaaatattaaaaatgcttatatctctataatgaaaagaaacaacccaatcaaaatgggcaaaatagttgactattttacatcaccaaagaagatacacaaatacctaatcagtacacaaaaagatgctcaatattactaggcattagggtaatatgaattaaaatcacagtaagacatgacttcacacccattaggatgactgcaataaaatcacaaacaatgctggtgaagatatggggacctggaatcttcatacatcgttggtggaaggtaatatatacttacatatgcacacatatacatctcacgtaaaaatggcttgctggagtgccagccttcacatccacatcacagcaaaaatgcttaagaatgccccctcagtgaagtcacttttaagcagaatttcctacaaacccacacatttttctcctcttacatcacattggctagagtttattttttccccaggtgtattgtggtatacttgccaaataaaagcagccaaaacaagttggcattttcttaaagtgtttaaacttcaatttgccataaggccccaagttctaggtatctaccctaaatgaatgaaaacatgttcactcaaagacttaggtacaaatgtccatagcaggattattcataatcaaaaagtggaaacaacccaaatattcataatttagtgaattgataaccaaatgcagtatttacagatgagcaaatgctctccagcaacaagagagaatgaatgactaatacatgtaacaacatgggtgctgcatgaaagaaggcagacacaaaatccatatatcaatttatgtgaaatatccagaaaatgcaactctacagagacagaccatagattagtggttgtctgggactggggatggacattgaaattggcttcaaacgggtaggaggaatcttttgggtggtgaaaatattctaaaattaaattggcgtaattgtggcacgactccatgcatttactaaaattattgaattgaataaaccggatggagtttatattaaagtaaactacctctcaacaaaactgttttacgaaacctgaatgaggtatttatttttttatttcaacttttattttagatataggcggtatatgtgcagatttgttacatgggaatattacgtgatgctgaggtttggagtagagatcctgttcctcaggtagtgagcatggtacttcataggtagtcttttttttttttttttttttttttttgagacagagtctcgctcagttgcccacgctagagtgcagtggcgtgatcttagctcactgcaagctctgcctcccggggttcacaccattctcctgccttagcctcccgagtagctgggactacaggcgcctaccaccacgcccggctaattttttttgtatttttactagaggcggggtttcaccgtgttagccaggatggtctctatctcctgaccttgtgatccgcccatctaggcctcccaaagtgctgggattacaggtgtgagccactgtgcctggcccttgataggtagctttttaacctaaactctctgccttccacagtctagtgtccacagtgtctattgttcctgtatttgtgtccatgtgtggtcaatatttagctcttacttataagtgagaacatgaggtacttggttttctgttcctatgttaatttactaagaattatggcctccagctccatccacattgctgcaaagaatgagatttcattcttttttatggctttccagtataccatggtgtatatgtaccacattttatttatccaatctaccattgatggacacctgggctgatttcatgtctttgctattgtgaatagcccagcgatgaacatacaagtgcatatgtctttttggaagaatgatttattttcttttggatatattactcagtaatgggattgctgggtcaaatggtagctctattttaagttctttgagaaatctccagtctgctttccacaatggcaggactaagttactttaccaccagtagtgtataagtgttcccttttctctgcaccctcacagcatctgatgttttatattttaagtgcatgattgaagcaatgcttgagacaggctcttgtggggatatttggtcatatatcaaatctgaataaccgaacggcattgtctttcattttcatccccttcaaatttttttttgtctcaaagtcttcaaacttttatatatatatatatattacaaaaattatttttaccccaaacatttgaaaacgtacagaaaagtagacaaaaataatatgacgcatcccatatattcatcatattaatggctctggcaccaaaccttttctatttttcgtcatgtttatttcttgatagttttactttgtttttggtggtaaagtatatgcaacaaaagggaaactataggctgggtgcagcggctcacgcctgtaatcccagcactttgggaggccgaggcagggggatcacaaggtcaggagatcgagcccatcctggccaacatggtgaaaccctgtctctactaaaacacaaaaaattagctgggtgtggtggtgcatgcctgtagtcccagctactcaggaggctgaggcaggggaatcacttgaacccgggaggcagagatcgaagtgagctgagattgtaccactgcactccagtgtggcaacagagtgagactccatctcaaaaacaaacaaacaaacaaacaaacaacaacaaaaaacaaaaaagggaagctatgtcattttatcattacatgactagcatgtttccctaataaaaatacggttttgttacataaccacagtcagtattacataatatcaagtattatacactcccaattcatttttcctcatcagctcaaaagtggctagcttttaaacaattgaattaattaaatcaagatccttctcttgctcacatgcagttgttacatctcttgagtgtttcttaatgcagagctagccctcctcctttctcccatgtatttgacttggctttttaaagaaaccaggtatgatgttccccctcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaatagtgccgcaataaacatacgtgtgcatgtgtctttatagcagcatatgtaccctaaaacttaaagtataataataataaaaaaaaagaaaccaggtagttaccatgctgaatttgcttgtccatgtcatcatttaacttgttccgttattgccataggcatttttcttatgaactggaatttatttcagtgggttggttagataagtgttcaacctctctctctttgagaggggtgctgtgcacttcacattgcttccacaaaatgtatggttttcccgttcttagtgacactcaattgttcagtgaggtcagatgttaaaatttatctgagctattttgctaaggttgaaaatggaattttctaattgtgtcatttcgttcgcattcagtagatataattattctgcagaatgaactttcccttctgaactaaggttatttggttatcttaaaatacagcagctataggaaagacaatacatttagtggttgttgtctttaatcatctgttatcagaatgaagagttagtgccctggtttctactatgcagaccaataagattcttctttctttctttatatgaaatatatatgcaggtgtgcatatgtaagtatatatgtacatatgtgtatatatctatatatacacacacatgtatgtataaaattaaaatgaactcaaaggttttcaaaatatttaatggttatcaatcatgtgcaagcatcactgctgatactcaattcatcccctttggctgacgagagccgctttatgttgattcctatgtcattttgacaagaccccattcatgtttcagactcacctcagacatttcctgcctcagaccttcaatcagccactcctccaagaagccatggtcccttttagtagtgaattatatttaaaagaatctacaatctagatgttagaggggcttgttgctattgtttgctcatcacttctgggacttctcagtggaaagactgaaaattcatactttttttttgaagtgtgtaccaatagttttttgtgttcttttttttttttttttttgagatggaagttcactcttgtcaccaggctggagtgcaatggtgccatcttggctcactgcaacctctgcctcctgagttcaagcaattctcctgcctcagcctcctgagtagctgggattacaggcacccaccactatacctgggtaatttttgtatttttagtagagatggggtttcatcatgttagccaggctggtcttgaactcctgacctcaagtggtctgcctgcctcggtctcccaaagtgctgagattacaggtgtgagccaccacgcataccacaaataccaatagtttctattggaatttgacatttcaaggattttatgcattttttaaaatttagggaaaggacttcatgtctaaaacaccaaaagcaatgccaacaaaagccaaaattgacaaatgggatctaattaaactaaagatcttctgcacagcaaaagaaactaccatcagagtgaacaggcaacctacagaataggagaaaatttttgcaatctactcatctgacaaagggctaatatccagaatctacaatgaactcaaacaaatttacaagaaaaacaaacaacaccatcaacaagtgggcaaaggatatgaacagacacttctcaaaagaagacatttatgcagccaaaagacacatgaaaaaatgctcatcatcactggccattagagaaatgcaaatcaaaaccacaatgagataccatcttacaccagttagaatggtgatcattaaaaagtcaggaaacaacaggtgctggagaggatgtggagaaataggaacacttttacactgttggtgggactgtaaactagttcaaacattgtgaaagtcagtgtggcgattcctcagggatcgagaactagaaataccatttgacccagccatcccattactgggtatatacccaaagtaatataaatcatgctgctataaagacacatgcacacgtatgtttattgaggcattattcacaatagcaaagacttggaaccaacccaaatgcccaacaatgatagactggattaagaaaaagtggcacatatacaccatggaatactatgcagccataaaaaatgatgagttcatgtcctttgtagggacatagatgaagctggaaaccatcattctcagcaaactgtcgcaaggacaaaaaaccaaacaccgcatgttctcactcataggtgggaattgaacaatgagaacacatggacacaggaaggggaacatcacacaccggggcctgttgtgggatggggggaggggggagggatagcactgggagatatacctaatgttaaatgacgagttaatgggtgcagcacaccaacatggcacatatatacatatgtaacatacctgtacgttatgcacgtgtaccctaaaacttaaagtacaattaaaaaaaagtgtatatatatatatatatacacacacagtagtatatatacatatatatatatacacacactagtatatatacatatatatatatatatatacacacatacatatatatacacactaaggcacatctgttctcttagagcttaggataaaaagtacatatgtaaagtatttagaaataattatttcagttgtataaatgccttacatttttgttatatttcaagaatttctataaattttcaagaattataaaagaatttcatacttttatttttctcttatactgaaaataaaaataaaaataacataaacataatcacttttcacttatcccactatatatgctactataaataaaaatgagtatctataatatataatatataaacaaatatatttaatgtgatgattaatattgagtgtcaacttaattggattgaaggatgcaaagtattgttcctgggtgtgtctgtgagggtgtcaccaaaggagattaacatttgagtcagtgaactgggagaggcagacccaccctcaatctgggtgggcaccattaatcaactgccagtatggctaggataaaagcaggcagaggaacatggaaagactagactggcttagtcctccagcctacatctttctcccgtgctggatgcttcctgcccttgagcatcagactccaagttcttcaacttttagacgcttggaccttcgaccacagactgaagggtgcactgttggcttccctactttgaaggttttgggaattagactgactttctttctcctcagcttgcagacggcctattgtgggactttaccttgtgatcacgtgagtcattactccttaataaactctactttatatatacatctatcctattaattctgtccccctaaagaaccctaatacatatatagagactagactccaatttttaccttctagacactactaacctttcagaagagttgctcatcttctcggagtttcagcaatctcctctaaaactgtccctactgaaaaggcagtcctcaataccaaactcacttcttgtggctgttttcctctggaatttggtcctgtaagttttcactctagctcctaacagccatgagcagatgttttttacacatttaacaagtctttctagttatcctcagagaaagaatgacttgtccaaataactagccctagcacagaaatcaagaccattttaaaaaatattaggtcagtttgtctattttactgactttttttttaaagaaaaaacttgtttattacatttactgttcttttggtctattttctatttcattagtctgtttatattctcccttagaagtaacttgaacttattttctggctgtctaaatgatatttttctttatctttacagctcaaaaattttattagactatgttgcatgttgaccattctgggtccatttttccaggtagggttgtgccattttaatatgtagtcattatgcattctttttaatgacaggagactttttttgaattagtgttttattattaatacttattctcatcaattgcttggctttctttttaagagaatttagttatacatgtgtttcatcatctttgtcagacatctatacatttttaactctatttgtcttattccttaatatttttgatttcccatattatgctttctgttgtgtttatcctctgatgtgttccctgtcatttcattttaattttagaactcttcatttttctaactttttccaaaatatgccactttttgtttcacagatttgtgttgtttcatcattttatttctgatttatactgctctttcaaagctttaatcatttcaaacaaaaaaatatagttttcatatgatttgtcagtattttttgtagttacttataatcaaaacttttttaaaaattttcattctttttcttgtgataaagttgtgttgggttaaatctttttcctttttgtttcattttacaataagatagagattcttagttaattaggagaaggttcctgcaggagaggatgaaatgagtatatttttccagtcttctcccttgatattaccttcaaggactcgacatttagcccatctctcagagctatatgggattgaactgtatgggcttccacttctggccatgtgtttcctagaacactgttttttacattctaaggctgtgcgtgttgtattttcttttgcagtatttcataggatggaattctctagggcctcccctggttcccgagccttctctgttactctttgtattctactctggctcaatttgatttctaaattgagccgttcccctgagagtgagtctctgttcttctgaaaggagtacttgctgagtacttccactatcttcaaggacatagaccatcactggcctgtgcaaacattaccagccactctaatggccttgtgactcatctccaacctagacctcatgcagttctatcccagtgttgtgaggactctaagacacaaagaattctcctctgcttttggagatggggacccgttggttatttgcagttttctgacactaccataaacccaacaggctgaccccttctactgccttccacctctgctgctggtcctgttgttgccagtaatccagttgtgttgaaggtgccatccatgtacttttttctttgtcatcctattttatctgtgttggtttcaggaggagtttggggtcaaacaccaacatgtttccaccatgacccaaactccagatgtacatttttcagtatatttaaatctaatttaaaatgaaattaatttctcttttccttcaaagcttgacatgttagaaatgcattctgtattcagtgtctacagtctcatcttttagcattaacaaatttcttcctcaactgctttattaaaatttcaatgacaaaaaatattgagttattttccacatatggtagactctcatatgagcctttttgtggcatgtgactctgtggacccctcccttctcctggcatctatcacctccctgtcttcatctatactgttagtcctgaatgctcagtcttattccttggctacttttcggcaggtggcttagtgtatgatattccctggctggattatacattgttgctctcacttttccaatgctcactaggcaatcctaggactcccatggtgacaaaatgcttgtgactacttctgtccatttttgaaacattagtgaatcactccaaaacaaaaaatgaacaaacatcgtgggattaaggaaagtaaacttgcctttccaaccctgagagatacatttaaaaatcaacacttgatgattcagcatgaagataaaaaaggtcacctgaaacagaaagacgggctcttagatcatcaccacttatgtcatcatttggagggagaaatgcttatttactaattttgcgaatcccaaattaattttatatcaggatccccctcctacctcgaatccttcccctttcttttctgaacatgccattagaaaatttctctttaacacaaagaggacgttttctaggattttctgaataagcagaatattgtgctctccttaaagctatcatggactaagatgatagttattattcattttctaattcatttttcccccaaaagacatgataactataaaagcaagggagaaaatagcaattgacttgtaaaagaacagataaagaaacaaaaatacttgcaagttcaaaggaaaactaatttaattctgacttgtatttgtgctggaccttgaaagactattggctattttgaagatgtaagtgatgaagagaaaaatcccaacagtacattatcaaggacaaaaagtgggtgctcaggcagtgatgttttaaattattccaatgttcaacaagttcccttcacttcttcccataaagcattattacaaataaggtacttctcaaatattgatagcaagcaacctttggtcacttccatctcactattacaaccttataggatatttaccacaggggggcaattttatattcttcagctacaaaggcaaaggttgggtattttgtatttggttttataatcaaatcaaatgcaatttgactgcatttgagatggatatttgggatggagatggatctttcactcctaatgtgctccctgaaatgctaacgcatcattatgtgaatgtgtcaattactggtttgacaaatgtgaaatctgtatttctatgaaattgtactcatattcatttaaaagagttttaaaattcctaaaatattttggaaaaggaattgaaggctccattttagtggcaacactccacaattttgattgagtcgtctcaggacactaacaaagaaatagcagacatagcagacagagtcttgataagtttttacctgatacaaaaagtctggcgctgttgctctgcctcgtctctccggtgtatcgatgccgcgtgatgcagcggtagttatacaatccatcttcattctgtacatctttaatatacaaggctcccgtggatgtgatgagaaatctagatcctgaaatagaggaaaacagtggcttggttaaaagacaatgaaagcaacccaaccacacagacaaagtccttaaacagttttttttttcccccacctgaagaaacttaatgaaaaggctaaaaatgggtgcgtgcgtctgcgtgtgtgtgtgtgtgtgtgtgtgtgtgtgtgtgtgtcaattaagggtccaagctgttttaattttttgactagcctacattaagggtttttagtccttatgctatacaataaatatatacttagcaaatctaacctcataaacttttttttagatcatgcatttatcttacagcaacgaagttgtcatataattggtatataccgaacacagaagattttcttggatcattacatttcccttagaatgtgacaaattaagggaatattaactttttgttgcacatctctagcttatgaaagtataaacttttgcctcagtttaaaatgtttcaataaaagcacaaaaatattagactacaaagcaataaaatattctacaaacttcccctaaaaaggctgtcttatttcctcacattaataaccaatatttatcactatattctatgacacatatcaattcttcccagattcagtgttttagaatactctgttatttcttaatcactaatttttaaagggactgttcaaatcactaacaataacaattttcacctcaagaaaaaaaattcatgatcagtcattccccattatgtcagcacaaaacaatgtcctatctgtaacctctaatttttaccggtaaagcttcagttgaacagaaagggccaacattgagatcaaatatcagtgttagtttaagagggcaaaaatgtttttttccctttgaaaatgtaacttttaaagatatttttcgctgttcaattttaattggctgataaaacaagttggagcataaaggtaaaatgtaaatgatcatcgtaagtggattctataatttccctaagataataaaatttctggtcttttactttaaaaaaaaaaaaaaagtagagctgagagtgcctcattgcaccttcccggtgggtaactcagtacacctcctgccaccgttagactcttctatgggctatttctgcatgtgatgtgattccactagaaagaatgtgatttttatctttgaaaaaagactaaaatgccaaataatcaacttttattgcttatttttctcaggttcagttgaaacatcctttagtttatttcagtcagaatttccaggagtcttagcttcattgcttttgagctttacatatttaaattgtaaagataatttcttggtcattttctgcagtaactacacatcatgcataggtcagtttctcagataaattaaaaatggtttatggtttttttttttgagataaggtctggctgtattatccaggctgtggtgcagtggtatcatctcagctcactgcagccatcacctcctgagctcaagcaatccttccacctcagcctcccgaatagctggaactatgggagtgggccatcacacctggctaatttttgtatttttttatagagacgagatctcaccatgttgcccaggctggtcttgaactcatgagctcaagtgatccacccgtcttggcctcccaaagtgccagggagtgtaatccctcccaaagtgggattacaggcatgagccaccatgcccagcctaaaaatgatttatgaattatcatgagttaggagtaattccaaagaacacagatgtgaaaaagatcataaaataacagagcaaatactgaccttgtataagcttttcaaaggagcgcaaattaattattaaaggtagtataaaatatctttaaagtaatatctatattaactttccaaacaattccagttagacatttagtttaaaatatgccataaataatgctagctattagagaagctgaaaaatctcctaatgctgtatattccagataattttgctttattattccccaaaatgaaagcaactaaaaataccttttaccacttgtcatgtgtcatcacacaccagcctttcttatgatacacattgtgtataatggaaacattatttctctttcaatatattttgcatacttacataatgctttaataatcagttcctttaaagtacagtttgatagacagaaaggaaagtcaaaaaaaaaaaaagatgatgtatgtaattcctgtcaccttcttagcgtggagtattttcattagaattgataggccatgagtggtggcaaaatacaagtgggaaggattttgtgtgccattttccagaaaggttgagaaatgcacacagatagcagcagcctgcattattactgattccagagagggctctattctctaggaacattttgttcttgtaatatctaacatttttttcgtttacccacttacgttaaataaggctttagggcgtatcatttcagaagaacttgaacctttgattgtcttaagcattttttgagatgtttacaggaatgaaggagttgacattaactgagtttctgtgcgtaaacccatttaagcctagcgtttcattattggaacgctaagcatgtggcaattatttatttcctgctgctcaaggtcattgccaaggtctgattgcaaaaatttaaaaaattgcaacctcaggcataaatgggttaatttgacctcctttgtctagtccttcatttctcaatttatctcatcttgaaattgatcaacattttaaaacataaaataaggttgaaaagtaggatcttttaattatgagaggaacaggtaagtccagggtccttgggtacagtctcaactcaggagtcctgtggaactatcaagggacaacaaggacacagctaagtcattagagcaccaaatatgtcagccctgtggtaacaaggaatcattttaactgctccctaacttgccactgtaccccacttgctaccttatgccaccaaaggtttccatgtcatatggattaaatggtttgttcatgtccttcaatgggattaatggatgtgcttctgttaaaataggcaaatgtttaaatacaatttattggcagcaaaaagtgcaaacacacaattctgtctcattctgtctccctttgtgtgtctttctgttttattttccttggaatactattagcattttaaccggacacagttctaaaacatagttcatactttttgtcatgttagacacactgcaatttagagcctactgaacagggaatgatttttggattttgagtcatcattttggacatcgattattgagccatgctgctcagttaccagagggatgtctcagaagctatgtggcatctcaagatgcatggaatggtcccagactgccagatgttcaagtctctgagcttgtctttattagcttttctgcttcctcctttactatccagctgttatatgttacttccctttgttatcagtatctttgtcaacacacagtgtgatgcattcagtatgctgagagttagaaaacagacatatcaaggcttttaggactttgtataaactaagagtaaataggttatgagcaagtaacatagtggttttccaacatcagttaacatgagcttacatgttagtgccactaaaataaatccagcgcttggtgtcagttcagtcagcctggttaagattagcataggggccagtgggatatttctatgtagggacacaaaactaccaaagaaaatggggcattagcccagtaggaaaatgttgcagaaaccctcagatttggagttctacagccacgttcttcccattgtcacggagctgagccgcaaaaaacactcatagagcagtgggttctgaaactcaggcacaacaccattttgggttttcttcaaaggcagatattaaaatagcagcagttctagaaatctattttgctgaactatgggttgttaatgctgaaagtcagatctttaagatctgagccgcagaaagcaggcatgcatgatctccagaaagaggcacatcagagttgattctagaaaccagcaggtgttataggtggtcaggaaacagagccaagtgatgcacccattcgttggaccagcactgtcctaggctccagaaatgcaaaaaggagagagacagcccctatctctagggagcttataatctaaacagatttgagcctttgggtttaggaacatcccaagaagttgaggaaaaaggatagaagggaagaacctggagagcaatcaaggaagtggcattgtccttgtctccctgggatgaaggggctactgatacccagggaggaaaactggtatttatccccatacctgcttttatccttgtgtgttattctaatacaaatacttaattttatatgttaaagtcctcatcattaatgtgcttgttcaatcttctcagctaactttttcttgttcttatgaagaatcaaattaaaagattttccctggtttgaggtgcaataagctcatccactttgagagatttctcagtgtggaagaaaaaacctgggctttggaagccagtggatctgaactacaaaacggtccttgtccctttccagctgtgtggcctcagtctagtcatttaactctaaactttgctttcttcatctagaaaaaagagagatgatgagtaatctctttgttctgctgttgaagatcaaattaaaatgcatttatgtcatctagcagatagtcatgcatctactgcacagcagagtgactaagctgaataataatgtattctatatttcaaaatagctcagagagtaaatttcaaatcacaaaaaaagggataagtgaggtggtagatatgttcatcatcttgatgtaatcatttcacatcgtgtatacacataggtgtgtatatatagacacatacaaaatcaacacattgtacccaataaatgtatataacttttcaattgaaaaaaatattaataaataaaaaattaaattggtatctatcctagtaaatgccatgtttgttattctgctgttctggacaatccacaggtgtataaaatgtagcctttgtgagccagacagggaagatcccactgacataaacatagcagggccccctttcaattgcttgtttgcttacttatgaaaggcaaccgcatatattaaagaaagcatctgagtggtaatgatgtagatgaattttacatcataattctgccatttggagctatttcaccacaggcaaaatatttactaaacctctgagccaatgtcacatgacagagcattggtaaacatagaaagatatactgagtccatggagtatttttgtataccccagtgaaaggcttggggaaaggaggatcacagacatctgctatgaactgaatgtttgcatctgcacaaaatttatatgatgaattcttaatccccaatatgacagtatttggaaataaagcttttgggaagtaattaggtataggtgtgattataagggtgggaccagacctcactttctctttccgccctgtgggatcgcagtgagaaggcggctgtctgcaatccaggaagggagcccccatcaggcaccaaatctgccaataccttgatcttggacttcccagcctccagaacagtgagagataaatttttgtggtttaagcctcccagtccatgctattttgtgatagtagcccaagctgaccaagatattatcttcagaagtcttttccacagtagaaatggatattcacagaaactcagggactttccccaaaatcattatcatgttacttgaacaattctccctggcatatctgttagtatctgagtataaaaaaaatatcctgaagttctcaaaattaatcatttcttgtccatcatattttatctaacaggaaggccctctgcttctacctccaaaatatatcctgaatccatccactttcctccctcaacactgtaccacacacatctaaggattgtagctttcaaactctctgtgtccacttctgcttccctacaatttaatctctattcaacatgcatgagcatttagcaatatacatcatttagtgccttgatggaatcccactagacctaaccacttatgatggtctatgatagtttgggctttggccatatctccaaaagcttccactccactctctccttcttccaccatacccaggccatgctgtacttcttttaattgctctgactggaggctctgagcccagatctctccctggatgggtccttcttgtcatcctggcctcagtttttaagtcaaatttccagcaaagtcacatgatcatggtcattcatgatgagagacttggttttattatacctgtatgtgacgttatcttgtacatgtgcatgagattggtttaacatttccctccttcatctagaatagcaagaactcattttgtcttgttcaacatttcatctccattacatagaacagtacttggctatgacatcctaaaatatttgttgaatgcatgcatgggtggatgaaacagtctattattgcttgtattcaaaacatcctttcctaggtctcagtaaaaagaaagctaaagtacctttttttagatttcggcacatttcctcatgtagactgcataaaaagagtttgttctcctccagagatgaatatattcttatatgaaaatgagcatattttaagattgtgatgaattattctttcattatgctccctggctttttactgtgtggttaagctgttagatcttcagtaaaggcaatactatttgggggaagattttaaaagcatatgtcatttttcacttagagaaatatatcttagagctcttgttgttgtgtttttcctattgcagtctatatgaattgagttaatagcaattgaaagaagagatggctctgctaataagatgttaaatggtagcacaagcacgatgaagcttttctcagctgcgcctgccgtcgccaattgatggccacactgtgtcatgaaactcagctttcttcaaagccgtttcaataacagtttctgaaatattagaggaacataagaattaaatctaagttctaagtatatagcattagaaaccacatgatcctcttagcattaactaaaatagaagtggaaatagaagatatatatatatctatatcatatatatcttatatagatatctatatatcttatatagatatctatatatcttatatagatatctatatatcttatatagatatctatatatcttatatcgatatctatatatcttatatagatatcgatatatcttatatcgatatctatatatcttatatcgatatctatatatcttatatcgatatctatatatcttatatagatatcgatatctatatatcttatatagatatcgatatctatatatcttatatagatatctatatatcatatatatcatatatatcttatatagatatctatatatcatatatatgatatatataaaggattacatgcaggcatgaacgagctacagatatttcctgagcaattgagttgccagataaaaatatgcacatgttgaaagctgcatataagagaaaagaagagccccctaaagagaagacatctaacctgacgttatgagctgaatttcccccttcctcaaaaatttatgttaatgtcctaacctgcagtacctcgggatgtgactttatttggaaatagggtcagtcactgcagatgtaatatcttaagatgaactcatacttggatagtgtgtgcccctaatccaatgtgaccggtgtgtccttataaaaagggaaaatttagatagagacatggatattaacatgaatcctaatcagagccaacaggttctaggtggaggctaccactgctttcggcattatttatgttatgacacatttagttcttacaatgaccccaagaggaagatactgttattcccatttttcagatgagaaaattgagaaacagagaagttcagggacttgccccagtttatacaactagaagtatctgtgccaggatggtgccctggcttgctggctcatgccctcacgcaaatcgctcccctgggtttgggccatggcacaagtgtgagacggcaaggcatgggcaagcggaggtacaaccagagtggggcagaagccatgagcacagaaagaaatttaacctaaaggttcaacagagctggggtgaggagaagaagatgccaggtattgattctgagggacctatggggttggggtggccttggtagaacaaaggagttggggtaggggagattctgtttcagaaaagataagagctcagctgtgagcatgctgagtcagttaaaatcaaaaaagtcaagctgcagacagggcgttggagaccaaactatgcttgttgaggagaagcccttcatgagaactgaagtttagtaactccccaggaaggggagtgaaggaaggcgagtgaaggaagaaggccaagaaaagacccaggaaaggagtgagaggaggcatggaggacacaagccagtgtggcgctaagaaagccaggggaggagaggacttctaaaggatgctgcaaagggcctcagctccctgccttcctattgccatagccttgagtacatatacaacctgtacaaaggggcaatattgcctttttgggaaaatcatgatattaaataagaacatccatgtaagaacctgacagagaaaagcactttagagtagctctaatctgtaataaaatatgataaaatattcttgctgaaccaataaaaatattaagtgtctaagagctagaaatgcacaaaattgagttaaagaacactccacgtcattaccaaatgacataatagaagccctggataaatgaagaggcatatccaaatctaggattagtcaacttaatattgcaaaaatgtcaccttttcacaagtgaaatgaattacgttttaattaattgctgaacaaaatttacttagaacttgaacaaatcaatgtaaattaaaatgagagattcttttcatacaggagattagaacaaaaaataaaatgtttgaaaataagtggtcttgacaaaaggtatgggaaataaaaacctctataggtgggcatgtaaattggtgaagccttttgatttttgaagggcaacttgccagtatatttcaagtgtgagacttgcatacttttcaatccctcttgcaacgtcaaagattatcctatggaaaaactcagaagtgcacactttgacgttcacccccaaatgcacggatgcataatttaacaatgaaaacttatttttttttttttttttttttttttttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttttgtatttttagtagagacggggtttcaccgtgttagccaggatggtctcgatctcctgacctcgtgatccgcccgcctcggcctcccaaagtgctgggattacaggcgtgagccaccgcgcccggccaacaatgaaaacttatacataaacctgaatgccaatcaagggataaataagtaaataaattagggtacatctatactctgcagttacataaaagacagtaaggtatatgtacacataccctgcagaaaaatctccactacatagtctaaagtggttacataacaatctgtaatgttatgtaccaaaggcagtggtatatgaataaatttgtgtatgcaaatgaacagagaggcctggatcagcagatatctgcccaaatgttaactgtggttgcctctgaaatcatgagtggattagaggaaggggaggagaaattatgtttcatttcccactgtcacgtatttgagtatcttaaaagaagactctattaatgtgcttcttgggtagttaaaatgtattttggaaaaagatgtcagtgggtggtgagcatatggacacagtagacgtaaaccaaacccatgtaacacacaacatagaaggagataaatttaggatgatgttgctgtcgggagtagatgcgtcaaagagggcttttattatgcttgcttttcaagctggtcgctacctggacttgcctaaaagcagaaggggagactttcaatattcaccctggtctttgtattccctcccctccaaatacctcacacaaaagttgaatctgccatgtagctgatctctgtctcttcctgaacttctgtgataattccccatttcacacataattgcatcagtccagttgatttgggtgtcagagctgcctcctcaaaatggcagttgcctctctgaagacaaagggatcctcttgtttgccccacttacctgctgcccccaaaggtttgcacagtgctaaattaagtgactgtttagaagatatacatacttcgagtttttttctaaaaataggatcagtaaaataagggatcatattgagggggcagagctctcaccatatcattttatttaaccttctttggagcctattatgtttatgagagtatcatcaagatatccaagaaataatgaagccccagcgtggatcttgagccgcctggaagaaatcatttggctagaaataacaccatcacatggggcatgaggaataagcttacaattctgctggatccagtatgtaaggagagatttggtgtacatattttaaattctctcaaagcaatttcactaagacatttcttttatgtaaataaaattctctcagtgaaattctcctgcagttaaatgaggctcaattatacactactaatttaagcctgcatactgcattccaactgtatacctaattaccctatttagtttgttaatgatcagatctttgtgcagatattcaagtctgtcactaatctttgctctagttagatttctagttgtttaaaataatgaatccttagaaagaatataattgtataattcctttacttttaaatgaatcacttcaagaattttttattaaagaaccaaagaagctcgtaaaacttataaattgtatttatttatttatacgatgaacaagatggttttggccactgacatttgaaagcaaatatttcagttgggaacacagacaaaaagagtacattgacaaagaaaataaatccactctcataaatgcatttacatgaattgagaaacagaagttgactctagtaaagagaagagctgtttagatggtgggggtttggagtggggtgtgtatgtaaggatttctgaggacgtgcacttcagcagagccacagaaggtaggaagataagaagggattattcatggataagtagagctaagaacaaggttaaaggaaaagtatgtttgaggcgggaaaaactgtggcatatccaaggaactgacacaggatatggtttgaaaatagaactgaggccgggcgcggtggctcgcgcctgtaatcccagcactttgggaggccgaggcgggcggatcacaaggtcaggagatcgagaccatcctggctaacacggtgaaaccccgtctctactaaaaatgcaaaaaattagccgggcgtggtggcgggcgcctgtagtcccagctgctcgggaggctgaggcaggagaatggcgggaacccgggaggcggagcctgcagtgagccgagatcgtgccactgcactccagcctgggcgacagagcgagactccgtctcaaaaaaaaaaaaaaaaaaaaaagaaaatagaactgataggacatagaactcgcctgaatgccaggatgaggcaaaggcgatgaggaccaaggtggctgctaggtcttggtgaagagccctgaacaggtgaagagtcctcctgccaggaataagaaccacggggtgtggcactggctgtccatggctgacttattttggactttggggaattgaaagtagccctttatagagatatggaaaggggaaggaagagaatgctattggatgtgctcgttgtatcaggcggactcatgtttagaagaggtacatcagcattatttactgtcccacaagatttctgcattttggggctggaagggaatgtgtatttcaggttgactgtctgttccagttgtgggtgcacaatacagtgctgattaaaaagcaacacatacaaaaaggaaaaaataagtgaaggaaggtcagagcacggcacttcaacccacagtgactatgcttacctggtctgtgttagcaacccaaaaggaatttaagacactgggcttattggcaaaacacattgaaaattaactgtaaagtttgtctacctgatacagatggcataggattatgggaaagaatctggaaaaataggaaccaccataaagaatgaaactaacactatgttgtggccacttaatattatgggataatggtttttcacactttgggttcacctactaataggttgtgaaatcagtttcatggattgcagctttactttttaaaaaaatgaaataaaagagcatagaatgtatcagtgtgtatcaaatagtggtgataaatattctgcagcttgtttcagtacacctgtgcatacataaagttatgtgtgtgtttgtatatttatgtgtgtatttatgtgtatgcattactgagttctaagataaaatgtctttattctatgtatctcttactgtgagtcagagcaaaaaatgtttgaagagcctttttcaacatcttagtgatggaattgttacttttctgactaggcttccgtttcaaagcaaggctaatcgtcttttagcatcagctggtataccttggattcttaaagttctctctttaaatatttctgcattttaaattaaagattcctgctttagcaagtcccctagttcttattcctggtagggggactcttcacctgttcagggctcctcaccaagacctagcagccgccttggtcctcatctcctttgcctcatcctgacattcaggccaattctatgtcctatcagttctattttcaaagtatatcttgtatcatttccttggacatgacacattttttcccacctcaaacacatgctttgagaccagcaagtctataaggccataggcttggttgcatttataatgggaatagcagagaaagcagtttatttttttaaaactgcaacatcatttgaaggtcttggattacatttgtttcccaatgacacgtgatgatgtcaaaggaaactataatgagtttactgagctatccatacaaatgtacatgcaaatatgtatacttacaagaacacgcaagggtagaaaccatgtcagatgcggtccctcgtgtcactcccactccactgccttttggtttcaaatagtctgaccccatgagaatctttgagactgtctttcatgtcacagagccttgcactgtgagagtaactcaattccctaaatgacttccccagatctagcttatcacaaactccattgccttgcaataacctttgtaacaaaatggtattaataaaatcatgtagcaactgcccatcatatgcagacctagtaatggaatccaagttacctaaaaggctaattcctaatgagaaggaaaggaaacataccataaagtaaaagtgcaaacaattgcaaaacagaggcaaacagtgtcagttggatatacgtaagcgctgatgtaaagagagattggaaatgatatatctggctgggcaggtcactcatgcctgtaatcccagcactttgggaggctgaggcaggcagatcacctaaggccaggaattcgacaccagcctggccaacgtggcaaaacccgtctctactaaaaatacaaaaattagccgggcgtggtggtgtgcgcctggaatcccagctacccaggaggctgaggcaggagaaatgctggaacccgggaggcagaggctgcagtgagctgagatcatgccactactgcactccagcctgggtgacacagcaagactccctctaaaaaaagaaaaaaagaaaagaaaagaaaagaaaatgatatatccatgatgaattaaaatggagtggaacccactgatggtatgcagctgataagacgctatagagaaatgatatccggacacatggtgagactttttctcctctgtaaatctcaattcttgtgattctttcaaagggaaagccacagaaggtaccagttatccactcactgacttaggtgcctccactagaattctcagcacgtttttgcagaagtaagttatcttcactattgctctaacacttcttagtctcctttttctttcttttctttttttttagacaaaggaaaagtaaaccgctggtttagagtctttggaaggcaattgtatctgactagaatttaatattattgtttttctttcattgtattgcatttatctgtatggctagttaaactgattttccatttaaaagtagtaatgcatttttttataattacattgttttaagtaaacaagaattattcaaaggacaaaaacactagcacagatggcattcaatgattgcagatatcataaagatagttcatgaatgacaaagatttgagaagtactgtgttcacgatgcttcctggaagaggtgggttatacagtgtttcttagagaaagggataggggtctactgctaggagggaaagatgaagctacttagggggactaggaaacacgcagttggcctgccctctgcttggagatcacagccaaggaaacacaggagaggcaccccctggaggagctccgtgggctgcagggctgacgtggcccaggtaagtgggagttcagggaggcccacaggttggtgctaggatagtggcagatgattttcattgtcagactgtgagacaaaaggtagacataagggaggcagaggtgaaatcgggatggttaaaacagagaatgctgagagcagagcaaggcagttgctaaagctgttactaaaactggacagcagaaggcctggcgtggtggctcacagctgtaatcccagcactttgggaggcctaggtgggtggatcatcagaggtcaggagttagagactagcctgaccaacatggtgaaaccccatctctactaaaaatacaaagttagccaggcatggtggcccatgcctgtaatcccagctactcgggaggctgaggcaggagaattgcttgaatttgggaggtggaggttgcggtgagctgagatcgcaccattgctctccagcctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatgacatactcatccatgtacccatttcttaaaattgatcattgttaacatttggtgtaatttgctttatttatttttaatgaaataaataaaactttacagaaaatgctttatttttctctttgttccctccccatcctatatttttctcctaaaaaaccctattatcagaaatattagtgtgtattcccagtttcgactttttattttattacacacacactcccacacatagctgtgacaatgaacttcacatagtatggttctgtattttctctttgtttttcaaacttacataagtattttactatttctcatggaaaaactcacttttcccatccaacgttatgtttccttaagatctctctatgttgatataaagaaatctagctcattctttttaatgaaaataaagtatattttatgaatgtaactcatgctaaccatggcaataaaagctccatcaagcatgcatttagttctgtattttgttcaatgctgtattcccagtccctagaacacatacagagtagtggttcattaaatgtttgtcaaatgaatgaatcaatgaatccactcatttcactgctgacaagcagtaaaactgacgtcaattttgcacaaacttttacaagattcctcggcacccacataagagacgtactaatacgtctacctagaaatatatgtattgcattgacagaatttgtgtttttggttttgtgggattctctgaaatgctatgtgacttcttaagggcttggcacatgctgtaggctgttaatgtggctgaggggtttggctctcacatgaccactgcagacaggctgtgtgccacctgctcactttgtaagcttctcgtccccctctgacagctctttgcaatgctttgtcttttcttcaaaactttatatatatttttttaagaagaaaaatctgataagcctttgtcagaaaaaagtgggtgaattcttccaagtaataaaataatgcaaagtataaaataaagaggataaaccgattcacagctaggaatacaaggtatctttggccaatgggattttgccttcgtgctttcaagcacagtcactttctgtgcaaggttgtaagtgttcaccatgagctttaggtggatctagccctgtaacaacaaatcactagtaccgctggatcaagattagtgtacatttgtgtttaagcaatatcatggtccattaattacgtgcactgcaatttaatggccttgcagatcttaacactgtgcttttatttcatttttgcctaggcccgcctcaccgctaaatataaatggaatgaagcacttgaaaacaaaaagtataaaaatgtgtatatttttcattgcaaagcaattcttaatggattttgtaaactttgcaaaattaaaaggaaaatactgtcaggacactaagcttcttcccaggttttcagattccgaagctttagttgagggcagttgaagaacctacaaggctgttccggagacctttgtgaatgtgaatgaacgccctttgcttcaaaggcacctgcctggtgctgaggaatcggccttggagccgccgcccacgccgggccgctgcgggagaacactcggtgccccctgctggtcagaccgaggccccgcagcgtggcacagagagctccacggcacgcgtggtgtgggaactgcaggctgaaaaacgctcccagaaatgaaatagtgagtgcccgtggatctggcaccaccttaacacttcctcgttaataacacatgatttttgctttattaacctataagcacttcctatgtttacacttcttgggttttgatagaaactcgtgatcagcaaaattctttcaatgaaaatttgtcaaattacttctccacttaaaagtggaaacagtgacgtttttcttgaactccacgtttatttatattattttttaatttcatttttgctttacaaccatctaatgaattttctttagataaaattccctctaggattttaagataaaattccctctaggattaagttttggtcatttctctcatgaaatgtatgtcagattacattatttggaaccttatttttccatttttttttcaggtagtttaatatagtcagtgaatcagcagtgagttgtagcaacttccatttctgactatgtaaaaaactaattattttgaaaactctccaggtataagaaacttagacaagctgcataaatctaacattgacttaaatgaacagcaggtttctcaggtaaggaaagccctctgggctctataaaggaagagggggggtgaatacctaacagcaaagatcttgttgatactacctataatttccctgtgacatttgcacatttagggggaaaaaacatagttttaacagcaatgaggaaatggaaggctgttagtcctacacaagtcctacacaagagaagtctgcagaaaagtacaacttcactaaaagattggacctccaaaaaaaaaaaaacagcctttgcaaatacccttgccttcctagcctaagctttgtgtagggattatgtctaaccatagtactggccttgctctggtttgggatttgtagtctcactgtctccagggtccagtagacctcactctagaaaataacatatagtgacttcgcttctaaggacatctggcagaagcaaagacaaataaatcttccctggaggaaggagcactgagaaatgtttacagatgaagcttgactcctcccttccaatcttgagcttccagtaccaaacctctaacacattagagaacaatttatcataaaaaggagtcagaagaagcaatagaggcctcagacaatgaaataactcgacaatgtttacacaataagtattttaaatgttgcaaaactatagaattgaattaaaaataggataagtgaataagagtatatcataaaagatacaaatattagataaacaataaaatatttgcagaatgggcagaaataaaacacataacccttgacataaatatttatattagacacagttgggaaaaattagtgaacaagaaaataaatctacagaaattactcagaatatttcctagagagaaaaagaaacatatggaagaaagaaagatacatatgaaagaaaggttaagagacttgaaggagagatagaggaaatccacagttcaaggagagggtagaaaaaaatggcagaaaagcaatatttgggaaaacaatttggaaatttcccagtattgataagaaccgacagtttgccaatagcaggcttgcgcctggaactaaaggatgtgcttccagaaaagaaattgtactcaataatgagatgcaaaaagaagggtggagaaagaacgaggtatgcgtgagtaaccctaaacaaataatgactgtataaagtgataataatggcaaatatgattgatataaaaagttagatgcctctagaacactggaagacaattgcatttcagatgggagggagatcacagcagatggtatcatgaagtcctgtgtttctcggtatgaggtaggtcagcgtgctgtatttgtgggtgaagaaaagcaatctctttagtgcttttgacacttttccacaaattccatttcacccacatcttaacctggcaggcatctctttactgtttgagaaaccagaccttgctctttacagtttccataaggctgtcatggtcattactctatttaatcttcataggaaaatcacgggagttaaggccattttaaaccccccctcctccactgataaaccagctgtgttctttgaaaatatttgatacaactctaagcactgcaaacttcacattctggaaagtgtgttcaatcctactaaaacctattacaatccattcaaatgcacataccctattggagtagggtggtataaattcaccactctgggtaagcaaatcttgctttttaatttcattccctgtattttctccccacattttcccacttagtaattgtttataaattccaggtagaacatgctcatttcatgttggcttttcttagcaattcttacagtaaatgtagtgtacagtgtaactaccctgtgccatttagaaatgggtgggatacaatatggtaagtttactctttccctcaatgtaattcaacatgtatttaataaaagtaggatattcctgcataaaagatgaatagaaatcccccgtgttttaagataatttgctctcttcttgagagtacaaaagggttttctccaatgtacattttgctcatttttatatcttctgataaattattctcatgtcatgctgagaaaacttcacttgtcatttgagcaaggaaatcaaaagtcattataaatgtctagcattgaaaccatctttctttcatttcctgacattaaattttaattagagaatattcttttaaatagccaatattttatgaagagaaataacaaaaaagaggaccgttaaaaaacagctaatgttctaaaaaagacatctgattagtgggcaccacttctttctggcacattccaaagatatccactgtatttggccagtaccacaatagattatagaaaatctatgctgaattaccataataggatttttatcattaatactgtccaggtatattgattaaattatttgttaaattctccaaatcattttaaccatatgaaccaagttgacaaagagcttaccatctaaaacataaagtacatcagaatctggatttatctgactcaggttaatgaaaagagtgataaaccacaccctaaactcttgtctttgaaagaagatatagcctgttaccatcgcagaatggacaagtactctcgagaaatcttcatgtacactggccgacttgtttgcctgcattgcttcctacccaatggccatgccacgtgttcatgcatcaaggaagagaaaacttaagaacacagatttgggaaggatgcaaaagtgagagaacaggtgtggacgtgaggacacggggaataaatgagaaagaatgtatcctaagaggacgtattgtgtggtcagagctacaagtctgggtgtttcttctcatcaggcatcattgagaataagcctccttggtcacctgctcatcctgtgtctatccattcccccaccaccccaccctgtccctttcaaatctcctggagggggagctgcacgcatggacagggtggggcaagggagaggctggagctgtctcagcttcgttttgcttaatcaagcctcctttgactatgcttgcccagttgcatgtgcagtggtattcagacctgctcagcaggtggatgagtctgatcttagtattcaatcaaaaactacatttttgttcttttgactcttcttcactgcacaggggtaaaaagtgtggagtctatcagtcagctgttagacagcaaccattttagatggatccgtaatagccaatcaagagatgacaatctccctttaaaaactgacaggtacaaaaataagacctgaataattcatggagagaaggtggatagccttgggttagctgattgctgatgcaccctattccgtgctgtgctcttggcttcaccttctgatgtggcatccacattattttcccagggctgctgcaacaaagtactgcaaaccgggtggtttaaatgatagcagggtattcttttccatttctggaggccagcagtattattggcaggtccgtacctactccaatgcctcaagggaagatcttcccttctctctcccagcttctggtaggcctcaatgaccctggattatggcagcgtaattccaatctccacctctatcttcacatggccatgttctctctgtgtttaagttttccctcttcttacaaaaacaccagtcatgttggattaagggcccatcctactccaatacaacttcatcttaactacttatatcttcaatgaccctatttccaaataaggtcacattctgagccactggcgcattagagcttcaatatcatttgaggggacacaattgaatctattataacatctcaaagcagctcattccttgcctacctcaggtagcaacaagcttaaaataaaagaaagaaaactgtatctatggttctttgcaagtgtagggagtggagggagaccttctcactatggaaaaatatttcaaggtatataacatttcatattggatgatgcagaccgcatgaaatcattgtgctccttaaacaatccctgaaggtccaaccataccagcaaatgctgcaatataaataatattcacaaagacaggtgagagctattgccttaccaggggctggactcatggctgttagaatgagcagcaatgagtattctattcactcactttggctttaaataagaagccaattttacgcttaaaaatcgctgagtgcataaacacaaacatatagaaatctggagggaggctaaattttacacagtctacccacctgctgtttgaaataagagtgctatagttaatgtaaattacgtgcaaagaatgcagattgagaagattagagaaccatcaacttagtttgatcaaatgatacaatgtgcttgaaagtaatttaatacaaccatagagcatttcaatgtttctttctttggaaggggactttttaaaattttatcagtttcatactatgatttatccttctctccagggttgttcatactgtggagtttttctacaggttagcgtaagcttgagcagtgtcagtgacaggatgtctccccactggtgcatgatgatttctcctacagtgtcccacatagcatcaggtatgttcactcaatacatacttgctcactgcaaatatttagagaagtgtattaccacattgctgttatcggaaatttctcgttgcaaaaattagaagattgctaactacaaaaatctcattttgagtatggtatgttgacacaatttgcacagactaggcattagaatgtgactctgggtcatctcacacgccaggaagtttggctagccccttctttcttcccagagagaaagcacctctccaagggggaagcagatgtgaaaaagagcatggagttcgggctgtgggaaccacgccggtgaaatacccacctgaggctgagtcttcataaggtagttgccttgaccagtcttttcaaaagtcatttcttatttccttcattatctccatggttattctacatatcctcgtctggcatccaacacacatcttaaatctcatattcaaatattgggtaaatgagaggaattcctttattttaatcctcagtacttcctgaacatgcaaacctattagtactataaaaattaatgcctataagtgatatttatgtacaggtattaagaataataatcatgtattattctagtgtgggttaaagataaacagtgtttgataaatatttggaaaaatctaagagcaataaaacaagcctcaaatagtcagatcagaggttcatctataggccacactcttcctaaaatgatatgtattttttaaatagttataggatgagagtggattagaaaatggtactcctgtaaagcatatattttcaacgatttcctaagaaactaaccaacacgacgtagaaagtaataatcacatgaatttattgtaagtatccttcgaggtcagaaagaagggtagaacacaagttcttgtaacactggaattggaattccaggatggggaatgtgttatgtatctcagacgcagaagggaaagaagccaccacgtacagaacggtgaagcctctgggtctactcccaaacacgagcatttcccccaggtcctgccaagctctgcaagatgctattgaagagatgcttcccataaaggaccaaagagcagtagtacagtgaatataacctcagaagcaatgtccacaactcagtgaaatttttcaaagcatgacacagcttggccagagctccttaggaagccacaaggtcaactgttaatcatgaaaaaaattttaacacattcaaaagatataataaaatttacaattcaacccccaaatcaagtactaaaaagatcaatgagctgatacacatgtacagaattattagtgcatgttagatatcaggcaaattttgcttccttgacatcaagtgtaagcccatatttaatgcacgcagctccaaaggctggttccctaatatcggctccaaattgagaccacaaagtcttcttggatgaaagatttagaatgccctcaaatctaaagagtgcagacttaaaggtatactgccaaagaaaggtaatgatttctcagtctctcccacttcaaagccatacccaaaggctctggcaccttccccttcatcatccaggaatctccagatccacgtgcatgacctctgatgcggagcagcactcaatccataacagctccacgaacagggaatacatggatgagtcttcattaagatttaaacatgaaaagacatgttcccagcccttttgtgagcttgtgctttggaggagaaaatacaacgaaaattctagaaagccactttactaaatgtatatgtttttataggcatatttttttaaaatcaaggtaataggaaatccatattatcattttataaaactttaacttacatttttttctgactacaagtataggcacagtgtgaaaaatctgaaaaataaaaactagaaagaataaaatataaatcccacataattccattaccaaggatgaacagctgaacaccagagctgaccattattaacatgtttgcatatatccgtctatgcttttttctacatatatatagtatttagataattgagattaaactgttatttaaatagctttccattcagcttattttatttgatccttttatgagattcatgtgctcaatgaatattgtatgaatgttgctaaattatgagtggctacctgtcatttgaatgctttaatacatcattttaatactgtgtaataatccattggatgggtatataataattggattagcctatctgttcttgagtgtttctaatatttcaccattataattaaaataagtttccaaatagatatttttctgcatttctaattatttctttaatacagttctctcaaggaaagtttctgtggtcaaatctatactttttcttaaagaaagacatcaaactgataaattcatggaatagtcaaggcagttgttgggtggtttaatgcaatgacaatcttgtgggggtctaaatacagcagtgaattcacacttatctacttcacctagaatatgaagatgaggcgagataaagataagaacaatgatctttattgcttactacagtccaggcatttttcatattacttcatttaattcccctaaccctttttattagttgaatgagaggtctgagtttcagcaagattgcataggttgaggaccaaggtcatacaatctaggcttgcctgactcccaatgccacattctttcttccacatcagaccagatggcttttatacagtcaggatgaaaaataatagaatatgaacctgcactcaacaggctgtcagagtctctcaagtctccatacatacacaatgcatctgactgcgttttaaccgcttccagagccctggcagctatgtctgggaatgcagctttttgcttccctgagtcttcaaccaaggcaggtaaaccagaaagaagtggaaatgcaatattgagccacacaaaccctgcacagaagtatttacagaagagtgagaaaattcttcctagcagggccaagctatcttttccctagagggagccttgatcttgggctgaggttttggataatggatgaatatcacctggaagacaggggagagggagattttcaacactgagaactgtagaaccgaaggcataccagttcagacttggatcctttgtgtgtaattggggagtactaagagagattaggatagaaatacagacagtcttagatggcagaggggtttaaaactttaatcccaggatctttactgtatgttaaatatttcccaagggaactctaaggaaaatttataaggaagtaaaggtagaattaggtaatttttacatggttaatttgagtggtcaaacaatgtcgtttgatacaaatatactgtgttcagtcagtgtaattgacgaaaaacattggcaagattgttatgaaaattctaacttcaataagaaatgatagcattgtattttaacttcttcctccctttcctctcttggctggttccaaaaataatttgatgtggtgcagtatttttaacttgagaagagactattagggggcattctttattttattttatttttattttaatgaaagaaaatgaaagtcaaatttaaagacaagaaatttctgccttcaaaggtcaggtctatttttactttccttctgtatttttttttttcttttagatcaaaaatttgagtctctttggtatccagctgtaaaatgacgcatgttttttttcctacctggagactgtaacattttcctatattttaggctaaaagggttgagagcaatttgtaaattcattcttttaggaatactaaaattagttacaattgacttatgaatataatttggagatttgggtgtagattccatagttgccttcgcaaggaatgtatctttgatttctttttttttcttaaatcacaaaacttaaaaaaaaatcagaaatactgagaccttgctattggttttgttttctctttatattcatgaacacaaagaaaatgggcattaaagcaattttataaaaaagaatcactttccatggacaaagtctattaaagattttttagtgttcacagttcattttaaatttattttctatttggccctggagtcctctcagggaatggattggggagaaagacattggcattcacacagtgacagtgtgacctgatcatttatttgccaagccttattaaagcccctgaaatcactccctgccacggccctcacagcccatcagccatcagttcggaatgtcaaatctgattacagtgttctcctgcagcctcttccaagccttcagcaacagaaagctgactttatgcctgtgcctacggaagcgggtcccatggaggctccaactcagggcagctcattttgcttctgaaccgccgacagggttcctaaatcgagatgacatttaccattttatattttaattcactagagagattttgtttacttcctcttccttgctactatgtctcaccaaaagataaattcaaattccaaaatagtatatttagttcacaaaaatatgctaaaataatgtttaaatgccatgcaattgcacaagaaaacttcactgattgtcaaccataacgggtaccagagaaaagggattcttcaccatcacgccaacttctgagaaaatcctaactttaggaattagccaaattcagttagattggatttagggctcgttaatatctactgtaatgggaacggtttcccaacacaaggaggctgttggtttgttgtggaagtttcagctcagtaatggagggtgagcaggtgaagaatatttcagatggggggcaactcacagtacacacgtgcagtgttcctgagctgggtgcccaccaggaacggaacacttaactggaaatggttgtggccactggtctgtgaggaaaatactggagaatgcaggcccctaaaacactgctaccactactactaccgttattacccctactactgccactgctgctactactactactactactaccaccactcctaccacaactactaccactaccaccatctaccacagctactacaactgatgctggcccaactgtcctatagaattaatgtttatagtttcttttgaataaacatagaaattgaccctcccagtcttacaacttgacaaaattacatttgtcttatctaagtccttttcttaggaaactaaccatgagggcctcccagataacatcaaagaactgaaacttcccagatcaccacatctagacagtgaggtaccagaccctcacctatcatgattgcctaactgaccacctgcttcctattgacaaactccttttccttacccttccctaattcctgttttcccacacatggttacattgctttcatcctataaaaaccccaattttaatcaatctgagagatggatttgagactgatcttctatctccttggctgcagcaccagaatagtcttcttcactggcaataatcattgtctcagtgatatagtttgaatctgtgtccctgccaaatctcatgttgagatgtgatcccgtgttggaggtggggcctggtgggaggtgattggatcatgagggtcactccctcatgaagggcttcggccatctccttggtgacgagtgtgctcttgctctgagttcacacgagatcttgtcatttaaaagtgtgtggcaactccctctcactctctcccttgctcctgctttcaccgtgtgacatgcctgttccccctttgccttccaccatgatgagaagcttcctgaggcctcccagaagctgagcagatgcccaatgccatgcttcccgtacagcctacagaactgtgagccaattaaacctcttttctttctaaattacccagtctcaggtatttctttatagcaattcaagaacagcctaaaacactcagtgattggcattcatgtggcgagcagtaggacctagactgaacccctagtgttttggcaacactaccaatactactgttaccactgctgctaccactattactattggcggtactactactaccactattaccactactgctactatcactaatactaccaccactactatgctactactattaccaatactgctaccacccctactatcatcactactaccactaatactaccaccaccactactaccactaccagtacttctactgccactacttttactattattgctataccattattaccaccaccattactactgcaacaattaccaccaccaccactactgccactagttctaccactactctaagagcacccggagcattactccttgtcaacttacacttttgagagtaagcttgtagtttaggaggctgtgctgcacacagtacctcattaaggatgtttggattctgctggctattgctgaaaaaacttacctaaattccctggtcctgggcctgtctacaaactacggaatcttcatgctctgggcacttatacactcttaggggacatgtcactttgattcagacattttaagaagtgacccaatgttaatggttcctcagttattctgagcatcctgaagttcaaggtccccttaaacatgaccttgtcccagatcctaacctacagcccggatcccttttgcagttgactccaaatggttcccaacagaccttgcagttttctcccctgtgctcactcacaccattcatttcctcttcctaaaatgtcaaaatacccccaattccctatcccatgtttaaaataataaataacttgcttgctgtcacacagatacaaaatgattggagctggacttaaaattagcctctagggctctacagtcccaacacccttgctctgtctgctccgctaactttggaattatgcatacacactgaaatctccactgtgaaattagaagtttctttcctttcttttttctttcttttttttttttttttgagatggagtctcactctgccgccaggctggagtgcagtggcatgatctcagttcactgcaacctccacctcctgggttcaagcgattctactgcctcaacctcccaagtagctgggactacaggtgtgtgccaccacacccagctaatttttgtatttttagtagggacgggatctgcccacctctgcctcccaaaatgctgggattacaggtgtcagccaccgcacccagcctaggagtttctttctaagaagaggcaatattgttttctttgtatctcccatgtaagtacttgttgcttgaggaatgaatgattcagccaaattggggtccagaccaggtgcagtcacttacacatgtaatcccagcattttagtaggctaaggcaggcaagtagcttgagcctacaagtttgagaccagcctgagcaacatagccagaccttgactctacaaaaatagaaaacttagctgggtgtgatggcacatgcctgtggtctcagctacttgggaggctgaggcaggaagactgcttgaaactgggaggtcaaggctgcagagagctatgactgtgccactgcacttcagcctgggtgacagaggaagaccctgtctcacaaaacaaaacaaaacaaaacaaaacaaaacaaaacaaaacataggagtccaaagattccatctacaaatagctatttcacattgattttgagagtatgggtggaaaagggtttctatattggaagctgagtcacttctagttcctaaatatctttagagttctttaggaaatccacctacttaaactggagagcctggattgtcaattcctgtgtgcatgctatctgattttataaaagtctttatatttcgctgtgtttcagaaagatatttgagataatatccatcaaaattcagaattctaaacgtatcttctctgcatgtgcctagattggaccaacttcctaaatctctgaggtcaagcatcatattaatttagttactgcctagcaatgtgctcagcaaaaaatgctgccacggtttctgttagaagctgcttattcattcattcattcatttttatttaacaagaatttatataaacttagtagtgacaagtatgccttaagtgcattataaacgttgactcacataaacctcacactgcccttaagaggtacgtaaaataattatatccattcctttttgttttttgtctgatgtagcaagtaaaacaaagtaacaaagcaatgttgctgcttttttctcctgtccctggatttcccagttccagggaacatatttctaaattttacccatatgtggaatggattcttcaacaggatttttaacagaatcctagaggaaaaacagccacagggaatctgtgtttgaagcaggtgtcatggtcagcattccccagactcaacctttctccctgttccgggagcaccttcctcccgtgcagcaggtctcagggcccctttacacttttccaaattattggagaccataaagaggtttcattatgtgatttgtagctatttatatttagtgtggtagaaatcttaaaagattttaaaatatgtatttattttaaaaatgaaatagtaaccccattacattatttaaaaatattttaatgaaaacattgtattttccaaaacaaaaaaatagctagaagagtaatattgtttatattttcataaatctttttaacgtctaccctaatagaatgctcaattctcatatctgcatctgcattcaggctttacagagatatgtagatggaaaataaaggagtgttttaatagtctttgtaagtaattgtgaatattctactgaggtaagttttttttctttctttctttttagacagggtctgggtttcttgcctaggctggaaggcagtggcatgagcacccagctaatttaaaaacttttgttgtagagacaaggtcttgctatgttgcttaggctggttttgaactcctagcctcaagcaatccttctgccttggcctcccaaagctttgggattacaggcatgagccgctgtgcctggccttctggggtaatttcttaaaggttagttggaatggtattttcatactctgttatgttaaaattgattgccctatcttgagctttaaatggatctattactaatgcatgacttttgtaacatcatgcattagtcatttatagttcactgagttatgcagatctttcaaatgttgacaggtttcaatatataacactaaaaaatcatatttgttaatataatcactgatctcatcacaaaagttctttaaatattgggaggctgtcaagtacataatggtggatacagtttttccacaatttgaatttttgtttgaaaaattttaccattgaatcaaatactgttggttattttccttgaagtaacaggatcaccttggttcatactttgagaaaataactgtcatctgtagtccaaattaccatagttttctgtcccttgttccgctaagtaaaagtaacagtaacaggaaaagtaacttttttaaagttctattaagaaaaggattatttcagcttgcagctcaaccactcaaatgcttttcctcaaaataaccacactttatgggaatacatttcctgtttcctcacagaggctattaaaaagtcatatactcaagggttgagataaaataaaactaataattatatggctgcataaaggatattctcaataaaattggatttttttttctgttagtgtgtagcagtgaagaatatagtacactatttacacaaaacaagtataattggatcccgcagccttgacacctgctgagacaccagcaattttatccaccattgcagatgtcaaaacaacaaagaaagtgaatgatatctcaatattatcttgaaagtagttttgaccttgcaaatccctaaagggtcttggagaccatcaagcgtgcagggaccactccttgaggactgttgcactttggcattgtgatttaaaatgtgctgcagatgggataatcatatgttacaaaggatataaggagagtagacagggatggtattcttacagccatgttcccaccagggtcaagagaacagcacaaagcccagcccaagccagggccttccaaaggggccccatgttcccctctggaggctgctgacctggagacctgccatgggcccgtcttgccagctctccttcctctttctccagaagtcggcccagccttgctagctatattttacacccaactgagcagagcaacactggacaataatcaaatgtttcccccttttaagttccccgtgtggttgacagggaacatttatgatttctaaatggtcaagtaaaatttattcttattattcttattccttttttttttttttttttttttttttttgagacagagtctcgctctgtcgcccgggctggagtacagtggtgccacctcggctcactgcaagctccgcctcctgggttcacgtcattctcctgcctcagcctcccgagtagctgggactacagactacaggcgcccgccaccacgcccggctaatttttttttgtatttttagtagagacggggtttcactgtgttagccaggatggtctcagtctcctgacctcgtgatctgcccgtctcagcctcccaaagtggtgggattacaggctcgagccaccacgcccggctaaaatatattatttttaagacaaatggtattagattcctaagaagaagctaagctaagagtttttacctctcagatcattagaacaagtatctgcctagggaaaaagtaaagttctagagatcttaaatgtgaaattatttctaaatggagaaataatgattttttccacggggagtaaactatctatatatttccaagtgatactgcttttctttacctaaagttaggcagactgtggctccttgtagataaacaggattaaaaaaaatggcacttaactcaaaattgacattgtcttttttatttgtttttttttttttaatttattgagaggaagatttaacaacaatttcttgaaggaaaaattcaattgattctgagatacattttaattttaggtttaggaagtcaggttctcattatactaaccattttttgacctttcaaaatacaaagttttaaggcttaattttaatgacatatcaaaactcagagtaaggcaatagctatcaataaattatttctttgtattacttaagagagacaagtacaggaaaaaatgaattaacacaattgagaaaatttggaagcaagattatacccccccaccccataattcatagtaattccctattctggctcatttaactatttcccaatatccttcactagacactgaaagcaggcacttccaataacatgccaaccttgtatcatttctatcaagcaccaaagctgacatcatgtgtgcttaacacgctcaatgatgtggaatgattagaaaggacataattattaaaagcatcactatatatttccagtgatcccttgaaatattaaaaaggaaaaggtatcaatgaactagcatactttaatggagaatgtacattttaaaagaacaattttttaatgtccaggtgattagtaaatctttttttttttttttgagacaaggtctcactctgtcacccaggctggagtgcagtgatgcaatctcagctcattgcaacctctgcctcctgggctcaagtgatcctcccacctcagtatcccatgtagctgggactacagagtaaatctattttacaaagaataaattaaagacaatgcccagtggaattttctttggaaaccttaaaatcagacttgtggtttaacaaactatgccttatacagccgatttcttacatgggtggtttggcaggctaatcattgtcatcaacacacatgcttacatacatgtatgcaagcatgcatgtgcacacacacacacacacacacacacacacacacaatacacatgcccttctctctgtagagccataaatttcaccatgaggctaccaatgacaaaatcacaaaagaagatagttgagcctaaaatgtgatagaaggccctagacttgaatggctgatgaggacattatgctcattaataaagcttgagtattgaatgtgcctgtgacaagcatacagcagttaagttttaagtgttcagaacatttgatgaagaaaatatcttagaaaataatatgaaaatcaggcatgtctgtttccaaatcattcatcatcatcatgatcaccatcatggctacaacttactgaactacctgttcagcattgtgccaagaaactgacatagattatctatgttaattccctttttaacataaatgagaaagccctgagatggactgctgtgtcccttgctgactctcttatttctctcttatttcagacctatagcttacacttttcctgtcttctgtgaacacaagttcatgatactgcatttaacaattgcctcaataaaggttaacttcaaagggattcatctatggtacaaacaaaatgctgctacgaggcactttacatttgcaaaatgttctggaaatgtacataaatagcaaagtgaaacagttaagatactgtttcagattctgtgaaccaagaggcggttggagatctcttagatcaaagattttagaggaattttggacaattttgcaagtgatttcctaagatccagtctcttgactagttataaacaattgtgtgttcactgggcctcttgagggcagaagagcaaacattaagcacaaggctaaaagggtttccttggaaacctggtgtttctttaatacagcacaagtcccttaacacgtcacagattttccaggctcctcctgtgtgtctctgaaaaacctgctctttgaattgcacttaaataaacacagggaataattccacttttagatatcctctccggaaagttctatcattgccaacactccatttaacacatagggcttgtcatacaccaggctccaggccaggggttggatatagaatagtgagtggaggaaggcgtggtccctccttgactggagctcactgtgctgtcatcctctaggaaagtctcctcagtttgcactcctggcactgtttgcttcaaattcatttccattttgattcaatggatggatcatctttcctaaaatgactgatattcatgaggtcagcaggcacacccagtaacagacctaggcaatagattctaggatctcagagacatatgaaataatttagtgtggttacagcaaggcttttaatttgcttcagtacaaaatatgtattattcaagttgagctattttggtttttcaactgggcagctggctcccgtataacagaagccatgaagtatgggagatgcaaaggtgaatgggacatagcccatggcccccaggaactgagaatctagtggcgtatattgtctagtaaaaataataattttcatactgagtgatgcttatgttctgaaagcactgagcagaggtagaccctgggaaaatgtaacagggtctttcatgcattaaactgggatcagagcagccatcttaccatattatccctctgagaccttgtgtatataatatctatgcatgcacttaggagttgagcaatttatcaagacctagcattatatccactggtgcaattttgggggtaagcattagtgatatatgctaaaagtggtccccagtagaaaagccacatggcattggtctgggcaaataatttttgtgtatttgacccgaaaagcacaggcaataaagggaacatagtgaaatggatgatatcaaactaaaaagcttctgcacagcaaaggaaataaccaacagcatgaagagacaacctacaaaatgaaaggaaatatttgcaaatcatatatctgataatatccaaaatacataagagactcaatacaataacaagaaagcaaataatctaattaaaaaatggggactggacttgaatacttgttttataaaagatgatatatagccgggcacagtggctcatgcctgtaatcccagcattttgaaaggccaaggcaggtggatcacttgaggtcaggagttcaagaccagcctggctaacacagcgaaaccccgtctctactaaaaatacaaaatttagctgggtgtggtggcgtgcacctgtaatcccagttactcaagagggcaaggcatgagaatcgcttgatcctgggagggagcagttgcagcgagccgagattgcaccactgcactccagcctgtgcaacagagtgagactctgtctcaacaacaacaaagaaagatgatatataaatggccaaggggtatatgataaaatgctcaacattgctgatcatcagggaagtgcaatttaaaaccgcaataacgtatcacctcatacctgttataatgactattttcaataagatgaaagaaaacaagagttggtgagaatgtagagaaaagggaacccctatgaactgttggtggagaacataagctaggacagtcactatggaaaatggtatggaagctcctcaaaaaactaaaaatagaactaccatatgatccagcagtcccactagttggtatttatccaaaggaaatgatatcaatatttgaagagacagctacactcccatattcactgcagcattattcacaatagccaagatacagaatcaacctgtgtccaccaaagcattaatgaataaagaaaatatgtataaaccatgaaatacaactcagccttaaaaaagcaatgaaatcgtgccatttgaaacaacatggataaacctgaaggacattacgctaagtgaaacaagccaggcacggaaagacaaataccacatgatctcactcatatgtaaaacgtttttgtttgtttgtttgtttttgagacagggtctggctatgtcacccaggctggagtgcagtggcacaatctcggctcactgcaacctccacctctcaggttcaagtgattctcccacctcagcctcccaggtagatgagactataggtgtgtgccaccatacatgctaatttttgtgttttttgttcttcttcttgttgttgttaaattttagtagagacagggtttcaccgtgttggccaggctggtctggaactcctgacctcgagtgatccacctgcctcgacctcccagaattctgggattacatatgtgagccaccgcacccagcctcataggtagaatctaaaaacttgaactcataaaagcagagagtagaatggtggttacctggggctgacaggtggagggattggagagatacgagctaaagaatataaactttcagttaaacaggtggaataaattcaagaaatatattgtacaacatagcaactatagttaatagcaatgtattgtatacctgaaaatcattataagcataggttttaaatgttcacaccacaaaaaatgagtctgcagtaatatatattttaattagctttatctaatttagctcagttagaataaattgtgtacatttccacattgtatatatatttcagaacagcatgttgtgcaacataagtatatacaatttttatgtgtccactaaaactaaattttaaaaagagaaggtctccaataaatcagtcctctccatgtcaacaacccatttgtgagacaactttgccttaactcccagattcaagggtagggactcttcctgccccttaaatctgggatggctttgtgacttgctttgaccaatagaaagcaatgcaggtaatgtcctgggagattcaaggtgaccctttggaggtctttcaagcttctaattttgctcaggtggaacccagcagacataagaaggaatccaaacttcctaatataaagagggaggtcacatggaggggagaccctggaggatgagacactccatataaagacaagggtcatgtggaagagtagcgaggctccagaggtctgcaagcccactcatttgggctgtctcagctgaggttctagacaggtgggaggccacttttgattcttcagacccagtccaggtgacagcatgtgaagcagggacaagctgccctccagaaccctgctctgcttcctgtcccaaaaacttattaatataagctgtacaatgatgtttatcttgagtaataactttctgggtgatttgttatgcatctcttaataactggttataacccttctgggtgtgaaccagatccagaggaatatcttgatggttccttatctttcaaggagcccatcaaaggaacttagctctttataaggctcgctggctacctggtgggtttacacagcactacagaactgtgttcactgtgttttaacaacagaagatattacccatctttgcctgaaaataggtttgtgttgctacaaggaggcacagaattatctaagccctgggtcatctcggtgcccaacatgaaaacaaagaatatattaaataaagaatgaagtacactaagcctaaataattcagggttagcattgacaattttcattgatgacgtggatgatgagaaagaaagaatggttactaagttggaaggtctgtgatagggtggggggacaggacactgaaaagctggaatttaaggtaacttattaaaatagattatcattagaatgggaaaccatacattctggaaatgttgagctttaagggcttgaaaggctattgacaaacaatgtgaagggacatgctggttatgagacatttgctggaaattgccctacgagatcatctgggcatcacattcagtttggggaacacatttagtgaggagcattgacaacctgaaaattgaatatcttttatttctgacacagcaacagacattcatcagtcgtaagttggcattggttcttgtaggtttcttctatcctaagatttagttacatcatttatggatattcagtaggctttgtttttgtctgttgatgtgccctccattttccttccccgagcccactcattcctacaggagggatgatgcagtacccctgtctgacacacagctggagtgacgtgttcactcacatgtgcagtgcagtcactgtgtgccccatgatgccagtcataattttaaatgacataactagagttcgtaggctagtgtgattccgataaatgagacatttattctctaataggtagcaatctccaaatagtccatttttagtatgttatgaatggaactagaatattatcatctgacctatccaggtgtttaggtaatgtgtggttatctttttctctgagaaatcactaaatatttatttggataacaattatagttcaatattaatgcttacaaagaaagaaaaccattaagcctaaagaataatttaaatacctaagggtgtattttcaaaactgctcccaaatacatagtcataaaaactgtacagtaaatactggcaatacctttagcttctgagtattgagagctatggcattaaaaagttccattagaatgtaatttgtatttttaaatgttacattacactataatcacttccacattcagccttgattaagaaagtccctattttcccttttatcttatgcaacttgagtcatggtcaaaatatatgaaatagtgatttataaatttggaaaacatgcagggaagcctgaaataaggaaagcgaacaaagtgaaatctctgcttttccagagatgacccaaccagcctgatggtctcttctctgagttgagagcacagtttcaacgctgaagaggccacagagctagaatgtaggaaaaagtactagaggaatcctagtgagaggtggacagatcctgagttttacagagggcccacccctgtcttttattgagttattctgataatgcatgtgggaagattagccaaggctacggcaagaacaagaatcactggagctcatacagaggtgggaatagtttgtatccctgcaagtcagtgaaagtatgtctgaatatttgagaaatcaagtagaaaccacagaattgtattaatattaccttagtaagggagccaatcagttctagactggaaccatgcaaacaagaactgtgcaaacaaggcttaaagcaaggcttgatggaatcatattgaggccaagtaactcaactgcatcccagtaaactgtccaacaatattgaaagaaaactaaaaaatccagcacccaaaacataaaattcaaaatggctgacatccactaaacaattacaaaacatgtctaaagcagaaatatgtatatattatataaagcaaaattatatatatggagaaaaataaatccattttaacagtccaaaaaataaagaaatgaaacagatgataaaattaacaggcaaggaaattaaaacacggatcataaatatgtgccattttcaagaaggcagaaaaaggatagtataaatggaaatagaatataaaaattaaacccaagtaagactttagaagataagaaatttaatatctgaaatgaaaaattatcattggttgggattaataggaagttgggcaatgcagaagaaatcatctgtgaactcataaacaacaatagaaactacacaaaatgaaatacggatagaaaaagaaccagataaaaatgaacaaagcatcaatgacttgaagtgtaatatcaagcagtatagaatatgtgcaattagagacttaggggaggcagagttaggactcctatcagaggaaagaagagatagaacagaaaaaatatttgaagggagtattgaaataaatagttccaaagttgatgaaactataaagccacagatgcaataagtaccgttaatattaagccaaggacatatgaagaaaacaacaccgagatgcatcattatcaaactgctgaaagccagtcatgaagaaaaaaatatctaaaggggccagggttaaattacgaacaaatgaagacaagaaagacaagattttgccatgcaaaccagagacaatggggtgacacttgtaaagttttcaaagaaaaactgttgatatagaattctctatacagtacaaaaaaaaaaaattcaaaaaagtaagtaaagttgagtcttgctaaaactaaccaaagtagaaagaagtcattgcccacagacctgcactaaactgctcacaggagcctttctggcagaaagaaaagaacatcagaaaaaattcaaccgatgtaaacaagtgaggagcatgagagtcagaaaatatgtggttaaatgtaacaccttttattatcagttttaaaatatctttaaaagataattaaccatttaaaagataattaaccatattttgtgaagtttacatcatatgtagaaataaaatacacacaaaaatagtagcaagtctagcaggggagtattggaaatacactgtaataagattcaacaatatatgtgaccagactcaatattacttgaagatagacagtaattatatacacacacacacacacacacacacacacacacacacacacacacacactgaattgtaggggaaaacaaacaagcaaacaataacaacaaaagaggggcagaataagccacgaatggagacaaaataatgttttatacaattaatacaatgaaatatggacttaatccaaaagaaggcaagaaagggggaaagatagaacaaaggatagataggataagcagaaaacaaatagcaagactgaaacccaacattgtcaataatcacactgaattttgatactgcaagtatttcaactaaaaagcaaatattatcagattgtataaaatgcaagacctaatcatatgctgtgtaaaagaaacatactttaagttaagtcatagaaaggttaaagcaaaaagatataaaaaataaggcaaacaaaaaatctcacataaacactactcaacataagttataatagctaaaaccattgatgtgaaatagatatcaaagtgataaacagaaagactgaagaagtgaaaatgagagaagacacacattaccaatataagtaatgaaatacgagatgccactgaagatcttccagatattagaataataagagaataatatgggcaattctacacatacaaattaaacaccttagactagtttctcataaaaccacaaactaccaatactcactaatatggtttggctctgtgtccccacccaaatctcatcttgtagctcccataattcccatgtgttgtgggaaggacctggtgggagttgtttgggttatggagttgggtctttcgctttcctgttcttgtggtagtgaataagtctcacaagatctgatggtttgataaggggaaacccgtttcatttggcattcattctctctttgcctgctgccatccatctaagatgtgacttgctcttccttgcctctgccatgattttgaggctcccccagccatgtggaactgtaggtccagttaaacctcttgcttttgtaaattgcccagtcttgggtatgtctttatcagcggcatgaaaatggacgaataccgtaaattggtacagtccagtggggtgctgatgaaaagatacctgaaaatgtggaagtgactttgcaactgggtaacaagaagaggctgggaacagtttggagggctcagaagaagacaggaaaatatgggaaagtttggaactccctagagcctagttgaatggctttaacaaaaatgctgataattatatggacaatgaaacccaggctgaggtggtctcagatggagatgaggaacttgttgggaactggagcaaaggtgactcttgttatgttttaacaaagagactgatggcattttgcccctgccctagagatctgtggaactttgaacttgacagatatgatttagggtatctggtggaaggaatttctaagcagcaaagcattcaagatgtgactagggtgctgttaaaggcattcagttttaaaaggggaacagagcattaaggttgggaaaatttgtaacatcaccatgcgatggaaaagaaaatatattctgaggaaaaatccagtttgctgcagaaatttgaataagtaactaggagccaaatgttaatccccaagacaatggggaaaatgtctccagggcatgtcagagacctctgtagcccctcccatcacagacctgaaggaaaaagtggtttcatgggccaagcccaaggtctctgtgtgcagcctagggccttggggccctgcatctcagctgctccagctgtggctgaaagggaccaacatagagctcaggctgtggcttcagagggtacaagcctcaagtcttggcagcttccacatggtgttgaccctgcgagtgcacagaagtcaagaattgagatttgggaacctccacctagattttaaaacatgtatggaaatgcctggatgcccaggcagaagtttgctgcaggggcagggccctcatggagaacctctgctacggcagtgcagaagggaaatgtggggtcagagtccccacacagagtacctactggggcaccacctagtagagccaaaagaagggggccactgtcctccagaccccagaaaggtagatccactgacaacttgcatcatgcatctggaaaagctgcagacactcaacaccagcccatgaatggagccaggagggaggctataccctgcaaagccacagaggcagagctgcccagaccatgggaacccacctcttgcatcagcatgacccagatgcaagacatggagtcaaaggagatcattttggagctttaagatttgactgccctactggatttgggacttacatggggcctgtagcccctttgtttttgccaatttctcctatttctcttgattcaatgcaatcccaatcatcatcccagcaggatattgacaaactaattataaagtctgcaaggaaattccaaagatacaggatgactgaaacaactttgaataagaacaaagtgaaaggatttagactacttggttttaagactcattatagagttacctaatcaagacagtatattattcacacaaagataaacatagggacctaaggagctgattagattctgaaaacagacccacacagatagagttaattggttttcaacaaatgtgcacaggtaattcaatggagaaagaaaaaattcaaaaagtagtgctggaatatgtgaacatacataggggaaaaaaaactaagaaatctgtatggccaaaatggacctcaattattgcttcaaaccatatacagaacttaacttgaagtagctcatagacctaaatgtaagagctgaaactgtaatatttctggaagaaaacatttaagaaaacggaagtgaccttaggctaagcaaagatgttttatatgggacaaaaataatttgagctataaaagaaaaaatatttataaaacaagttacatcacagctgaaaaccattgctcttccaaaaatacgtttaagaaaataaaaagtccaactgcagattaagagaaaatatttacaaaacatatatatgataagggaccggtatctagcacatataagagttcttagaactcgactataagaaaacaaaagtcttctttgccatttacaatgtgcaaaatatttgaacagatacttagtgaaaggagatatatgaacagtcaattagcatattttaaatgtttaatatcattttcagggaaatgtaaagtaaaaccacaatgagataccaacgcatacctcctagaatagctaaaattaaaacgtactgtgaagaactgagacaactaaacttttcaactattacttgtgggaatgcaaaatattaatgaataatttacactttttccatgaggtacattttgatattgcttagtccctatttttctctttctttttctttaatgttggccttacaatattaaatgtatttcagatcctaacaatgagtgcaacctgcagtgtgaaatacattgatccagttagctatataggtatgtctcaaaaatcacagattattattatcaaagtgcagagaatatctcgagtgagtcattacctgccgacatgaacctgcctaaggcaacaaagtgttctgataaagcacaaggtaagtcatcaggtctaaaagctaaaaagataatttatcaagacatgggacaaaggaaggaagagctatttattcatctcagctttattcagcatatagatattcacaagtaaccaagagacaattttcttaccctcaataaaatatatccaaagttacatatagcaggatttataatatatgcctacaacattttccaggatcaaagctacagaaagaaggtgtgattccatggaaacaaaggaagaaaaagcctgagaaaaaaagacctggaatttgatttggacgtttttcacatgttaggtactcaatagaatgtatttcttgatatcaaattaaagattatcatcaaacgagcctgattttttctaacaaagctctgtatttatatttaaatgtaggatacatgattttatatagttataaaaaaagaaaagacagatggaatttaactggctcaatttctaggacaaaatagcagtgcaacatggcggaatataaaagggcactgtcatctacagtctctttaacagagcgtgccaaaagttggtggcaccactgttagactgttcaaacaacaaacagagctaatatactgagttatagatgtatttcaaagagaaatgaatatgaggtagacaaactaatgaatgacccaggtctggatggtcactgtgcaagatgctgaggagtgagaccaaatgttttcaaggagcacagttgcttaggagacattgtgataatactggaagagaaatctagaatcctgaaaggacaaaagaactggcctaggcctggacagggaagttgccctggccctggagaaatctgatctgcagaactgcacaaatgcctctatccctctaagggagatctcacaccctggcaaggtaattgctgtgaggcaccatttgcacaggctccccagggggccggtgggaccctcttcgagggtcttctcatccttatacactgcttcccctctctaaactctcccaacccctgccgcaatccctatacacaccttcccccaactctcaggacggcaccatcatgtcatgcatcgctgtcatcattatccatttttattaatgacacataggttttatagctcagattttctatttttaggcagaaaaaaaggttgggaactacaggcacacaggattacttcaaacttccaaaataggcaaaagaggttatttgcaatctagacttcatcagtttttctgtgcaaatatatttttttcaataaaatgacctgcacacttggacatgatgtgaaaagtcctgccttggctggacatgaggggatcccctttttctggattggacacatttgatttaacgctctgcttcatacctgtccttcaaggctctgctcctgcccactcctctatttctttgtggcatttttctgacagcccatcctgcattggtttctcccctttctgaactccgttacccttatttgtactgatcgcttgacccactgtgctcacacacagattatgtcttcatctgtctgcgtgttttatcaataaaggaaggaaaagcctcgtaattatttgtagaaatacccttggttgcactctgtgcctggtaagtttttggtgcttaatggatgcttgttgaagttatctaataaagaaaatggacattcctcttgccatctcttgtgtaaatgttgtcattttgccaaaataagcagacaaagagtttggagacaagaatagtcactgtatttcaagacaaagcaagagcaaaatgaaaaatgacaggtttgtagtttcagcaatttggggaaaaaagtgagctatttgcaaaaaaaaattgtagggattgatataaacttcaattgagttgatagaattattaaactaaaagaaaataaggatcctataataaaaactttaataaaatttcatgaatgatatgtctaggagaggtattatactactctctagtggttggattatagagcaagatgatttcagaattaatttaggatttttttagaaagataaaaacagaaatgtaaataaaatttaaaatctcattctttcatgaacatttcatgccccccaaaaatgctttataatttcaaaattcaagaacatctcatgtaactagctatcattacaggtgaaaatcaagggactctggaacgtgcaatgctccttcaaattttgtcatctgaaaaggtgacattggtctgatttggttgaggcatctgactatatctgtaactctgacgtccatatttgcatttccaatatgacaactcccaactgaataggaaatttcctaaaattttcctttaatagcattgtaaagttgttaaggttgcgtgaacatctatttttatctcatttattttcattttttattgccaatatataatatttcatacagatttaattttattattattatacttaaagttttagggtacatgtgcacaatgtgcaggtttgttacatatgtatacatgtgccatgttggtgtgctgcacccattaactcgtcatttacagatttaattctttttgagcagaaaccatttttcaagacaataaaggtgaagaaataaggtaatctttaaataatcattataaagatcttgcaaattgatggtaaatttctgagtacaatagaaaatacattagaatcaatttcagaaacatgaacacaagttaattgttgtgtctaatgtgtaatattgcatttgatatttgatgaagaaaaatagatatacagagccatgtatatgtccatattagacagtaaataactcatattttatcttattgctatagtatggaatttagctataataaccacccagatatttccggtctggttctagatatataaagcaatttaattcagtttaacttagcaaattataatcgttgtgcttagttaatattaatcacaagaaaaattaaaaaatccctttcacataagtacatcacttgacataatagacatgaagaaaggatcacaataacaaaatacaaaaaaaaagttgtttatacaaattatctcatttatttctaagaaaaatgcctgtccactatcatgatcctcatgtataaacggggaaggtgaggctccaaattatgaagccccttgccctcagtaactttaaggcagcctcaaacctagacctagtgcgtggatacacctgccctttcttctatgcaaaagttcctcaacaaaaggcagattggagaacttccttggaagtaaccattgaagtacgataggggattagaggggtgtaaagaaccttcatgaacatgaagccagagtatcagttgtgttcggcaggagatttcaatgccatccattgaaagcattgagattcagtgttatccattgtgtttggcaggagatttcaatgctcagattctggaaaactgtctgggtgggaagacaggaaagtaaggctggccagaggaaaggattcagtgaacgtcctctaaactttgacatggtatctgagcaaaaaatcttctaagagtttaagttttgaccaaccaataagttttaattgaaattcaagttaaagatgtggatgctgaaaaaaactatgatatctgtaaatccaattcatatagttctgcagctgggaacgggagaattttgtaatattccaaggagggtgtttaggttatgtgaggtgaagattatggccacaagaacatgggttttactggcaatcaaagcaagccttcttttgctcaggattgccggtactgaagggcaaaagtaagattgtttagcaaacagtaaaaattagtgttttagaaaacatctaattaattatcacaacataaaccaaaaaggaattttgtatgtgaaactagaacaatctgctaaaatgaggggataggctaggatgtgaataaactggatagatatgaaaaaacatgataaatgaattaaggactgaaaacagtagaataatgcataaaattgaattagtggggtaaaatacaaatacaaactataaatgtttcacaaaaatttagagaaaaaaaacccctgatagaacaatttaaaaacctatgaactggacatgaatattcaacctatttttttccaaaaattccaggaattcaggacacagaaaaggaaataattaaagaaaaaaatatatatctattttgagatggagtctcgctttgtcacccaggctggagtgcagtggtgcgatctcggcccactgcaaactctgcctcccgggttcacgccattctcctgcttcagcctccagagtagctgggactacaggtgcccgccaccatacccggctagcttttttttttttttttgtagttttagtagagatggggtttcactgtgttagccaggatggtctccatctcctgacctcataatccgcctgcctcagcctcccaaagtgctgggattacaggcgtgagccaccacacccagcccagaaaatattttttaaatgtattcaagagttcataaaatcctgtgttttcagatagaaaaattcatgaagtatccgaaatattatttaaaagagaaataattctgaaacatatatcaaagaattttgaaatataggggtaaagaaagttttctaactgtgcaggctggtaaaacaggtaatttatacatgaaaacactgggtttcatcatccaaggtcaatggaacagaatatgcacctctctgagcaaacttctatacccagccatcttatctttcatatatgagggcaaagaaagagattcacccagattcaaggtctcaccagctataccactcacatataatttctgggaaaaattactcagatacatcttctagcctatcaaaagaactcaagaatgtattgcataacttaatctcagctaaacataaattatgtcaaaagatatgatatggtcatgaaacctaaaatcaattctatcattgtcagcatcatcatcaccatgtataaagtctcacattattgttattggaacaaggaactgactagaaagaataaaaaattaaaattatataaaattacccactttatacccaagaaacccatagatacttttttattcttggcttttacacctataaaaaagtttggataagtatatataaaatttaagagtaatcattagaacaaatactgaaggaatgcttttgagtcattagagaaaaagtggttatgaaaatgacatattaagggactgataatataataaaacaaaaaaattaggcacaaagcaaaatacagtaacaggataccaattgtgatagctttgtagctcaagaaaactcatattttcaagaatattgaataatttgatgagataatcacaatgtaacactggtaaaataagcccggtgagaaattatatataaacaatgccaattttcatttttaaagtaagtctatagatatatgtgaaagactaaaaggaaacagtttgacatgaatctgcgcttgagtgtatgactcaagatctatgacttgggttctggatttcgtttatcttttctttatccgtatcaaaagcctctacatttgctaaaatcagaatgcctggtatttataattcagaaaatcagcttttgttttcaaaaggtggaagccactgaaatcctgaggaaaactgagggaatcaagtcaaactttatggagcaagcaggaaggtcaggattcaggagagttggtttgaaccaagtatctatggtgttatgggttgaattctgtttccccaaaatttgtatgttcatgtcctaccaccagtatctcagaatgtgaacttatttgagaatactgtccttgcagatgaaattagctgaatgaggtcattagagtgagcactaatccaatatgcctggtatctttatacaaagggggaatttggacacaaacggacatacaagaatgccatgtgaccctgaaggcagatatcagatgatgtttctacaagccaacaaaatgccaaagattaccagcaaacgaccagaagctacgatcaaggaatggaacagattctctctcagagtcctcagaaggaagaaccctgctgataccttgatctcagacttccagcctccaaaactgggagatgatgcatttctttcgctgtaagccactcactgtgtgtgctttgtgatggcagacccagcatactaaactaatattaaactaatatagaagcttaataaggagagtgcctgggagcaacagcctcaggcatagtcttaaaagtgtcaccttctcacctatatttaccataatatgttaacctgacaattgtttcagccatgaagaaagacagaggaattgatgtgtgttcaagacttgagagccatggagaggagctggtatcaccactgcctgcagctcaggcccatcactgcatccttcactccaccattcctcacctggattcacctcacccctgacgttagaacctgaacacgcctccgaaactggtgagacagaggagagaaactaagcatacagtacctgtcctgtcttgtcaaagggaagcctgaccttcggtaagcatagtcataggcaaggggaacccagcctgctcagaaagtgctgcatgagttcattctgcaaacttcagggcacttcttagcatgctcctttttgaagaattacatttgtgcttgtgggattggtgtgggacactaggctagaaaaatttggatatcaaatacatgtgctctcataggagctgccagcgctgtgtgttttgaggtgtatgttgaaaaataaccctgtcccagagcctttcttttactgcctctcacagtctttgaatttccgccatcaaggggcatatctttggctctcaggagagataaacaacagtattatcaatcaccattttagcagaattaacacctgagaggcggaaaccaaaatggacaaaggaaacaaaaagtacttggattttaagacaaatatctccatgactttctctctgacagtgttgaaacaaatagctccttgggagaggacatttcttttcccaggtgccctgcaggggagggtgcttagaagaggtctacagagccaaccttgagaaatgtcctatagggctgtggtttccctgcctaagacaaactgagaatgaggaggctctgagcatgtaatgcatatggaggagacagaaaaggctcttttaaactgaatgcctcattgacacaactgctatctttctataaacttagacaagggatggcaattatgagcatatccactgatgcatgtcctgctcatgcccatggcagacattgctaatcaattactacactcttttctagtgagcacagataagacttcagaatccttctcagttctgcattccaggcagtcactaccagtcagatggaactgacattcaaaatgtaatttatttccagtcttggccttcgagggcatataccctaaaagtctaaaaggttcgttgacatatttggatattttaattttatgtgcctggatagaaagctttgttttaaaagttggtggccgagcacagtggctcactcctataaccccagcactgtgggaggcggaggtgagcagatcacttgaggtcaggagtttgagaccaaattggccaacatagtgaaactccatctctactaaaaaaaaatatatatatacaaaaattagccggtcatggtggtgcatgcctataattccagctactcaggaggctgaggcaggagaattgcttgaattcaggaggcggaggttgcagtgagccaagatcgcgccactgccctccagcctgggtgatagagtgagactccgtctcaataacaacaacaaaaaagttgacatgtaaagtctattttttaaaaaatgtatatgttgtttttctggattttcaataacaacttgcaaaaaccacatttttaaacttcctccatatgaggcagccacaaaaccaaaatctctttgctgcaggtttttccaagaagtaaaggtcttgcagaaaatcatacattcaaatattccatcaatgtaataggtaatcaacctcaataaaatgttcgtctatccacatagaatactattgcctaataaggtcttttactaagtaattataacgacacaattttatcagtaaaggttaagtatctttatctgagcagaatccaatgaaattagtcctgatgtaataagtaccatttgtcactattagagctagaggggttgacaggcttggatgtctccctggcaacccgagtgttccatttcttttttctgtaaccttagacactaacaaggcataaaagtccagagggcatagaaggtatcgcctgggtaatttatgtaccctcttctgactttgccaggcagtggcatatgcgagcatctagaagcattttaacagcaaatatattcattcccaaaattttgagtcacgatgaatattttgaacagaagtattgtattaatgtaggtaggttttcattaacaaggacagttactaatttttaactgactcattatccacaacgagagagagagagattgagaacatgtatgtaaacggtgttacaacttcctaaacacactgcgcatgctcacctcccaaggggaaggagggcactgcgcatgcgggaagctcgtcctaagcgaagagtcatgggaaaggggtgcaagacacctgaagtgggccagcctacaaagtcctaggatcaaggttaaagattgcacttgtccttcaagttgcctgcttcagtctcttccaagtgtacttccctttctttcctgttctaaagctgtctaaaataaacttccactcctgctctgaaacttgcctcagtctctttttgtgccttataccccttggtcgaattctttcctctgaggaggcaagaattggtgttgctatagagccatatggattcgctgccggtaactcagataccatccaccagtaacacatgtgggccatgatcagtgatgtaacaaaattaattatgaatggcatttcatagatgttcctgctatcagtcttaatgggcagaaatccaagagcggaggctgtgaggggtgtggggaagagggagatgctggataaacatttagagaaatattacaaacaaaattttatatttcctcactttcctattatcctttctctttttatatatagctaatatcggttttccactttaataaataagctaatataaaaatatgatttctaaaaacaggaaggtaaaatttgaattgtcctatttttaaattttgcaaacatcaataccaagatttggaacactgttaatttgcagatagcctagcagcatgacgtaccttttaaaacagatttcttttattttctaatttagaagtcatgggataaattgcgtccccccaaaattcatggcagacccctaacctgcagtatctcaaaacatggctttacttggaaataaggtctttatagtgataatcaaatttaaatgaggccattaggatgggtgccagttcaatataagtggtgtccttatagaatggagaaatatggagacagacactgacacccatagagggaacatgaggtaaaaacactggaagaagccagccgtgtgactggcgtgatgtctataatacaaaccaacaagagcaaggcttgccagccagcgccaggtgccgcaggaggtgagcaaggacctctccagaactgtcagggagaacatggccctgcagacacctgaattttggaggtgtaagctccagaactgtgagagaatcagcttctattgtggtcatatgttatggaatccccaggaagctcacacaatttacttcagattaaagataaaaaatctatttccagaatataatcaaaggttcaacaacgatatgcctgaggacatgacattctgggaatagattatattctggaaatagctttcttatctttaatctaaataagctgtgtgagtttcctgggggtttccacaaaaaattatcacaacaggccagtcgcacatgtaatcccagcactttgggaggacaaggtgggcagatcacttaagttcaggagtttgagaccagcttggccaacatggtgaatctcctcatctctattaaaaatacaaaaaaattagctgggcatggggatgggtgcctgtaatcccagctattctggaggctgaggcacaaggattgcttgaacctggggggtggaggttgcagagagccaagattgcaccactgcactctctgtgacaagagtgaaactccatctcaaaaaacaaacaaaaattatcacaacagaagtttaatctcttacagttattgaggctacaactccaaaacagaaccaaggtttgggttacataaaggaatgctgggatcaaaaaagataatgatgtagctgagattaaaattctcttcccggccaggcatggtggctcatgcctgtaatcccagcactttgggatgccaaggtgggtggatcacctgaggtcaggagttcaagaccagcctggccaacatggtgaaaccccgtctctactaaaaataacaaaaattatgagtgagaacatgcggtgtttggttgacgagttaacgggtgcagcacaccaacctggcgcatgtatacatatgtaacaaacctgcacgttgtgtacatgtaccttagaacttaaagtataataataaatagataaataagaatttttttacccccccctaaaaaaaaaaacatacaaaaattagctgggcgtggtggcgggtgcctgtaatcccagttgttcaggaggctgatacaggagaatcgcttgaactccagcctgagcaacaaagagcgaaactcggtgtccaaaaaaaaaaaaaaaaaaaaactcttccttgttcatttcataaacttaaaaacaaaaatacagctttttttctgttttagtataattctaaagaatatatttacttccaatcttatagtttctaatccaccttcagcatgtatatacacacacacatgcatgtgtatccataaacatatataaacatacacatgttaactatatatgttatatatgtgaacatgaataaactatgtatatatggatatctatctatatataatatccttttgtagggggcagaataaaggacaatgaagctaaacttttcagtaaatttcactttgcttgctggtcaatcaagagcttctccaaatctcatgtttgattgttaaatttgcacctgtgaacacacatggattggggtcagagggtgtggctggccccatactactccattggtagcactggaagaaaagaccgactctggactgtatccagcaaagccaggcacaattgtcaggggcttgtgccctggggctagctaagcaggaggcagacttcctaaactagcctgactgctgtcacagttaacagaagctgcatagatgggtctgcctacaatggtcacaaatgttgtcactttacaagatccatggacagtttgttggaaaacctgtgctgcttccttttctctccatttgtcctttcattggccattcagtaatttggcgaggtggtctatgggcattttcacgagtggacgttgcctgctgtgggaacagttcacggcatctatgtgtctatactactatgcatctgtgactactttcagaaataggaaatttgtcatctcgttatacattctaaattgttaaaggttcataatgtaaatggcaatattaaagttgtcaaaggccacatttcactatttattttgtttttagatgtcaatgtcataaaagataagtgttctagagagtactatgacatgagagatgaagaaaagtacaagatactttcccagaggcataactcaaagggctggagcctaggaaagaggcccagcaagctttgttgtgtgcttcctaggagcaccagctagtgaccacagcaaacatgacaatgggaatggtgtcatttgggctggggggttggagcagcacacacaggacaatgtccacagtcattctcctcagtcaagcccaaaccgtcatcttggctcacatttgctctttcttcattggtacttggctaacactttgaaaaaaaaatctagtgtgcaagggtactatccctatttgtgggaatacttattacagggggtataataagcagctccctaggtgtcagccccgggacctgatgctgtcagccgtctgagataccagaagcttgagtgttctgattccaggctcaccaagcaaccttctggccacagcactctctgcaatgagccttgaagacagcgagcagggcatacaggagaggggcctaggtggcccagctgactgctgctctggtcatggacctgtctgtcccagctgaccagaccactgtcattggaatggggctgtctgtcctagctgatcactgtcctgggcatgaacccgtgtgtcccagctgatcactgtcctgggcatgaacccgtgtatcccagctgaccatggccctcggcatgaacccatgtgtcccagctgaccatggccctgggcatgggccattcatatactgacaaactcaattgttcaataggttaatgggagctttgttaccatgaaccagaattaccaaaccccctccaatctgggtcagtatcaggatcgtttttcagagtctagaaggctaaggtcagacctcaagtagaagagatttgccaaacacaatgcccacctgcagtcaacattcagaatccctggccttccctctgtgaatgaaacctcagctcccttattgctacccactttgcagcactttatgcaaaatctctacagcacagtaaacacagggaaagagttagggagaggataagctgccccattggctttgtcattggaagaatgctgcagattctcatcctgatgcatcaaaccaaaccagacacaagctagggaggctatgctcacggctgcctgccgcatgtggcctggtgctgctatgtcttcctgtgagctttgattgaagatgtcatccagttgaggtcagttaagtattgtgttctggatgaatatcagcactgaggcagaaagccccatttttttaaagggaatttcccaaatgatactgattaatcagctgaattttgatcctaaattcttccagaccttgacccattatactttgtgctacactgtatcatcttcgctctgggagagctccatctttcttgtctgtcctcacagtccaggtccagtctgatctactatgaaggggaatctgcctttaagtttctgaaatttaggcttggcatgttcaacaccaaagctcatctgtcttaaccctaatattttacctgagatttacttactcttcattctcccaacaaaggcgctggcctcaactgtgtgaccatgagggcaaatactttgtgtgtgtgtgtgtgtgtgtgtgtgtgtgtgtgtgtgtgtgtgtgtgtgtgtgtgatggagttttgctcttggtgtccaggctggagggcaatggtgcaatctcgtctcactgcaacctctgcctcccgggtccaagcaattctcctgcctcagcctccagagtaactgggattacaggcatgcaccaccatgcccagctaatgttgtgttttcagtagagatggggtttctccatgttggtcaggctggtctcgaactcccaacctcaggtaatccacccgcctcagcctccaaaagtgctgggattacaggtgtgagccaccacacactgctgcaaatactattttattatcaattgttgaactgcagttatgagtcttttatagagtctaagacaagcaaaaactaaacgagaaggcagaactatctccaaacaggatatgcaaatttactaattccctctagagcaaatatccatatttagtgtcgtggggctgtgtgtttcagctggccgctgccctgggcataggcatgttgtgtcccagctgaccactgacatgatatcgttctacttcctttatcatacagcgacctaatacacacacacacacacacacacaccatttcatgtgactcctttcatttaggaatataaaatataatgaaagttgcattagtgtatgaaaactttgcattttaggtactttttcaagcatcactgtaaccccttgcagcatggcacttttgacagcccccacatggctactgagtacatactgtataggaggctctgagcttgctaggcaagggagatgaactggcaacaagacataatctttgctctcccatggtgcttaaagttgtatccaaattttcaatgttattatatggcaccaacaaaatataataatgtttttcattgcaaacacaactgcagatttccaattttttgcaaaatgtcttttgcaaaatataattttaaatgttacatttatggactttagagaggcagtattgtatcaagttttttgtgcttttttttttttggagacagagtttcactcttgttgcccaggctggagtacagtggcgtgatctcggctcactgcaacctctgtctcccgagttcaagcaattctcctgcctcagcctcccgagtagctggggttataggcatgcaccaccacgcctggctaattttttgtatttttagtagagatggagtttctccatgttggtcaggctggtctcaaactcctgacctcaggtgatccacctgcctcagcctcccaacgtgctgggattacaggcatgagccaccaagcccagcctgcatcaagttttaaagtgtgaactgtggacccagatagcctgggctcccagctcagggctgccacttgtagtttggaaagttgttaaacgcccttgtacttcaggtccttataatgtcagtagagaattaaatgagttaatacaaacaaacagcacctggcttactgcctggcacacagtaagtactcattaagtgctggctattattaagtactccagaatatgttacttattttacttatttgataaacactttctggattttttctatgctgggcgctattccagatggtgagatgcaaaatataataagacatgacctctttccttaatgcaattttgggtcataggaattaaagttactaatatctccttaaaaatgaccaagaaaagagccttcagagcaactctattaaaagtcattaagaccttgtgtaaaatacaaatgaacaaaaaataatttttcctaatatccagtaatctgaagagtaccctcacacacatagagggggctggtcgctgcttgtcacctcttgctaaaatccagcactctgcacattgcatttgatggagaattaatcttcataccttcactcacagcctagctcagtgctattttaggtacagttttagcaacacaatgttttctacaagttgatgtagagacagctgtgatggttaatactgagtgtcaacttgattggattgaaggatacaaagtattgatcctgggtgtgtctgtgagggtgttgacaaaggagattaacatttgaggcagtgggctgcggaaggcagacccacccttaatttgttgggcacaatctaatcagctgccagcaaatattaagcaggcagaaaaacatgaaaacaaggactggcctagcctctcagcttacatctttctccctggctggatgcttcctgctctcgaacattagactccaagctcttcagttttgggactcgaactggctctccttgctcctcagcttgcagacagcctcttgtgagatcctatgattgtgtaagttaatacgtaataaactcccctatatatatacacacatatctatcctattagttctgtcctctagagaaccccaattaatacaacagtgaagagtggttttcagggccctggctctaccgctggactcctgtctatcttcctcctgtgtagctttactgccggcttcgcctctttgggcctcattgtcacaatctgtaaacagaggttttgggaaagtcaaatgagataccgtgtgcgacgcacttgaggcagaacacacagcacgtgcttcacacatctttaccggcattcttcttctctagctgtacaactagaaggtggtaagggtggaggcagcagtgagagagaagccgctactgagacagctggagagggagaaaaacaactgcaaaatcttacaaatgaaaaccagcaattcgaaaagcaaagcagtctgagaatatggagcatctctatgttatacagaatctctgcgaagataaatagaacaaaaatagttatcctgccacatcttcattatctctcatttaaaagggctgatgttatgcaaagattttcagaaaaacttccatctaaactaattgaaatctcatgtaatggggtgtacaactggcccctgaacaacccaagtttctgcagtttcactgatacacaaattttcttctgcctctgcccctcctgagatgaatccttctcccccttcctcctcctcagcctattcaatatgaagacaatgaggacaaagacctttatgacacctcagcctactcaatgtgaaaacaaggacaaagacctttatgatgatccacttccacctaatgaactactcaatgtgaagacgatgaggacaaagacctttatgactcctcagcctactcaatgtgaagacgatgaagacggagacctttatgactcctcagcctactcaatgtgaagatgatgaagacgaagacctttatgatgatccacttccacctaatgaatagtaagcatatttttttattccttatgattttctgaataatgtgttcatttctcaagattattgtaagaggacagtatctaaaatatataatgcaaaaaatatgtcaatcaactgtttatcagtaaggcttccagtcagcagtaggctactatattgaagttttggggagtaaaatgttatatgcagatttctggctgcctgagcagtcagtaccccaactgctgcatttttctagagtcaaccgtactagtttcttgtggctattgtaatggattgccaccaacttagtggcttaaagcaatagaaactgattctcttataaatgtattcttctggccaggtgtggtggcttatgcctgtagtcccagcactttgggaggccaaggcgggcaggtcacctgaggtcaggagtttgagactagcctggccaacatagtgaaaccccggctctattaaaaaatacaaaaaaattcgctaggcatggtggtgggtgcctgtaatttcagctacttgggaggctgaggcaggagaattgcttgaacccaggaggttgcagtgagccgagatcgtgccattgcacttcagtccgggcaacagcatgagactctgcctcaaaaataataataaaaaataaatatataaataaataaataaatatcttcttcttctgatagtcaaaaggctaaaatcaaggtgttggcaaggctgttttttccagaggcttcagtggagaatctgttccttgcctcttccaccttccagaggctgcggtgtttctcagctcctggccatcactcagatctccacttccttcctcacaccaccacctcccacttcggccctccagcctctgtcttatgaggacccttggggttacctttagatgccactcaaacactctaggatatcctccccacttccaaagatcctcaatttaatcacatctataaagtcctttttcccacgtaaagtaacattcacaggttcctagtgcttcggattcaacatctttggtgaatggggcattattcagcctatcatataggacacagctaattatcttgccctaaaatagatgccccttttcatcaacgaagccagaagatgagctatgaatagatatagtaaaggaaaaaagtagtcagtgcccttcattttgacatgcatcaacttactaaatctcaaagcaattatatggcttaggtgagataatctctgtcatacaggtgaggaaactgaggcccagagggtgaagtcatgtgcccaggttccacggtagctgagctgggtttgcacctggggaagtctgagcctgaaacctactctcttaaccaggttgacccatcgcttctcgtttgttcttctttcccagctgtgaaagccaacatttctgttgtaaccattttctatctgtttcaaattataagcaatttacagatacaaaaaaaatcagtcacatttcttcttcattcattaatatacctgtcaaaatgagccgggcatggtagctcacgcctgtaatcccagcactttgagaggctgaggtgggtgaatcacgaggtcagaagatagagaccatcctggccaacacggtgaaaccctgtctctactaaaaatacaaaaaattagccgggcatggtaggtagtcccagctacgcgggaggctgaggcagaagaattgcttgaactcgggaggtggagactgcagtgagctgagatcatgccactgcactcagcttgggtgacagagtaagactccgtctaaaaaaaaaaaaaaaaaaaaagagcacctgcagcaggcaggcaccagctgcacgggaccaacacagaaagcataacatctgcctgttcatatgggctccttctgctttgactggccccatctccaacccctgcacgggactgcatttttctttgaagatgattttcctataattcaattattaaggaatgaaaacaaaagcttggagagagttggatttgttcacactgttggcggatggcagaggtaggatttatttttttctatctctcttccagtttagggaaatggctagcaagagactgcacaatgtcacctgaagtggatgacatcacttgaaataggtgacatcatctgaggtggatgtcacctgaggtagatgatatcacctgaagtggatgatgtcacctgaggtagatgatgtcacctgagttggatgaggtcacctgagttggatgaggtcacctgaggtgatgacatcatctgaggtagaagatatcacctgagctggttaatgtcacctgaggtagatgatgttacatgaggtaggtgatttcacctgaagtggacgatgtcatctgaagtggataatatcacctgcgttgggcgatgtcacctgaggcagctggagtccacaccacatggtttcacctgggaagggccagtgacttccaaggggcatctagaccgcctttcttcttccaaactgggtatttcattctggccctcgcatggctgcctgtcctaatgcagttccacaactttccttaccagccttgtcatcaccattttccttttaatcatgtttacacacacatgatcacgtggtggcagagcacacttattctcaaacattaatgccacacaaagtccaccaggacaggatacgtttaaccctttcagcttgtacagccagagcaggtgtgaacacacaacatggaggcagagagcagtgtgctcatgccaacacggagacgccaacaacggcgtcaaacatcagcaaatgagaaatcacacatcacctttccagtgtcttagagttaaacaaaaccctttcttgaaaaacagattatttgaatttaggcttagaatcaaatggctgaactcaaactctatctggacgctggcaagaccatgcacactacaggatggtagccactgtaggatggtagctcagcctgggggctggggacacaggctgcagtaattgcttctcataatggtgcattatgctaggaaaacaaggtgagcaattttcctaatcaggccatcaggtggaaataattaaacaaaataatgcagcagcacctcaattataattgcaaaaagcagtcctgatatgccctgtgtataatgaaggaaaataatttttgaatttgtgtaattatttgttattctcaataaacctatattgatcattatcaatacaacatgtgtcacaaaaaaacacccgattagacactaaatccagatattggggagaatgtacaatcactgatatgtacaagacccatttcagctatgaatgattatttcctcacagccttgagaggtagccacaattagccttgtttgttgagtgggacaagtaggaaacgaagaaagaacatggccctaggatgaccttttgagacaggccatcctatcctgaaagacctacattgtccccaacaagtgctctagaaagttttccaataatggaatcgatcagtgatagacaaatggtagggagcggacaagatctctccttaggcaggaggtggcagagattaccccggaatcacccttttccagttctgaagtctggtggctgcggtgtgaggtggcgtggcacaccagtggccttgccccgcagctgccaagcggaatcctcttggcttaaaggaaaatcctgtgagcccgcagctgctcaaagtgcagccttgttgctagatgatttattaaatccttgcattctttcaacttctctaatgtttgtttaatttagttggtattatgcagcaaacaaaacaacaaattttatagttttacatttcagatttaagcctgggatccattctgagtgaatttttgtataatctttatgtcaaaccctggtgacacaagtttacctttataacaaacctgaacatgtacccctgaacctaaaaatgaaagtttaaaaattaataaataatacaaatttaaaaactgtatctaccaaaaaaaaaaaaaagctatgagatttaggtgaaggttcatttctttgcctatgcatatccaattgctcttgtactgttttatggaaacaagactatcatccctcctttgaattgcttttgtacctttgtcaaaaatcagctgagcatatttgtgtgggtctatttctgggttctctattcagtttcactgatctctatgcctatccctttacctatacagacagttcctgtccgatggtttgacttaggatttttgcactttacactggtgcaaaagtgatacccattcaatagaaaccatactttgaattttgatcttttcccaggctagcgatatgtgatatgataccctctcatgatgctgagcagcagcagggtgccacagctcccagtcagccatggaatcaagaaaaacaaccatgagacattcaacacattttacaagacggacttgttagatgattttgcccaactgtaggctaatgtgggcattctgagtgtttgaggtaggctaagtatgatgttcaatatgttaggcatattaaatgcattttcagcttaagatattttcaatttaggatgagtttatcaggacataaccccatcataagtcagggagcatctgtactgtggaatatttttaacatacttttgtgccaattaaattaaagtgtctctgtatcaattgtagtgatgtatttcttcatctaaaaatagttttataattcagaaattacacaaagattaatatggaaaaatttccccctgagatggttagtttacacaaattacacttgaacagtattttcgggtttaagttgccccatcatagtcctctgggggaagaacctagaacttctcaaaacaaggctgagctgaattctctctgaacaggaattcagcagctctggttcatgctggcatctagtggtgtgtgcacatacatttagattaggaaatctggtgcatatttttaacaattaagatagattcttaactctccactgagtttgtctcttattgacccagatgacagaaaacagacaacaggggtctcacctgagacttgtttggcagaacaccagttctgtgggatatgatgaggggtgtcaggaacagctacaaagcttgaaggactcgccaagtgaaactaggccgccctcgttaaaaaatggttaagaatttcaagacgaaaacagcagcgcattaagtcaagcactgggtccttctaagagcacagtcttttgggatgatagagttcctgcatgcatgaagccagcttggaagcctgtttcttgctgaaacaatcaatttatagaatttagattttattacctcagtaccctccagggtgtttaataagttattgtaaattttgggtttctgggaagggcatatactgttttccaaaaggatttggttctgcatgtgagttatggcctctttttgggaaatagtgtgttacacttactgcagatatgccacatacctataatcagatgtggtggctgaaaacacaggaagtagattacatttggctgaaaaggtaggaattcactttcaggattcctgaaaaggatcaaaatcaggaatgtgaaattaaatgattattttgatggatgacctacaggcggctttcttcagaaggggtgtagacaggctctgtgacatgttcactgtttgggtcacattcaggaccattttcaagcaaggggagacttgctgtgggaattgccactctaagaatcacaagggggattcaagaaactaagctcggggctccaccaaggtgtccacagagtcacagaggcaatactactactaataatagtaataacaatagccaagcttcaccaagcaccaaccatgggagaagtatgaagattcccatgagcaattacataatcttagtgaaaaccctgtgagaccagctttatgattatctctattttgcaagggaggcattgaggaacagagaggttaaataacttactcaagttcacagaccttaaaagaagagccagccaggggtggtggctcacacctgtaatccctgcactttgggaggccaagacaggcagatcactcgaggttgggagttcgagaccagcctggcccacatggtgagaccccgtcactactaaaaatacaaaaattagccaggcgtggtggtgggcacctgtaatcccagctactcgggaggctgaggcagagaattactggaacctgggaggcagaggttgcagtgagccgagatcctgccactgcactccaacctgggcaaaaagagtgaaacttagtctcaaaaaaacaaaagaaaaaaagaagaagagccagaactggggcactggcagtcaggcccttgaggccaagctctcagatttggcttgcagcaatgttcatctcatagcctcacaggtctcagtctgaccctatgtcctaccctgtattgaccttgaagctgccttcttgctcgccaccaggtgtatgctgacaccaacacctgattaaaatgaagtttctggcagtagcagcagacccaggaccaggagtctggggacacagcatcgagtctgtattctgccatagactgtgtgaccttgaggatgccacttgtcattgagcttaaaatgaaggagatgagataatttttgagacccttttcaaccctaagatctggtatcctaatttaatgatcacactcaataaaatagagcttgtgatattgtccaaagtaaaacaattctagaatataaactccatagatgcaacgatcatgtgttatgttaatcttggtatcttggaggtctagaacagttcctgatatacagtaggctttcaaacaatgattgggttgatgaatgaatgaatgagtggtaagtgaaggagttaaataaatgagaaagtgcaataatccgacataaagcaaatgaacattatacacttttgtaagcctcacaaaccatggcaccaaattgaatcttgcaatcatagcacggccttggccaacctcaaggtccaaggtctcatcaacatttagttgttggacctatcattgctggtaataggcacacagtgtctctgagtaaaagctaccatgttggcccgagaaaaagctttcttttgatgctaacaacataaggaatgaggactgattgagataatttatttttgctctccaaaatgagggtgtcttctggcaccttttgaaaaacagcagacctttcatctctcacgaggcactgtaacatacatgctgagagcttggttcctggagttggattcacagatttcacccctacacactctaggggatgccaagcacactgccaatatcgacatcttagatttataaattttacaattttttttttctggaaggtagccatagagtggcatgttcttaaaaaaccagtatatttcaataatttttcagcagatgaaagtgaggtatcataaagtagaagtacccttttctattgcaccattgtcataggtgcaagcaacatccctgtttaccacccattagctgtgcatatttaggcaaattgctgaacctctctgggtcctagcttactcatttccaaaatgggaatattaatattacctcctgtatcatggagctgttgtgaggattaagggagaaactagacacaaaacagctatgataggtcttgcaaatagtactcaataaattagttaatattagttccacaacatatacacaggcaaaacagaatcagaacttaaatcacttttaaaagatccctgtgcaaaaatgttattccagtgcagatcaggcctggatcccactgttcagttattaatacagtggaactggagtgaagtcagaaagtcaagttaaaggtagaacagatttaagtgaaacatagttctataaaggtaggactagcaacacttcagatgtttgaacagaaagaattcagcactgagtacttaggaagcatgtattcggaacctcagacagaagtggctgagatctgagtcccatgcacacattggagctgcctagccatgctaaagcccaatgcttccttctgtattagtctgcttttacaatgctgataaagacatactcaagactgggaagaaaaagagatttaatttactcacagttccacgtggctggggagccctcacagttatgatggcaggcaaggaggagcaagtcatgtcttacatggatggcagcaggcaaagagagcttgtgcagggaaacacccccttacaaaaccatcagatctcatgagacttattcactatcacaagatcacgagaacagcatggaaaagacctgcccccataattaaattacctcccaccaggtccctcccacaacacatgggaattcaagatgaaatttgggtgtgaatatagccaaaccatatcaccttctggaccccttcccaatgctctgtgcctcagtccaaatcagggaggatcaatgtcctcaacaatttacagtatttacaaaaaagtattttgtgactgtaaagcaacctgggtcttctgaatgagttgtaggaacatgtatctgcacattaatgatgtcagtggccatggtgagatagcatttgggtgatcagcatccatgatgctagccctttgaacatctgactcattgttcaacctagtggcagttctccagagagacacatggaaggagacagtatagaagaagggtaatcacaaatgttaaaggctccaaagtccaaaggctcaggcctgagtcttggctgtgtgtgacactgagcaacacagcctcagggctaccccatatggcaggacctataccacatgaggttgctgagtggatggaatgagttgacatgtggaaactgaacagcacttacagacacggaaagagacagtatagaagaagggtaatcacaaatgttaaagactccgaagtccaaaggcccaggtctgagtcttggctgtgtgtgacatgagtcttggctgtgtgtgacactgagcaacgtagcctcagggctaccccatatgacaggacctataccacatgaggttgctgagtggatggaatgagttgacatgtggaaactgaacagcacttacagacacggaaagagacagtatagaagaagggtaatcacaaatgttaaagactccgaagtccaaaggcccaggtctgagtcttggctgtgtgtgacatgagtcttggctgtgtgtgacactgagcaacgtagcctcagggctaccccatatgacaggacctataccacatgaggttgctgagtggatggaatgagttgacatatgtaaattgaacagcacttacagtgtgtattagctagtcctattattaatacagttatcatcaatgttattagaatggaccacctggagctttgaggacactctcttaatggacttcaggcaagtttggggtctgcactggatgcaggctatgggacctattcagcccttctttcccccaaccccaagcttactcagttggatcttcagtttctactagtctgtggacaagaaatggtaaaccctgaggcaaacacatagaatatgaaggaaaagggagtgtctgtctctgagtgccaagtagaccagatctagaccctagagcccaggttccaagaaggaggaagtgccaggatcatctttcttgagagccgaccaaggaagacatgacccaagaagacagagccttgttgtttatttagccccctgaaattcacccctcaaccccatcctgtagtcttcttgtaagtctttcccttggtctagctccctggaggccgaataagcatagagcgttgaccatgtgtgagttgtcatgtgcctctaacaagcaggattattcattgtgacttagttatccaagatatagatatttaccatcattctcttcagttttgttttggtaccaaagacaatagatgctaaatattccacaatatgagaaggattaacaaggcagatccctcaccataaatttatgaaaccattcacccttcaaattggctacctctctcctacttcttctaagcatccttttgccaaaatcatcaatgaacttctggttccaaacatagatcatttccttctcttgtctaaaagatactcaaactttaggataaaatttaaacccttgacctgccctaccaagccctggatgaaccccagacttatttctctggttccttcttagctcactgggcttctgtgcatgcatcttttcccatctactcgctgaccaatgccctctgctcaggatccttgtgccatgggaccccatgatggaatcatttctgagtttgttggcaactcatctccatttcctcctcatgcttctattcttccactgctctttttcattgcacactgtttattttgctttcagaatatttcttactatttgtaagaaatccacttgtttgtttacttaactaatgtttatcttctcttctagattatagatccagagggtagaggttatgaagacaaccaaacaattacaacttcatccaagggggtatattgaaagaaaccgagcatatttgctgaaagaatgagtttccctaaaaatgtttcttagtacagaaagtaattcatcatatattgttgaatcaaagagtacattataaaatgttaggcactgcacaatcctgtttaagtttatatatgtaaaatatctgtgtatataacttatatatacatttacatgcatatgtgtagagagaagtctggatgttgaggtcaaaatggtcacagtatccatcttagcatggtgacatcagagtgattttattttttaaaatttactagttttttaaatttaaatatttttaaatttaatttttttatatttaaaaggtatctgctaccttttaataataaacatgtactaccaatgtattcaataatttataaaaagaatatgatacaaattaagacccctaattttttttttgtttttttttttttttttggtgagattgggtctcgctctgtcacccaggccggagtgcagtggcacgatctcggctcactgcaacctctgcctcccaggttcaagaagttcttctgcctcagcctcctgaatagctgggagcacaccatcacgctcggcaaatttttgtattttcagtaaagacggggtttcaccatattggccgggctggtcccgaactcctgacctcatgatctgcccgcctcggcctcccaaagtgctgggattacagacgtgagccaccatgcctggccgagttaattttttattaatgtttagactctccaactggaacatgcccccttaatgaaggaaataatacaggatacatctgtgaaccttgtctctcttccccggtacatgtgttcatgtgtatgcatgtgtggatggacatgaaacaaaagcatacaaaatagcagaggagagagtataactgttcttgttataaagtattagatgataagttcccgagatgcagaaatcaccactacagatttcttagttatttcctttgttatgtttgctctcacacctgtggatcatatcgtgttgataaaaatctatattagtgacaggaaggctatgtggatcttctgagtattggctaatttatgtaattcgcttaatcaatttcttttaccagcatgaaatgctaactcattccaaaatagaaatcttaaacaaggttttaattaacatttgtattgctatgggcatgtatctgcataatgtaccctacttggtagatccatttatgctgcagtagagtgtcaataaagacgttgaaatccttctttatttcggtagtattttgtatctcacaaaactgtaacatctcttaattaaagagaatgttcatatggcttcattgtgagttaaagagttgaagctgcagatggattacaggattccattcatggtggtctgtgttcccgtctgtgttcctgctggggaagccaggtttccacagtcctactcctcatgactaggttatttcatgatcaaaataaaatctaggtttatatcatcacttgttatgtccaatatgagttcaacattatttttaaatagtaaattcacattagtaatctatgagttttcatttggtcaatataatttcactggtgaaatttttaaaaaagtaaaggaaaggtaatgtcctcataacaaacactagcagatgtaagatgggtcctattttctctgctttacatcattcctacagttgtagtgattacaagtgacatgaaatgaaatattttaaagttttaattattctaccagatttacagcagctctacatcatatttgtattcctatccactttacaaagttgacaaacaggcatttatgtcaagctttctggctgtgaacttagtattttcaccaataatttagaagaaagtaagtgaagaaaaacacttaaataacctaatcttgtgcaaaatggggatttccttaagacaaggaataaggtgcaataatagaggaaaaactgctgcttttacttttctttccctccttgtctttccagcattaataggggctactttcctttctcaactttgaaatattctaaaacatgttcaagagaggattcataactaaaactggagactcaggatactagattgtggccaatctatcatttttcccactgtttgccattccctgagggtatgaggtgtacacttgtcagggctgttgactttggagtccgacatgtaactggcagccaaggtcgtgatagcagaatgtctggaacagaggttttaaatgtttttgtgtggcttggcttgtctctgacactgctgtgatctgcctgagaagagaaaaccccacatacttactagcataagggagaggagaatcaagtagggccaatctggaccaatctggtacctggaggcaagtccaacctaaaccggttgagcatagccaatatccagccacctggagcacccatgagcaagagagagagatgcttttagattcaggggctatttgttacactgcattattgcagtaatggctgactaatacatattctatttttaaaaactggggcatagcataaaatatttacaaaatgaataagaactgatacaattatctgggcctgatcctcttatctggtagatgagaacactgaggcccatgatgttgtaacttgctccaaagtagagaagggaataggatcaaggtcttctgatgctcagtgactgttcacactgaacaatggcagattacatatgatggtgggatttgtaatgtaccctggatgatgctgtctacctccattccctacatgtgcctcactcactgtccatcccacattcttccttcctgcttcaaagcttctctatcactgacctacgcttgccctacattgtctatgttttctgtttagtccatttgggctgctataacaaaatatggttctggagcctggggaatctaagaataaggccccaggagattctgtgtctggtgagggcatattctgtgcttccaggatggtactttctctctgtatcctcacatggtggaagagacaaggcagccccttcaacatctgttatgagagcactaatcccattcatgagagtggagttctcatgtcttaatcacttcccaaaaggctctacctcttaatattatcacattgggtattaggttccaacatatgaattctggggtgacaccagcattcagatcacagcacctcagaagctttaattgcgtgctggcctctgggctgttaggtgactcagttcactctgggataatgcaacattggttctgttctgttggagactggtgacttaagtgagtcgtctctttaaatcacattctgtttccatgtgtttgttttgttatcccaaatcactttccaaatctcagattggcaggaaatcctaattaaaccctttggggtatctcagctatgaagcctgtagttgatcacgtgttatcattagtcagctaatttcatatgcctcccttgcccatcatcactttcaggtaaataagggagaacataaaatgaaacatctggcacacaaggtcatagataaaatctactaccctcagaatggcctctgaaaatccagttaggatttagaattaaggttggttctttccagatgccagttaactgaacccttgctctgaagaatcctcatctccttcagaaaaccttcactacatagtaactatggaaatttgcaactaagactatataaaacatgcttgatgttttttgaaagagaagcatattcttgttttctctaatgacttggattttacagttcacactgaatgcaaataataagactctattaccttcaatgcaaggatcttcaattagtctaggaaactggtttctgtattagaaaaatatgtgcatatctgttaagatgaacacatggcttaatgagggatcaacttgcctgtatattagagtttcagtaaaatgctcttggttttggaaacaaaggtttaagaggatacgttagctttatattcttacgtgggaacttattacctgacagacatcaagaagtgatgtcaagaatacctaaaagctatttaagtttaaatagtaatttaggtttattaaaaccatattagttatttaggtctaataccactgtttacagtgttcctgaaagattattacatagtccaaataatggatactgatggtcattgcatgctgaaatgacctgctggcttgtctgcttgactttgtcatcaatcaaggcaactgtggactctgctaaggccatgtcatgtaatccaatggaaaggtccagtcctatggccactgggcacaaggaatgtcagcccatcttggatgttgtcagtggaaatctttactgcatacagtgctttgctggtcagaccccactcagtatccttccagtttatcttccgttaagcacccagggccccctctgcaaaaaagtgaaggatcaactgcattaaggaagagcgattcccagtcagtgtttctgtcaatattaaaaccagcaaaaaagcaaatgtgtttagtgtgtggtttacaatggccagaacaggctctggccaagtctcaaagtgaatttcatttaagaatcactctcagcaactcaggtttatggctctcccctcaaaggaaataattctactgactaccattaaataaacatatctgttttcaacttaaagtagagcaaccacatgttccctaagaaatctagaagtcttttattggaaatagtacttaagaatgaaaatataaatccctatgactttcaaagtcctgttggggaaatactaatgacagggccagccccaaatgcagcaaagatgacaaggtacactcacaaatagagacaggattgagtgatgctgaagaccccaatgtctcctctactgatgaggtagcctgtctgccaaggtgccctcccgcttggtcacctccttgtgttcctgtgctgtgcttattctgtcatgctctggcagagatggtgtgggatgcagatgagatcccttccctagcagcacaggggtcactgtagggaacccaccaatgaacatttcttcctcagggtggaggatttactaatcaggctaaggttgggcatgtaggtgaatgaaactcgactccttacagtctcatacccaagcatgggctgcatcatggaaggtggagattgctgcattaccatcacaaaacctaacactgacaatttccttctaaaagtcccatgactcattttggttgtaaaaggtctaggataagtaaagaccacgaacaaactaaaatgtacttattgtatttttcacaaacctctgaaatatttattcttttctgggtaccattactgttcgtgtgctttatggtttgacaacaatgaaccacctctatccaaggctatagtgtgtaagagtaacctatgatcacaaaacattactcaaattaggaaaaaaagtatttcagacattccagacccaatggaaagactgattctaatttacacagcgaaatgctatggcaaactttccttttcttggtttttctaataaaaaaacacattcatcatgcaacataactccttactgtggttatggcaactctgaatacaatacatttgtactttcagcaacaataatcattttgaaagaataagcacatttctgttggtggtgaatgacattaatttttttctcctaaatcagacagcttatctgtggtaggtgttccacaaaatatagcagcataacgaggaggagcgtgatgcttatatcgatcaacttcaaacctacttggaatttttaagttctatttttatgtgattgctctattcttcaagaccaatttactttgctaaagggcatttttgatcaattagatatttatttctacagttgttataatattagcctaataaaattaagcatttcttgtacatgttgaataaaattcaatataaaggctaacttccctcaataggtcaacatggaaatcaactgtgttttatagtctgtttattgtgtgtgatgattttgtgtgtgtcaacttgactggctaagggatgcccagatagctggtgaaacattaattctggatgtgtctgtgaagcgaggatgtttttggaagaaatcagcatttaaatcagtaggctgagtaaacaagatggccctcagcaacgtaggcacacaccatccaatccaatgaaggcccaaatagaacaaaaacatagaggaagggtgagttcattctctcttcttgagctagaacatctgtctcctcctgcaatggacatcgcagctcctggttctctgacatttggactctaggacttacactagtggccccccagttctcaagcactggaacttggactgggaattataccactgggtcccctggttctcaaatcttgagactcaggctgactcgcaccaccagctttcctggttcagcttgtagggaaatgatcatgggactgcttgaccttcctaataaataataatcaatctatttatctataataaatcaataataaatcaataatatttatcataataaatcaatctatttatctatctactttatctaatcttctactggctctctgatttctctggagtactttaatgtatgctgcaaacaaaatctatttcttttgtttttaggagtatattctcacaaaatcaattcaaaaatataattatgagagttttgtctctggatggagggtgaaaaggctaaatcttgttcatatttattttgttttcttgttgctgctataacaaactgccacaaacttagtggtttaaaacaacacacatttatttatatcttatacttttggtggttaggagttgaacttgagtctcactgaactaaatgaaggtgggcaggactgcatttatacagaagcctctgaagagaaaattattattattattccttttccagctttcagaggctgccgaaatttcttggcttgtggcccttttccccatcttcaagttcagcaccatagactctctccggccatcttctgtagtcacgcctccctctgactatgtctgaaaaaggtcttctgcctttaaggatgcatatgattagtttgggcccacctggataatagaggataaactctctacctcaaggtcatttaactgcagctgcacccttacttcccttttcccatggaatgtaacataacacaagttttgggaattaggatgttaggcatctttggtgggggagcatcattctatcacaatatttttatatacatgactatttctcaagtatattcctcacctgtaagagctgtacatcccacaatgtgaaattgtaaatgcatgacactaatccgtatccttgtattctcagaaatgaaagatgaaaagaaaacatccagttattacattcactttttagaaatcaaaataaacttgtacctcccacagatgttgatgtgtgaccaaaaaagtgatttcaggagtcatctatgatgtattgtctaatgctatattctaaacagtaatcaagcagttattttaaaagctagttctgctgcatcatatgacttatgcctgtgttcttctggtggcagtttttgttgaagataaaagcatgaaaacattgagccaaggtaatcagaagagctaacatctatatatcttttttacttctaaacttcttcagtttctttgatgaaacagtcttaaatttcttaataaagattaggcatactgtacctcataggaattttcacaattacattaatatatttgatttaagcctatttttaattaattctatacattataatagttgatggccaaatccacaatacataagccaattaaaatatttcttcaaaggcagaaataaaatttaatatgttacatttgattttttgtgtttcttttaagaaagttctgccttgggatacacaggagaaaaactcaatgaaatgttcagtgacatttctccatacacatcaacataaatgtcaatatgcagtgaaaagtcttagaaagctatacaggaaatggttaacaagttactctggtactcatttaaaaaaaaattttcttcacaccatggcacaatagcacctttataaaccaaaccaaacaacgtaacataaaataatacatctgaagattcctgcttgctttgatactgggaaaaccagcagaacaaatcacttttagtttgctgaagaggccgtcaagtacagatttttaaaatgttctagtcctggctgacacttgaaaatagatcccacatgtttttgatgtaccactgtttgccttcaaattctggccacaatcttattaattcattcacaactacatgaaactcagcactttgctttcagtaatgaaaaaaaatgttatttacccagaaacacaagcttgatggccttggaaaaaaatatttacagggataaagcccttgatttaggattcatggacaatgacttcagaacatttgatgaattgcccatattcacagcctacaacataggttttaattcagaaataaaatttgcttgcaaatgtttgagatttttatctttcataggcatgaagtttatctaagccatcagggctcacagggtctatgttacatatgattgttattgaatatactgagactttatcaaaggtaagttttgttgttgttgctgctttttaatgacagacattactatatctctgaaaagaaatgtataggaagcttcttactaaggaacgcatatgtaaaatttccagtaacgattgaacagtactatttgtttcttttttgcatcttaggatttcaatcttattttataaacgtgtgaatctctgcaggtcacctaccctcctgctcaagatatgttctgttggtgggcattctggccagttggctggaccattccaggatggatgaaaatctgtatgccttgtccttcaagggcaggcctacaaataagcatgcacgtcagtggagttgggggcaggaaggccaaagatttccgagatgctttgcaagtcatctctgggcattcagccccatcatccagaggctctgccccactggaatttggatcgcctgttgatggctgaggttaagttgttcagactccaaagggccacaatgtaagagaaggccagtctccagcatttataaaaaagaacaggaggtattttaatgaaaggagagcacttactattatggcccagctccccatggcactttctactggcttagacatcccttctttttgaatgaaacataaatctttataaaaagattagtggggctgctttaatggttatgaaaggtaacagacttggggtagtaaagaaatttccacatcaaacacatgagataattgagtgtttcttggttttgtatccatgtgatgtattcataagaatcctacacaattaggtgtgtggggctcgtatcatgtcatattaagtctgcaccaggtatatatagctgtcagaataaattccattaaaattgctttctcagttgcatcaaacatccatgtgccaaagcacaacaatgatagtaatttagccgcaactgtttccagaacacatggtggactgcctagaagtgtacaaataaatcaaatcactagggttcgaatttcagggtggctggaggatgtgtgcacgccagaaactatttggattattaacatcaatgcaatacccaagtgttccattattggaacactaaacatgtgggagttatttatatcctactgctcaaggtcatcatcaaagtctgatttttcactgacgcaaaaattcaaaaaaattgcaacctccagcataaatgggtttaaggaggtattcccagttcactgtggatactggttatgacagaagggtccctcaacagtcagcgctactgctgaaagattccaattgattacctccctgggactatgaagtaccgataggcccctcaaccaggagaatttcaaaaataatttttcctacccattatacacaaaatcaagatgattaaatgtggagaaaaatacatccaatgaaaaatacagaacactgtatagatacacagactatatgtactatatatagatacagagcactatataatatctataatagtatatacatactatgtatacactatattacacacacacacacacacacacacacacacaggtatcctggaggtatcctggaaaatactctgtaaatgcatcaatctaacttgtgaaataaaaaactgagtattcaaatctgatttctgaacaattacaccttttacaagctggttcaggaaacgtgtgcatcgggacataaagaggtttatgatatttagtgaagttaagaagttaaagagtgatatcgtatgcaattcttgttttgctcgtaaacatttttcaattgaaagtttagtttcaacagttactctaataacttattagcattatacaaagtataaaatatattacctgccaaatagtatcaagcaaacttctatattctatttcataaagcatacaatacagcactcatgctctagcaagcaggatgctactaggttatgtgatatcaacgtctgtgagagttccctaccaatagaaaaaaagaaactcaaaatgttaggatttagttgctttttttttagtgcatgatgcaaaccattctctaccaaggctcatagagccttggtaatagctgcaaagaagatgtgatctaggatttgtgccaagtgttatattctatacaggaaaatagggaaatctgtaaaattctggcttgggctgaaatcagtagtttatgcttcagttgttgaattagacataattaggtaattccatattaagttcagaatggcatttaaaatgagtttggatatttccagtctttctttgcctgctgctagacagaaacatggctgcctctctggttcctgaattttaaagactttgtgtgtgtgtgtgtgtgtgtgtgtgtgtgtgtgtgtgtgtgtgtgtgtgtgagatatatgtgtatatctacacatacatgcaaacacacataagtaatatcacacacttatgtgaattactgcataaaatcaagcttaatgtataacctttttatctgctttctgactttataggattaatatgtgataagcgtactcccttatctctttcagaatgtattctttcttgagaagataaggatggagagatctactgaaaaagcaatgcacagtcctgtcatattgtcctagcatgacataaaattccatggtatgtcacactaggaaaggtcacactgacaagctgacagctgcaatcctgacagattctgcactatgacaggcaaatgactttatgtcctcaatgcacaaaacgcctgcaacaacaaaatgcatgttttcctttgcatttgcaaaacatcccagaaagcttcaattaccctcaacgattttccagctatccttggggaccactgcccatgtcctgatccaacaccttaggatgacaattccaccatccatctgagcattgcttagtactaatgccaataaatatttgctgctgttgacaagagataaacaaaagtagaacatcaaagtgctacaactcttcttttaagaacagataatattcaattaagaaacatttatattgaaatgcttgaagcactgaggttatataaagtacaaacagtccctgccctcctgtaaaagtattctaactgaaaagctcaggagatgaactaattagtcactaacaagactaaaaggaagtaagagccttggcccttgaatcagcaaaggcatccattgtgtgtaagtacatcgaagcaggggatatgtccttggctgggcctatgcctggcacatgaaactattctactctccaacagggccctaacatgggaacaaggttcacgagtacaccccaaatacctgcctaggtaggataaagaaaaacacatcctaatgagcaaacttacggactgaaacagaaagatatatataagccaattagacagtctgtcaccatggcaaagtctgctcatgatgaatcagggcaattttctcttttttctaatctatatcaaatgtctaaactctcaccatgttcaggggactgttcaggtttcattcccagttatgaaaggcagtataatgaaacaatgaaggtgtcagaaactcagcctagtcacgtgttcgtatgtggctttagccataacatgtgctctgagtttcttttgttcttctgtgaaatgaagattacaatgcccaaattgaaggattgtcaaaaggatgaaatgaaaccatatctgtgaaagttttctgtgaagaccactctgaaacactcaattttcaattacccaattttcccactttaaaaaatgtatgactaaagcagaaaaagcaatataacaatgtaaaggcactatatagaacagaaaggaatccttctagaatgaagaggaaggatgggcaaagagttcacacggggaagtgtttaatagctgcagagtttatacaattcatctttgaaaaaaactaagtgatttccgtacatgcaaatcaccttcccaaatcaagggaaatcaaatgaaaatgtagaagtcgccacaagaaggtctctgcagtatctcaggcagaagcattcttctcaaagtagggtaaatatacagagaggaaacactaccaatggcttaatcacagactttggtgatgactttggtgatgggtacctctcctttcgagtgtgtggcaccataaaatagtaggagaggcagggccagataaattctatctcgacgtccacaagaatgggtgaggcagaggtcctcagaatcacaaactgcgcacaacctgctgaccttggtaggctggagagaagtgaagtggaacaactcacacagaaatgtaacctgatatcagaaggtacttccctgtaaatgggggatgactcctactaatctagttatgctttccccgctccaaataaaccttttgcaagtacctgatctaggaagacttccaccaaaaagcgagacatagatcaagaagctcccagcatgggattgatatcaatgtaatgtaagaccaggttcagagaagcactggaaaaacaagtggaacataatgctccaccagaaaaagtagttattgagccgacgaatcatttgaacgaaatgtatggtcatgaatgaaaagaactgaatgaagcaatcaaatagctcagagcagaggtaaaagatgaagttcagacgagagaaagatggaatataagctatcagaatacttgaaagaaaaaaagggaattaaaaaataaaaaaactgattgccatattgtaatcaacccaaagaaactagacactgtccagaagaggaagaattgcattagaaacataaaccaagccaggcacggtggctcacacctgtaatcccagcactttgggaggatgaggctggtgaatcacttgaggtcaggagttcaagaccagcctggccaacatagcgaaaccccgtctctactgtaaatatacaaacattagctgggcatggtggcatgcacctgtgatcccagctactggggaggctgaggcaggagtatcggttgaatccaggaggtggaggttgcagtgagctgaaatcaccccactgcattccagcttgggcaacaaagtgaggctctctctcaaaaaacaaacaaaacaaaacaaaaaaacgacatggatgatagataaatagattgatggattgatagatgatagatagatgataaatagatagataggaaaaaatattcaagggagagagacagggaagaagacaaggagattcaaaatctgcataactggtgtgctcggggaagagcagcacataaatgagctaaaaagtattaatatacctaatgctaaatgacgagttaatgggtgcagcacaccaacatggcacatgtatacatatgtaacaaacctgcacattgtgcacatgtaccctaaaacttaaagtataataataataaaagaaaagaaaaagaaaaaagtattaaatataatttttttaaataatagagaagtatcattgcaagaaggcttgaatatgcagatgaaaatgatcacaatgccctaagaatagttgatattaaaaatttagcaagaactgtatctaaattagtatttcattaattggacttttgtagataaattataattagaaaaaaaattttttagagttcacttaaaaaaaagtaaattaaaattacaccaatctcagattttctcacagtaacagtctacttatgaaactattgggataacatctatgaaattctcaagaaaacaaaatgttatacccaggcagaataacatttaattatatgattacaggtcacattttcaaatgggaaaataggcaggaattgcaggggctgtaaaatcttcctgacaatcagaaaaaaaattagctaatgagaaaatgaggaaagaccactaatattgaactctagctaacgatatgtatgctaacgtgttcaaaggtaaagtcgattgctatctgaaaattattgtgaagtgcaatacacttcacaataatacaaaaattattgtgaatacacaatacaaaaattattgtgaatacaatggaatgatgagtgtcactaaatggatagctaataggtaaagcaaatattgcatatattgattgtacaatccaggtaatggttaatgggtgctcacaatacaattattttcatatttctatatatttatgacttttcataataaaatgatgaaaaatcacaaaaccatagcaaagtattgtctctccacatttattctatttaactatagtattaggagtaaaatatctgtggaaattactgtacagaaatcaattgtaaatcatggcaatttagaattactgtaacaaaagtccataggacaaagaagatgagagataagggatagagggatgcctatacaggaatcaaatagattctttaatggtgataaatcaattaatcaagatataaatactggaaaaaccaataaaaatataaccaagttaatttggggagtggcatacttagaatactttataatttcatctctggccatagtgggaagttgacactgtatttggaaaaagaagaaggctggctgcgcatggtagctcacacctgtaacctcagcacttcggaaagccaaggcgggaggattgcttgagcctaggagttcgagaccagcctgggcagtatggtgaaactccatctctaccaaaatatacaaagttagtcaggtgtggtggcacatgcctgtggtcccagctactcaggaggctgaagcgggaggattgcttgagcccgggagtttgaggctgtagtgagccacagttgcaccacggcaccccagcctgggggacagagaaagaccctgtctcaaaaaaaataataaaataaaacaaacaaacaaacaaacaaacaaaaaaacctgtattatatcaatttgtaattacagagttagccattataaaaactaaaaacatcccacattttcatattatgaaaagaaatattgcacacacttacacagaaaaagaggggaaaatgcaaaataaagatataaagagaaagaataacgtaaaatatgatatttacaatgtgaatgtgctacatatgcctccctttggaccacaaacttaactatacattgttgtggtaagttttaaagtatttacaaatatcaaatattaataatgtggaaaggcaaatcaggcaaattggaaaggaaagccatggccatgttctgagtagcagacacagttaaaacagggtagaaagcattcctgtgacaaagcatggccctttatgatgagtaagcatatactcagcaataaacatgtaagaggtatgaatatgtgcacacgatgaaaatattacatcaaatttaataaagtgaaacctacaagaattttttaaataggcagaagtatgtcaatagtgagggacttcaattcacatctctcagtccatgactgacccagtatacaacgaaagaaaaataatgaagatttaaacaacatagttatatctatttgtactttacctaattctataacctaaggacagataattgaccttccttcccagcaactgaggaaaaaaatgccaatcttgaagacatgctaggtcacaaagagaagttcattaaatatttccccacaaagttataacttatcaggatttatgaccaagaattcactcttgaattacaaaggaaacaaaaccagagatcgaagaacatttacaaaagttgtatatgaagtagaacctaggtaatatgttaaaagcaatgctcaggagacattttaagtctcgtacacatacatatgtaaataataagaaaggatgaaaataaatgacataagcatccaactgaaagaactagaaaaaagccaataaaatatgcatgaggaaagcaaaaggaacaagttaataaaaacgtaaatacaagaatgaatgcatttgaaaacagaatcatgttagacctattaagtaaatgtaaagttttaagataaaaaattagattgttgattaaacatcaaaagcaaaaataatgaagatttaaacaacatagttagatctatttgtactttacctaattctgtaacctaaggacagataattcatattccttcccggcaatcaaggaaaaaattgccaatcttgaagacatgttaggtcacaaagagaagttcattaaatatttccccacaaagttagaacttatcaggatttatgaccaagaattcactcttgaatcacaaaggaaaccaaaacggtgactggagaacatatacaaaagttatatatgagagtagaacctaggtaaaatgttaaaagcaatgctcaggagacattttaagtcttgtacacatacgtatataaataacaagaaaggatgaaaataaatgacataagcatccaactaaaagaactagaaaaaaaatcaataaaatacgaacaaaaaagcaaaaggaacaagttaataaaatcataaacacaagaatcaatgcattcgaaaacagaatgatgttagagctattaaataaatcaaaagttttgaaataaaaattagattgttgattaaactaagcaagaaaagaagaacaaaacaaaattagaaatgagaacagggaatgaatcagatagtgatgaaattaaatgctagaacataccattcgataagagaaggaaattaaaactgtgcatattaaaaaagaaaggaaattaccattgtttgcacaaaatataactgtataaataaaaagttcatgagaaccaatggaaaaactcttagacatggtaaagataattcagtgaagtgactgagtaaaaagtaaaaagtaaataggttgcctaagtatgtacaaagaagcatgctttcagatccaagatccatgcacaatagaaacaaaaagcataagtataaaaaatgtgtacaaaccatatgaacagcacgttgaaatgcttctttactacacaaaatgaccattgagtaagcggaatgcagactctacttaagatgggaacacaatatcctaaagaaagcaatgcatgaattaatctatatatttcaaacaactctagcaaaatatgaaagatatttttttctccagcaaagtaatccagttttaaagtaaacatgcaaaaacaaccagattttaaagaaaacctgccccccacccaaaaaaaaagaataaataaggtagcaatcggtaggaaaaacagaatcaagtatggataaatggtgttgaggcaactggaacttgtggaaaaaactaaaattgcattcctatcgaattcatcaaataaaaacaagttccacgagatcatgtcctttgctgggacacagatggaactggaagccattatcctcagcaaactaacacaggagcagaaaaccaaacaccgcattttctcacttataagtgggagctgaacaatgagaacacatggacacaaggaggggaacaacacacactggggactgttggtggcattggggaaaggagagcatcaggataaatagctaatgcatgctgggcttaatacctaggtaatgggttgataggtgcagcaaaccaccatggcacatatttacctatgtaacaaacctgcacatcctgcacaggtaccccagaacttaaaatagaatatcattaaatgttttaaaaagttggaagaaaaaaataaaaataaaaaataaaaacaagttccagagatacaaatgacaaacataaaataatgttattattagacaaaaatatgggaaattttgttttctgtagcctaagatagcaaagatctgagtatgatacaaaattatgattccataaacaacttagaaacttaaccacataaaaaataattatttacagcaaaagcaaaaagtaaacaaagtaggaaaatgttttgtaatttagaccacagaaaatagatctttccttaaactgtgagtaaatcctattaattatccattaaagaaaaaaatcaaccacccaaaaacatgatggatgagggacataaatgggtagttaattgaaaaggaaatatgattgctaagaaatgtgtgaaaagatgctggttttcttcaaaagagagatgcaaataaaaaacatgaaatgttattctcaactgtcagaacggcagaaataataatgctgggtgacatgaatcagccaaagagatatggaaatacacattctcatagtactgatggaaatgaaaatggataaaatatatacagagacaaatttggcaacatctatcacacgtttaaagtgtatataacctttgattcagaagactcacttctaggaatttatacaacagatatacggtgcatatgcaagcttattgatttatacgactatcagttacagccctgttcatagttgcaaaagaattgaacacaaaatattcatcaataaaggctagctaagtaaatgaagtatattcataaaataggaacaatgcagctgtttaaaagaaagaaaaaacatgaatgaagtattattcacataggcataatactttaccacttctgcaaataaattatatatttgcatatgcttatacatgcatagagtagctctgaaaggatacccgagaaactggtgtttgcctatgaaatgaggaactgtgtgactataggcagaaactcttaatacaattgcaaaagatgaacattataacaataataataacattttctaaaatcccttttccaggacctggcacacatacatatgattcattacccacagtaggtagccctgccacaaatactgtgaggtagatactttatttccctgggttccagcagtttagagaagttaaatgacctgctccaggtaacccagctctaagaggcagagctggtttcacactcaagcattccagctctggggtctggggggaggcaggtgtgacaggtagaataatgtcccaatccccccacaaatacgtttgcatcccaatccgcagaacctgtgaatgtgtaaggtttcatggcaaaggggagttaaggttgctcctcagctgactttaatgtagggagattagcctggattatccacgtgggtccaaggtaatcatgagttcttaaaagtggaagcaagcatcagagccggcgatgcaatgtgaaaaagacttgaatggccattgctggctttgcagagagaagggactaatggattgtgagtcaagagctgcaagttgtctcaaaaagctgggaaactcaagcagaactgctctagagcccccagaaagggacctagctctgccaacaccttaattttagaccactgagagcatttaacgctctggacttctgacatccacaatagtatgacaataactttgtcttaagccacttaggtgtgtgctaatttgttaaagcagcagcagcaggaaatgaatatggcagaaaagaatagaaaaatgaccacaggaagataaggaggcagtagggagcagatgggatttttaacccacgtctttcctcttggaactccttcctgcaagttcagataagaaaatttcatgcagggaatataggagatcccagccataccacccacaaacaggaacccaagagtacttctattagagcctggtacagaggctctcatgatgtggcaccaagaccagtagcagaagtgtcacctgagaatgggttagcaaatcaaattcttggacccatcttctggcagctggaataaaaatcttagagccatggctaacactctggtttgacaagtcctccaagtaagcctgatgtgatgcatgcctgagaaccgctggcttaatgtagctcttggtttagactgagcaaggcatccaaaatgttactgcacattggaatcacgtggagatctttaaaaaattttcacatctttgttgcacccaagacccatggaattagaatgcttaggcaggggaggtggcaataaagatccccaagtgaaccatatgcatgacagtttgaaagcactggtttagagcaatagttctcaatcttgatacattgaaaccactcagggccaattaaaatgtatagatacctgggttccatccctaggtgatctaattgattggtttacagcctgagtgtcaggaatcttaatccctagatgattctaatgcaaccctaaggtgaaagctagagcagaattcccacttgtagcacctgatcagagttaggtgccacatggtaaatgtgggggccaggagaagagtcatttcccaacccccagtcatttctgaaaagtcaactgatattcaactttgcaaaatagaaatgttaatcttatttttattccatatagttcaaagtattttcaagagttgatttattgtatcactgcaattgttgctactatttcctctttgacatactttctgctataaggagtgctaggttgaaccatctgaaattgcttgattggtccacatttgacatataaaacagcaatttcatattattcagcctaataacgagcattgtaatatacttccttaggatactaaaatgatggcattgagaagctcattattattgcacacctactagataatggcttgcaagcaaggagttatctgggaatttctaaaatgcactttaaaaataaaccccaaatgcctagtttaaatcacatgtggtgagctggacatagctgaacatccaataacaactatgcccagtgccctgatattcttctgtccatctcaatcagcatcagaaatgcaagcctcactgctcataccgagaccacccggtattgcactgaatgtctgctcatttgtccaatcaccccttcttccatcagttcttccagtgtgttctctgaaattcccctccaatatcagcagcataggctctgatcatccccactttccccaggtcttaactgaaacttgggcatcctctgtagacccaatctcaccccatcctttgcaacataggctgctgctcttcctgaccttcatcaggaccagataaagagaaggtccatccttggtccccatgctggctttcaaatcacagattggcaccacccatccatgtgcaggtccagacccctgctccttagaggctggttccagaaggctgcaccatcattaacatctgcttccagcctctttggcatccttcttgttccctgagctccatcatttgtcttctcatccctagacacccatcccgcaactgttggccttacctcatacttcactagaaagcacctctgaaggtgagcacctccttttctgaaattcctctcttttcttggcttctaggacaatccccctctaacctctcacctgataaaatgcccactgctggttctgctttgccatctcatccttcccctccaaacatcaactagagattctccagctgtttcctgaaccatctgcacactctttcctgaggtaaccatatccattttcatgattttaccatccacatatgaatttctcccacatttctatctcccaagtctctcttttgaactctgcagcctgactgcttccttcacacctctacagaggttctctgaatgccttggaggctccgggactgttctgggaacatcaataaaagtaaatcagtaaatcgctgcccacatggaccttcctttcaatgcaggagcagggagcaggtggagcagggagattgacaagaaacaataaacaagataaataaactaggtagcatgttagaaagtgatgagtacaatggggaaaaatagagaacaggctcagaggaaggtagaaactgttcacagtcacttaaatgtaaggttcccaaagctgagcctcagttcatgactccctcactttagaacccccatacacacaaaggcattgcttttcattctatctacaagcactgtccaagcaaaaacaaaacaggagtcattgcgactcttcagttttcctcacttgcaacatcagggtactcctgtccagcccacttttaaaatatatccgacttctacccactttcctccatctttgaaagagccaccctgttcagtcccaagtgcacctggattctctgcatctgttcctgttccgtcactaattcattctccccagaaccatcttttttttttttttttgaagcagagtctcgctctgttgccaggctggagcacggtggtgcaatctcagctcactgcaacctctgcctcccagatccatgcaattctctgtcctcagcctcccgagtagctgggactacaggcacacatcaccatgcccagctaatttttgtatttttagtagagatgaggtttcaccacgttggctaggatggtatcgatctctttatctcatgatccgcctgccttggcctcccgaagtgctgggattacaggtgtgagccaccgcatctggcccagaaccatctttgaaccatgtaaataaaattgttttcgtctgtttaaaatgcttaaaagtggctcgtctttgcactaaaataagatcccaattcccttcatgtacatataagatcttgcaagatctggcatcagtgtgtctcttcaacatcctttctcatcaatctatccttctactacttggcttgggatgtgttgtccttttgctgcacgaaacacatgaaatgcttcttggcctcctttgcacctgcttttctctctccccacaatgctgttattccagttatcatgagcggctctttctcttctttcaggtctgagcttaaacgtctcccaaaagctctgtttgaacatttgatatagaactgcatgtgaaaaggtaccttcaatgatgagtaaactgaggcacccaagtgggttaaatcacctgttcaaatggatccagatcaactacagaagctctgttccattaaaaataatgagacgagccattcatctcatttcctttagagcacgcatgtcccacccgtggcgtgcaggccacccgcggcccaggacggctttgaatgtggcccaacactaatgtgtaaactttcttaaaacatgagacatttttgcaatttattttagttcatcagctatcattagggtattttatgagtggcccaagacaattcttcttccaatgttccccagggaagccaaaagactggacacccctgttctagagaataaaattatattctctctccaaatgccattacagcttactcttgaaatacttgagaaagcaacaatgaccccttgttctgacaacttgtttgattataaacacgtttggtaaaaaaaaaaaaaatattttcagcaaggttgtcaaatctgcagatctgtttgtttttgaaggcatagaaataagagtagcatatccttgctgttttgggtgacggaatcatgcctgcaaaaatctcaaaaagactgtgaaacatgcagatgtggtcacaaggagtgcaataaaaatggaactgttgttcagaaagaaacgccagcatcccacagacatatgtgtggtcccatctgtgattctaaattcattgcttatgaacaactaaggagttgctggagatcagaagccatctctgcttttatcccttcagaagtaaggcggcatgcagctggatacatctacccctcctagaacttgagacaaatgacattcactcctgtctagacccaagacctctcatgccaatatcacttttcattcctgaaactctgatttaaagagacaggctctgaggccatcaacagttcctacctgatggttgattgttgatccacgtagccccagggttacagcactggaagagaccatgtactttagacccaagcttgagagcctgagtcccctccatggcaattctaacaagtgtgtttccatctccctgcttgagtactcacagtgatgggcaactcactgcttatcaaggcagtccatttttaaaaatagtttttaataataatttatttcttaaatggacttgaaactgtttgtttgttttgttttgttttttcagcttccgtttctccctgcactgtccaggtaaggaatgtgatcctatgacaaagaatcccttctgacctctgaagacagctaacacacctcttttcttttttcctccaatttaaatgccttcacttcattgagggtaacatgttataaatttctatgggaccacctcaaagggcttttgcattgctgagagtggacaaggttccaatgatactgtggcttctcccggacaaatacatgcatttgatttttgccagtttccaaaaacacttacaagaactgagttgaacctggctatcacttttcaaatttacattgttttcctaatgcaattacatttttttcttgtttatttcactttgttcatctgttgattatttttaaatgcctatactttcaagaagtttaaaataactagatcttgagaacctagaacataagccaaagatgtatgtctgtagctaaagatattttggccaccagagggctcccagattttgatcattattactctacctgtatttaaacaatcaagacaattaagtggacttatagaaacaacaaatttaaatataagctgtttctgacacaaagataggtcacaaatttttagaaacaattttatttgcctttgcctcttaattccagcacattaacttcttaaacactgtgcatatacacaatgatttaatccccacaatcttcttaaacacacacacgcacacaaagatttaatctacaaaataattagtcttgatctctgtaaacacatttaaatgttttatgacttacttgtctatatctgcagaagttttcaaatgactattttgtgtggaaagaataagtgttctgttttcaggaatatgtagctttctaaaagtacgtatttagaagtatgaatgatggcataaaattgacttgtatataaaattgattaaaaaataacgcttaatgtcaggaagtgtaagagaagaatcaacacttttatacatactttccagaaatgaaacttaataatttgatatgtctttgagggtaatttgttaaaatatggaatattgtaaaatgtacacgaatttatagtaagcagtaacttatctaagaattgattaaaaaatacacaaatattgggattttataagcaattttaaaaatagtaaaagtaaaggaataaggactaaaatgtcatcaattatgtgaggggaaaataaatcgtgggaccccaaaatcactaagcccaagggaaaagtcaagctgggaactatatcaggcaagcttgcctcccattttattccaaaataagatagctacaaagattaaccaaaaaaaaaaaaaaaaaaaaactacatagctccctcacaatttgcccactaggaaattccttgcgggccccaagatctttaccctaaaatagttctgttgcatttcaccctgacgagataaattgatagcttatcttcacaggtgcgggacgaaggacagaactcagtcattcctctgcccatctgagacaaatgcacatctgatttgcttcctctgccctatgtttattttatcttatgtaaaaataaagattcactgaaatttaaaattctctttctctttccccaatatctgccctttctcctttaaatccccaaaccctcaaaatcatctttggaggaaggcacagacctgtgtcctgggtgcacctcctcaatcgattgagacctgtctgagatactttttggtttgtaataagaaactagttaatttcatagcagagacagagagaggaggaagagaaggagcgagaagagaaaggaagagaaatacactatttcagagacttataatatttcagggttactatgaaatgtccatgaactcaagctcaacaatctgaagtcagggagtaaatggaaaaacagcaaatattgcacacaggattggggagggggaggcctcaaaggttttggggtttggagtggggcaagggctgaacaaggaggggtttcctgaaattctgcgtcctcgtgccccgcctgcacattcagctgcacattatgctgcttccagaagcatctcgatagcctaaggggtttattctctggctaaactgaaacagattattgggtatttaagatggaagtgtagatattttctgaaagttagtataaagaaaagaaccaaaagtcgaaaatttctgaactgtcaaaaaggaggagatttgtacaacaaaataataaagatttaaaaaaaaattacctccatccaggaggtctgtttgaacagtagaaattccagcgggagagaaaggtggaaagagtaggaatggtatcatccataaagaaatacagggaaatcaccctacattgaggggcaggagtgtttgcattccaagatgccactcagtgcccagcacactacagccacacacaccttcataaagttacgggacttcaggaataaagagaatggcctcaacactgcccacccaaaaggaagaaagtgaacttacacccgaaggtcagcaatcagaactataacaacccctaccctggcagctaaaagacaatggagaaatcattccctttgcaatttttaaaatttctaagataaaaattacttccaaacttatattctttttgcaaacataagttcttaaaaatgttcttctcatgcatcctttctcagaaatgatggatggtatgtcccgctgaaaggagggagaaaaaaagacatgggaaagcacaggatttaggaaataggaaatccagcataggggagacatgagaagaatacttaaggtggcagccccttcagattggaggctggtagaggggctcctggagctgtctctgctggaaaaacaaaatagaataaattccctgacaaagttgaacatgtggaaaatcattttgtgctttgaagtgtggaaatgttagatgtttaaagcaaaaaggaaaaatgtaatcatagcacacaacttggcttgacacttaatatttacatgattataatagatttaactaaaatgtaagacatactgggaggatgggaatatgggcaaagtgacctaaatttctgaaccatcacaatatgaagtcaataaatacatgaataagattgaaaaaaattaaataccagaaatttagttaaaaaataatgagagtgatttcttcgtgggaggaaaacggggaatgcattctcagttttttgttgttataatttctttataaccatatgacattaaaattatttgcatgtagtgtttgactaaaaaatttaacaatgaggcatatgtagtccatggaaaagtgctgtaataggttcagtggaaaaaacggttttagaataatgtaatcccatatattttcactgcaaaatgaaaggagaaatctattccaacatgtttaaaatgttaatctctggggcatagaattacaggggcctcttttatcttaataatcatttctgtcttctgagtatagcacatcaatttttaacctcaataaaccacaatgacgtaagtcatgttataattaatataaaataatcaaattggtatgttttatttcaagtttggatgcaaaagaaaaaaattgtgtaacttaatacacaaagcttttcagccaatgaggattcagtaactacgactaaaaccaagagtgctgtgagctcattaatgttacgtgtctgccttgcaggaaaaagctatggaaacacaatattaaagaaccttggatcctaaactgtatgccacggaaacgtggcaggcttacaataacgtcctgccaaagccacctgtgccatttggtgcctccctcattggagcaaggtttgcttctgcgaggctgtccaagagtccaagagctttctgccctctcttctccagcgccttcaactgaacagcattttgagcccaacacgaagcttactcttagtcatgcacctgaagtgttttgtttattaggtttttgagacaaagtcttctctgtcacccaggctgaagtgcaaagtggcatgattgttggctcactgcagccttgacctccccagctcaagagatcctcccacctcggcctcccaagaagctggaactacaggtttgcaccaccatgtatggctaatctttgtattttttgtagagagagggtttccccatggtgcctaggctggtcttgaactcctggactaaagggatcctcctgcctggatctcccaaagtgatgggattacaagtgtgagccacctcacctgggcatttattaaaaattactattattatggctaacaaagaacttgcaatattgattcagtagtcttagaatgccacatgtagaagacaaattacaaattatttttgtctagcaattttcttttcattacagacattttcacggttttcctccctagaccctagctgtcatattccattttctctagccatttctttactggtatttttctccctttaatgtgtcagagcggataaaaacataagtggtaaagattcagaaacggtagctttctttctctaaggtttagcataaccaacatgaacttcaagcagttagctgcaaattatctcatcaactcgagcactttacttctaaagttctgaccaatcctgcagaaaaagtcatctgtttgtgtgtcagagaaatatgcttatgtcaactctaagaaaccacattagggaaggaagcagggggaagtgaacttcactaggtagaggcctttggggccactccttccttccacaactatggggctctatgcctccagccaccacagctaggcagtggtagggcaggttctagatcttaggtgcagcaattttaacccagtgcttttaaaacaacatcagtaactgattatgcatgagacagtactagggttacagtctgctccgagggcttggccaagatttaataatgtaatcctccacaacaacctgatcagctggctatgatttttttcttattttattgctggagaaactgaggcaacagagtgtaaaccacctgcccaaggacacgcagctggaaagttctggagccagcactggctcccaagtagcctggtttcacactcctacgcagctattacacaagctctgacttaggagtgatctgctctaccattttatcagtggggacagcaaacaggagcagagattttattttactttacttaatttttatttttattttattatactttaagttctagggtacatgtgcacaatgtgcaggtttgttacatatgtatacatgtgccatgttggtgtgctgcacccgttaactcgtcatttacattaggtatatctcctaatgctattcctccccgttctccccatcccacaacaggccccggtgtgtgatgttccccttcctgtgtgcaagtgttctcattgttcaattcccacctatgagtgagaacatgcggtgtttggttttttgtccaaaacagagatatagaccaatggcacagaaaggagcagagattttctaaacaccatgttacttgcccagtgacagagctgtccagagctcagcctcccaaccctcctctctttgtggcagttttagttcattacatcacttaaatgtcaatggaatgagaatgtgtctgtgcataaatacggtgaatgtggacacttcattcttcagtgcttagactcagaacagatgatgtcacattttaaaatacgtgttctgaagaagatgggtgtacattaccttcatactgaatcaaattttaaattcactaataactattgaaagcaatccagaagcaaacccgtaaaactaaagaaaacttttaggaaataatcatattttaatctatcatatataaattctaattttcctaattgttaaaattttaatggaggtacacatgcatcttgttgtattggatatactgtttcccaaatgggaaaaatcatagtaaaacttcattttgaaataatgttattttggatttgtaatgaccaaaatcattaggagcttagagctttaaggtgatattgcagatagttcaaaattaaatggatggacagtcgatttggtttgtttcacttgtgtgtctgttttggaggagtggtttttttaaatggtttgtgtgtttaaatgtaaagtttttttaaaaagacctcatactcatttctcagagcaattatctgaggtgtgtcacattccatccccttctagaataacaattctcccaatatgcatgtgtgatgcagaaaccaggtgccagttaatgcacatcactgtgtggagagaaacgagaagagaaagggtgtttggccatgctgatggtgcaaacacagctgtgcacttcatatttttgttgctaaggtcatatgggtcagccctctcagtgggctacaaacccatttccctggcaaagcggacggtccatacggggcacggatttatttgaggagaagtatccatgttgttctgggggaataaaggggctgttcaccaaccaggcagagaccttcctaaaaagcagccatggcaactcagtttacctgcaagcaagaattgccagctacggctaggtaacggctcttaactttttaaaaactaaaggagagcagaatgaattagaaaagcagaatgtgctgcaggcacaaagagtggcaccaagagtggcacattcattttggacctagaggtggttaaggttatactgcatgtacaatttgaatagacaaaggcaagtactggaattaattacaaagcttattgggaatccaccagtgacataggcagtaactaaatcaagagggggctgagaagccatctgacaataacggccaacctaatggctgccatgctttccaacatgatagactgcggatgccgaccccttagataatagcctggtgttaacaccagcgcaaatatgaccaaaactgagggctctgaaattgggcagcggtcacctatcaggtagatcatacaggttctatgtgttacagaatgtgcatatacaactattgtcagattttgttatgggctgcatgatgtccctccaaaattcatgttgaagtcccaacccccagtacctcgggataaggtatttggacatagggcctacaaaggggtgattaaggtaaagtgaggtcatcaagatgagccctaatccagtatgactggtgtcattggaagaggtggaagtgagaacacagacacacacggaggacaaccacgttaggacacagagaggaggtgccatctacagtgttggaaggaaccaccctgctgatagcttcgtcttggacttagagcctccaaaactatgagaaaacaaatgactgctgttcaaacccctgctcagtggcatgtttttgtggcagccctagcagatgaatgcagacgatcatcaaaacaaaggcaagggccaggtgtagtggctcatgcctgtattcctagcactttgggaggctgaggcgggcggatcacctgaggtcaggagttcaagaccagcctggccaacatggtgaaaccagttctctactaaaaatacaacaattagctgggtgtggtggcaggcgcctgtaatcccagctacttgggaggctgaggcaggagaatcacttgaacctaggaggtggaggttgtagtgagcagagattgcgccactgcactctagcctgggtgacagagtgagactccgtcttcaaaaatatatataataaatattaaaaaaaaacacaaccaaaaatacaaaggcatattcagtactggaaaattccagaaaatggtccaagcaccccttggcatgttcctttgcagcatataatattccatttaattgttttttctttctttcttttattgtaggcaatacttttctttgtccatccagaatcctaacaagcattgtaaacaaataaacacataaaatagctaaaaatggagcagcagccgcgggagctgccgccctccccttcccccctgagctggaacagcccctggggctcccgcagagcagagtttgaaaaatgccgcttccattctggtgcctcacaaagatctaacatgtcagcgaattacctcaggtttgcacattatcattaatcaggggcatcacaggggatggcagcatcccccagacataataaataatggtgaactcaaggtttctgcaggcgagtgcgtgcgttctgcctgggaagggcagtccgtgtccattagagactgaggggaacgttgttcttgccgtgtcctctgagggttcccacgacgagaactgcgagggagccctgctcattcagagacccagtgcaggcagacccacacctgggcacctaggccagagaccttccatggagctctgcaggctctcagggcttctgaagattggcatctctccaggaaaaaaaaaagcccatcaccccaaacagtcagtaggcttgctgttgcctcacctaccctggatgctgaagttggagagcacttaaggtttccagaagtttctccagccagcaagatgctccaccctcctccttcagactgtcgtgcgcaattaatgacaagctttcatatctttgattgtgaaggtgcattagcacttcagctggctcctctgggtcactcttgggtttattccacgtttaaaccttcaaaatctgcttttatttaggtcttggcattcaggccagtgcccttcagaaggacacgaggatggcccatcttccagggctggactcagcccacctaactggctcagcaagatccctgctggtgtgaaacttgtcacaggatgtggcagggaggcttctcctagaactggactggggcccccttcgtcatgattgtagattagagtcaggggctctttgtgtgaccttcgtcctggcctccttatgatttgaatcacattttcctcagtggcttgatcaatgtgttcattcacgaaagtgctgactttcccatacaaaatggtcagcctggccgggcgcagtggctgcactttgggaggccgaggcaggcagatcacaaggtcaggagttcaagaccagcctgaccaacatggtgagaccccatctctactaaaaatataaaaattagccgggcttggtggcatgcgcctgtaatcccagctactcaggaggctgaggcaggagaatcgcttgaacctgggaggcggaggttgcagtgagcctagatcgtgccgtcgcactccagcctgggcaacagagtaagactctgtcttaaataaataaattaataaataaaatttaaaaaaaaacacatcagcctattccatttgagtagtttcaagtttcttttgtgtgtaagttggtatttcattccatttttgattttgtaggacattcgaactatctgtcaggttatccaatcctattaggcttctttcctccacaagtgtttcatctttgggtgggtgcttcactcccatgctgtactaaccacctcatagagaaagggactataccagaaatgtccttgtatttctataggagggtccccatttgggtgcttcactcccatgctgtactaaccacctcatagagaaaggggctatgccagaaacgtccttgtatttctataggagggtccccatttgaaggcccttagtgaaggtatatcgataattttagggagataatatggcatgagaaagggcagtcaactctgagtttgagctacagctcagccattcatcatggatacgacttggaccatttcttaactttcctgagcctcagtttagaggctaatataacccattgagttgttataaggctttaatttttagataacattaatatgcatatattgcatgcaaaatgcacaggtaagtgtctggcacatagtgatcaatttatcataataatattgatgatgatagtgacaatcacaaacatttaataagaggtatgtttaaaatagagtttgctcacaaccttatcagctaaaatgtttgtggtcttaactaaacaatgagctttcgaatgtgcttaaggtgaggacagaagggactctaggaatttcagaagactataactggggagttttgggggaaagaatttattctttgctgactaaccattggttaggtggtgggcagggcaggtcatagggaaagctttgatgggaagggctcaaaaatcagtcattgtaggctatgttatacagtgttccctgctaaggcctcaataagaagaatgagtggaaagttctctacgtgaacaatccaattaaccatgaactgccaaaaaaaacttgagggaaaattcagagagagtaggaaaaacgtttactttctcaccttagtcctgtgaccataattttgcaagccaagacctgataaaaataatgttcattttaaaatttaaagtacaaataagtatattttattgcatgaaatttggaatatttgggaagagctcaaagaaaacaaaagttatataacttcctaaatagtatttaaggaagactgcagtcagcccacaggcatttaggatctcaatgtggaaaagtataaaatgtgttttaatttaaaaagaaattttcaaaatatacctgttcaaacctcattcatacaatattcacaaataaagaggaatatgaattctttttcactgaatagtctagaaaaataaaaccagctctctatctgccatagaaaatcagaaattgatctaacaaaagataagaaccagaagaaaaggaaaagaaataggaaaaaggagataccatgcttaacacacaaaaaaggagatagttaaaaaatgataatggcaaaaaaaagaaaacggtattttttctgatcgtcttttctatagtagaaatttgcaatttctcagatgctcagtattgaagttccaaaggacgtgtaaatttccactgatggccgtgagtcatctataattatttccaccatatgtacttacatcctttccagagaacctgcccattaaaacagcatatgaaacttagtaagtttcacttttttatgttttggaagaaagtgataaaacccatactacttgaggaactgaattacacacagtgtttattaacactgagaggtctgcttttcatttgagcacaaatttgtaattattttagaatattatcaaaatgatatatttaatctaaaatccaatcatgcattttcatttaaattgttaacattttattcagtattttaaaagataaaataacaacattttctccactgacatttttttctgtctttttaaaaaacttgtcagtaaagtgtaatatacctagagaagagtacatttaactgaatagcccagctgaatcatcaccaactgatcccacccatgcaacccacatttaggtagagaaaaaaaattaccaggacccctgagccccaccccccatgcttctttatagtcattactcttctttcaaagccacccagtatcttgatttctaataggataggttcgttttgcctgttttggaagtttatgtaaatagaaccacacagaatatattctcttgtgtctgtctctcttccttcaacattaccttttcaagatttatccacatggttgtgtgtagttgttggctgttcattctcatttcttagctgtattatattgaatgaacataactccatttagctgtttgggggaatttgcatagttttttgattggagctattatgaaaagtgctgccaagaacactgtatatgcctgtgtgtacctgggaacctgtagtacatgtggacataggtaaatatttttttcttttggggacatagctgggagtggaatggctttgccatagggtaggcacagagccagcttttaaaaagattggtcattttccaaagtgattgcatgaccttaatttctatgcaccaaataaaatagcaaattgtaaaaagttacattgtactaaaattatagccactttttgttacatataatcttcaaaatatatggaacatcctaaaaaatcagttcttggccaatagggaggatttttaatttcaggtgttgaactgagattttgagcaaagaactataaatctaacaatgatcactactgttattactgctactaccacaactacaactaattacaatgactgcaacaaaataacaaatacagtagccctgccttatacacagcttccaagacccccaatggatgcctgaaacttcggatagtactgaatcctttatatgctttgtttttttctatacatccacacctgtgacaaagtttaatttataaaattagacatagtaagatattaacaacaataaataataataaaatagaacaattaaaacaatatactgtattctgagttatgtgaatttggtctctctctctctaaacatcttactgtactgcactcatgtattttcagaccatggttgatcaaggaaaactcaaactgcagaaagtggagctgcagataagggggaagaatgctgtaagaacagaagcccacctatgtgccaggtgctgtgctaagtgcttcattgcaatgaggcatttcaacgtctaagtaatcctataaattctattattgtcctcaattaaatgtgatgaagccagagacatggccatgagtaatttaaccaagatgaaaaagccactcaccactcaggtccattggacatgaaactcagctcttactaccctataaagcccagtgcttccatctgctcagggaagtacacaatcatcatcatcattaacggtgcaggggtaacatctgctcatctatgttttctgatatgcttaattccttagtccccttagaaacatctcacatatgtattagtccattttcatactcctatgaagaaatatccaagattgggtaatttataaaggaaagagttttaattgactcagttccacatggctggggaggcctcacaatcatggcagaaggcaaaggaggagcaaaggcatgtcttacatggcagcaggcaagagaaagtgtgcaggggaacttccctttataaaactatcagatctcattacacttattcactatcacgagaacagcatgggtaaacctgcccccatgattcaattacctcccactgggtccctctcacaacacgaggggattatgggagctcaattcaagatgagatttgggtggggacacagccagaccatatcacatgggattctccacatggactgacatgatttttaaaaatctgtcagcagtaaaaatgaatatcctagcagtgaagaaaaataagttgtaaatattttgaatcttattttcagacatatgtgtgtgtacatgcgtatgcatgtacgcacacacaaactcacacacacagctaatggtcttttgtgccaggtaaatgatagcaacatgtatgagatttgtttaccatgtcatttatttaattaaacaaaactaaatattgtgccacaatattttacccccaaactcagtcagctgtgacagaaactgcctgcacccaacattaagaaacaagaacgccagaaatgaggcagaggaaggtcaaacgccatttctctgggagtccttgttcaaaggctgctccagcctcacagcccagaggcagttccttgtgccctgacttaggctccttttagaaatctataggctcctgttagaaaaggaaatagtctctttctagatgtggctgtatacacaaaagttaaagaatcactaacacatgagataaagcatttcccaaagccttttagggaagagagagtattgctctttccctcctggtattcttccctttaaaaatctgaactcagtgtgaacaaataacaggtcagagactgagacagtcttgttcatagcctcacacacattaagttctatgcataacacattgaagctatatttttgcaaatatcatacttcattttctagaaacttgaaacatagtcaagaggaatttttaatgtttgtagacattacttatctctcacgtacattctgtattgaaacctatcttcatgtgacatatttacatgctacaattttgatgatagaaatttgacgctgttgctactgaaggttgtgaatgtaaggcctcgtgctggactgtcatattaaacagcgatgtgccacatggttttgagtgcagaaagtttaagtgacagtaaagaatgtacattaggaaggccattatcactgacactttgaatttcacataactggaccttaaagatgatactggctcaaggtcaaaaggcactctaaatatcaatatttatatcttttctctgatgcaatcagaaaacattttagtcaacctaccaaaattactgatttgggaaagaattaacaatttattctcatctgggaaaaaaacaactcttttaggccatgcttttgccctctgggcctaggatgccctacaccctgaaatgctgcagctagaaggcccgcaccagatgcggccctttgaccttggacttctcagcctccaaaactgtaagtcaaataaacttgggcatacactttttaaaacccactatttcaaaactattaaattcatttttcccccaacagaagctccctgcagcaaaagtcacttcctgtagaaagaccacaagaacaggccgggtgcggtagctcacgcctgtaatcccagcactttgggaggccgaagcagacagatcacaaggtcaggagatcgagaccatcccggctaacatggtgaaaccccgtctctactaagaatacaaaaaaattagccaggcatggtggcgggtgcctgtagtcccagctactcgggaggctgagggaggagaatggcatgaacccgggaggcaaagcttgcagagaatggcgtgaacccagaaggcagagcttgcagtgagccaagatcatgccactgcactccagcctgggcaacagagacagagcaagactctgtctccaaaaaaaaaaaaaaaaaaaaaagctcacaagagcaaaggaaagccttgctcaggaacaatgaaatggactcaaatacccagcatttttcagtatgagtggaaatgaccaaaaataatccaacaacactacgaaagtgtgattttcttcttctgatttttaaagttcataataaagccagaactatattcaactgtggaaacaacaaatgatgagactaaatcttgccatcctaacccacatgcactgcctagttacttcctgagcagctgcgttttggctctccatccataacaacccggagtggcagacaggacccgtgtcacagttgagtgagggacagagcaatttatgaagctacagcaaatgaaaggcagagctagacccggaacacacgtgcactgcttattgatccaaagtggatcctgtcacccatagaggcgattcgccgttcccagttgagtgtgaaaccagaaatctcagaagtgtctgaagtcactataattaccatggcaacaccactccggggggaagagcaagtgcagcctctcacctccttgtgagattatttctcatttatttgtacatgaaaatggctccatgtcaccttttttgtggccatccttgcatagaaatgaagaccatttccagtctttttattcacataattgcatttcttccctacatttcataattttaaaatatgaccacactgaacagttctaaacgtagctattgtacacttatgtagtgtcagaagcactttttctaacatgtagctttatgcccttatagctgtgggagagtataactacattgaaaacacgtgcctagcacccaaaataataaagctaatgactgtctttgtcatctgtagatatttcacactgttctttgctctctgccccttctagactcaacttttttatttttattttttaatatagagaatttttcagaatttttactcactacaacatgggtatactttgaaaacattttgtgttttaaaaattggactaaaggaaaaactttattggttttgaaaatcaaaaccagagaaatcactacattttcatactctctggagacatttcaaaaagaattagagcaaaaggtaacacacattcccaggaggtggaccctgacagcagagggcaataaatgtttgattctagaatttttgagtctcactgtttattttatatggaagccccctatgttttctcccaaagaatttcagcaagacaatttataactcttagcacactacctccacacttttaaaggtgtaaaatagagaaggtggaatgaggtggcagaatgtcttgcttctatcagatgtgtgcttgaacatgaggtgacaatacactgaatgctatcagggaggctaatgacacacagcccgcctaattgtgaaatttttattaaggtagagttgtggtgctgtggatgtaattattttttaaagtatatttgacttgctttttatatactgatcatctgtgtcagtgaaagatctcacaaaatttgatgacaaattagttgtgactaatattttaaaatgtcccacgcaattcttctgcatctctagaagattagaaacagaagaaatgtcatttaatgggaaaagtaaacatgcaggtgcatctgcagaaaagcacaaactcctcatgatcttgcaggacttacaaattagcaaatatctattttaaaatttccagaagtctttcaccattgtgagattttactttcatttcatgtcgaatctatttgaatagtaaggaggaaaaaacagctacctattatggataagtatggttttaggcatttatgatattactgtgggttatttttaagtgaaatcaacttaaacgggcaatatatttatttaagttggcttggttttagtgtcactggccaaacatttcaacaggaaattaccatgggaattatatctttaatagctatttctcctaacaatattattgtgaggatcaacaagccatgatgtttttgcctgattacacaatgataatttttttctttttattttcctgtataacggaggcatgttataattaaacataagttaaaatttcttaagctgtttgttggaaattatttatatataattcctttaacaactatgaatacccattaataaacctagattactatttgtccatttcaagcatcctatccctggaatagattagtgtgcctagttcttctcattttaacaatagtacccagacgtgcgtgggctccctggtacacacgtgtcttttgtgtgttcctaaagtttgctgtgaatgctttctatgactatggttctttccaatttaaaattttaatagaaagttaaaactctagatgtttaatcacttctttccttaccaaggctgaggaagtatttttaatttttctgagaggtaagcaattttaatcctgacattttggctattggccaataattacgaactgttaattctacggggcaggatgtaggtcctcggcaacaaaagatgttagacaaggttcttgctttcgagaatgtctcaacccacccaaactcatctaatcttcagcaggttccccacctataaacaaagtccacatccaaagactacgatttatgggtctgtccagaggcttcccgaatatttcaccgtctcaaatatattgtccggcagaattgtgaaaggtggaagtgggcagaaattgagtaagtgggcattaaatgccctatccagttcatccatccatcctatctataccttagcttgtctttgacttgactgtttacaactctgcagagatagaggttaactgatagaaaacataaagcaatgaaaacacttcctgtccatagcaaggcaaaggactcctgttctcagtgctgcaaatacattttgccccatagaaaacaaatctctgtggatagaatcttcaatggaaccagttgcaacatcttagcaattccctcattcatgaatgagttaaataaaatatttgactcaatgttcatctgctatttgtatgaaactcatgattttatcacctaaaaaagaaactcttggataatgttcatgggtggttttttttcctctggttcctgccactgcgtcatctcctgaagctgctgttctttctccagcttgcatgaggccaagcataaaatgcaactctctctccctcattccccaaagtgctgctgacataagtctgctgtggttacctgttttatacagggagatgtaggatgaggacaattgccacacagcgcaaagactgaaaaaatcctaaaatcaaatggtagatgctgtcatctataagttcttgtctatccctcctgcagagaatgttttggtgacgccaacagtcccagcctgtagcttcctgctctgtcatggaggtcacctttctttgctcctgctccttcatttccactcatctgcatgtccttgaagcttcctccagcagcttttagagacgcttccagagtctcattatgttattatacagaggaattgaagaactaggttttagttcctccgcctacatcaatttctggcctcactgacaacacaagactcactgaggtcccttgctactaagctccctgctaccccctttgcatccaccctccaaaaataaaacacagtcagccactctacatatttcaatatcacactgactttctttctttttttttttttttttttttgagacggagcctcgctgtcgcccaggctggagtgagtgcagtggcgcgatctcggctcactgcaagctccgcctcccaggttcacgccattctcctgcctcagcctcccgagtagctgggactacaggcgcccgccaccgcgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccacactgactttctaccagacacagaaggaactaatacagaaggctaatcatcagtagtttttgaatccaccaataacaaataaataaataaaatgtatttaagtttaaataattttattttataaattacatacttaaatagaacaatttagatgttacttacatgcatatgttatttctatttgttatttaactttaaaatatcttaaacctgtatacttaaattgtgtgtcaaatgtatattttatattgtatgttattatatatttatatacacacatatatacatacacatacatacacactgacttttcacacatatacacacagtctgaaatttaccttttgactaccaacacaattattacaccattacttttattaaatgtttttaaataggagcctcatttaaatctactgcatattcttttaacttgcttgtgtctaaaagtttttaaggcagcttacaaaactacgtactataaactgagggcagcaaaaataaagcctgagatatagctaatattcaaattacacatcaaaagaccctccctgattcctagaggtcagccatagatggctaacagatcacccaactataaggagagacccctatccactcagttgctagtgaatatacagtaacacagtcaacaaagcacatgaaatgcattcaccaggacttgggataatcacccggcatggtttatcctgggcctttctttccactactctctctatgactttcaactcacagcctttatactggctggtccttcccctcttgactgtcctttttcagatgactccagactgtccatcctagccaccaaccattgtaaactcagatcctggcatggagtatttactcaccaataaatgtcaagtaaaagaggcaggcaggcaggcaggaaggaaggaaagaagaaaaagagaaagaaaagaggaaagggaaggagagaggagaggagaggaggggatggcaggggagggagggggaaggagaaggaaggaatgagaaggccctcagggggtctggggttgtagcataaaagggcccataactgtaaaaaatgatattttacagttcaggttttaaccttgaagtgcacacagaccttaatacagcactgtttaagcattaggactaaagcttgaattttcacggggtaaactgatatttgaagaacctatgcaatatttcctttctagtttctaatgttccttgaatggctcaagcttgaaaccactgggatcaacatctgtcatcaaacagagcttgaaatcagctaccatcggagttgacatttgtaggacacctgccctcaccctggcctccgctgagctcctgcttggctccctagagtacttctgctccttcctgggtgccagtcctgctggcatggggtcatcagtgcctgcctttagcaactctgcttggtctcactttctgcttctaacagtctgggagcaccaggtaagcaggtggtaacaacaacatgcagactcagagaataagaccatgaggaactccacatgtttgaagcagggtctttagcacaaaggtttgatcctttaaatttaacctttcatgggccttttatgtaattcctggttctgacttatctatgggttcatggaataatctcagggtgagaaagcactttctccctctctctataacctgtaactctctctctctctctttctctccctctctctctctctctctgtgtgtgtgcatgtgtgcgtgtgtgcgtgcgtgtgtgtgtgtgtgtgtgtgtgagagagagagagagagagagagagagagagactgcctgctcacacgtagagggtaagcactccaggtagctataaaacatttcaccagtgaagcatactgctattgtctctcaggcaggcttgggtgttgcatgaggtgaggctggagggggctgctggagccacatccttagagaggtagaagtcacaccaagtcatgtgggttcatgctgagagtaatcagagctactcaaccatttccagcagagggatacatgagaagatttgaattttagcaaaatcagcataactgcagggtggggaatccattggaagggctgagggtgaaggcaaggaagcccgtgagaaagttaataatcttagagacggaaccaggggagaggcagtgaagatgggcagcttctagaaacattctagagagaacctatgaagctgcttgagggtgagggctgtttccagggagacatccaggtttttggcatgagttttcatagatggttctgctattcactgagataaggagcacaggagagagaagagagttgtagccagcatagtgaagaggccattgccagttgattagagtcaaatttatgtacattctggttcttgtacactctagatggcacttcgcaaactaaggcacattcaaatccctggggtatcttatgaaaacacaggcactggttcaggagatccagagaggggttgatgtttctgtctttctaacagttgatgctcatcttgctggtcagggaccacattttgaattaaggctccacattaatcaaaacttttcctgttatgcacccattctcaatgaacttaccaactctatgagtgtgtcgccctctctgtactccgcacctggaacagtggctggctggagacggacacctttgttgagccccagcagcaaagcccttcctctctgagtttctgcttccgcagcaagggctgctctgctaaagtgatgccagagagcttggaagtctctgtggagatcacggcttctctccatatcggggatccaggaaaagagacgtttggtctctggaaacttctatttgaaggctcagtcatgtctgaggttgtctttctgcatcagattgcctgatagtttcaatgagaaactgctgaactctgaagtttgactctgctgcatttcagggggagaggtaagctttttattcttttctgtctccgtgggcacagagtgacacatgcacagtcaagaagaggagaaaggcatccacccaaaggaaaaaaggtaaaaatcaaatcatctcactaaagacgccactgtgacaagggttcccttgggaattacagccagaatacctctcacctgggagggatattatagctcgaacagtgaaaagaaaaagctttatttcactattgtcttttccaattattgtgccccttgaaagattaagcaaatggtttatttttccttggcttcatttccagaatcacctttactggacacaatttaaattctagttatttccccaccaaaagccaacaaaaatgagttcaagagagttcacagcgatttcaaagagaattcacagagattctgcagccacgtggaaagaatattataggagattctaccatactatgcaatcctcatgtataataggatagtcagaggtcatgggcactattctctaggtctatgcttctaaaaaaccacaacacaaaagtaatgctataaaatttgcataaagaaaagaaaattttgtgatggttaatttgatgtcaaatcagctaggccacagggggcccaggcatttagtcaagcattattctgggtgtttctgtgagggtgtgtttggatgagattgatattttagtcagtggactctgagcaaagcagactgccctccctaatgcgggtgacctcatccaatcagttaaaggcctaaatggaacaggaaactgagctccctcaagcaaaataattcttctgctgatggccttcaaactggaacatcagttccttcctgggtcccctgctgactttgaacttaaactgcaacatttgctcttctcaaggtctccaacctcttggcccaccctgcagattctggatttatcagcctccgtaatcacgttggccaattccttaaaataaatatcttctatatataaataagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctactcgggaggctgaggcaggagaatggcgtgaacccgggaggcggagcttgcagtgagccgagatcccgccactgcactccagcctgggcgacagggcgagactccgtctcaaaaaaaaaaaaaaaaaaaaaaaaaaataagtaccattggttctgtttctccagagaaccctaagacatcttccatcccctaaattttggaaatggaaataaaaatcaaagatatattattcagttaggatacaacgtaagattttgtaggtgtgttagtctgctcttatgctgctaataaagacatatcagagactgggtaatttataaaggcaagaggtttaactgactcactgttccacatggctagggaggccacacaatcatggcagaaggtggatgagaagcagaatcatgtcctacatggcagcaggcaagagagtgcgtgtgcaggggaactcccctttataaaaccatcagatttcctgagacttattcattatcatgagaacagcccaggaaagacccacccccatgattcaattacctcctgccgggcccctcccatgacacgtgggaattatgggagataaaatgcaaaatgagatttgggtggggacagaaccaaaccatatcagtaggtctatgtgatttgctaaggacagtgttatacacaataaatacagtatttttttaaaaaaatggaatctataattggattctagacattttaatttcttttacttactatgtaggttcacacagtatattttcattacatggatgttgaaatattactttcccactgtgtggctgatggatcacataccatcctcctctccatgcaggaatcaggtaagggtatgtgagaggaaggaggttagggttgggaagtctttgtttaacttccacctcattcttgagaaaagatttgagagaggtctggctggagtacccccaccctgacgtcacaaagaggttgtctagagccatttggcagtgcaggcaggagcttctggcacttggtaggatgaggaccaattgttaatgtgctttctttgcttagtttttatccccacattctctcccactgtcctgcaaggtttctgtctcatggacatgaaaatgtgtcagtataaacaccagcattctctattcacacaaggattccttgtcactggggatttttgctgacttctattagtgtaaaaatcattcttcaactttctctaaaattgccaaactttggcaaaataattaattaaaacagatttaaggtcactttttaaactacagatgacatggatgagctccattattcttttacgtgacttgggcacatgaggaattcaaacataaaacttcaccagcttataaaatctgtgagtctctgcccccgtgttttaagatgtttgtaaaatttcaaagtattttgtcttacgatatcataaaagaaagtgcaattttagagtctaaaattaatttaattacgaacacttcaaatgtgttctcttattcttttttaaaaataaatgctttctagtgaaaaatctatttttctctttgacaggtaataaggcaaaattctgggaggttattggtaattgctctctttttttatctcatatctcctgttcacattgtcaacaaatcctacttattctacctgcaaaatatgaccagagagtgattgcttctgcctaacctttttgccacgattctcttattgtcaagcattgctgggactctggcaattttcccttgcaggcctgcctctttctagtgttgcacgccacccccaccctccagtcacctctgtcttttctcagttcagcaactgctgcagttgctaaaacagaaattagattctctgttcaaatccatgcaaaagtaccctgtaccattcaagggtattccaagggctgcaataccccaggtaacctgtctcccatttcctctctgtcctacctaccctccttctataaacacccccacacccaattcattcaacccaggcacactggcctttgtgctgtttctgcaacatgctagtcacactcctgccctaagacctttgcctagcttctctctctgcctgaaaagctcttcctctaaatacatttcaccagcaacttcccttcctttaagcatttcctcggatgccactttctcagcaagccctgtttgaagcattttgcccccactgactattgccaacccctatgccatcactcccaaccccccttcccgggggtctcatttctttcacacatgctacacataacatttgatcatactatgtaatttacatatttattaggtttgatgtagtacccttcttcccacaacagaaatcccataaaggaaaacttttgtctgttatgttcactcaaatatctaagacacctagaataatgaccagagtataataagtaaccaataaatatctttcaaataaatcaagtgatttttccattgctttagaaaaaaaaaatcctattctagtgcttcagagcctttgataaattctactttataatgcatgtgttattaggtatagattatagataatgaggataagttccacttaaattaagaaattggcttgctttctatttgaatataggtcattggtagccagttatataaaaataagaaaaaagaactaattgagaacaggctgacttcccaccacactcccagagcagattccaagaccaaagaaataaaataaaactctaaaggaactagaaatttatgatctttctcacaaataattcaaaaaatttttaagaaacctcagaactcttcaaaaaatacagagaaacaattcactgagatcaggaaacaataaatgatcaatattagaaatttagcagtgagattgacatttttttttaaaagcaaattctggagctagaaaatacaatcgaggagcagaaaaatgcaataaaggtcatcaacagtagacctgataaggcagaagaaagaatctgtgaacttaaagaagaaattatataattagaacagaaaaaaagaaagaatgagaaaatttgaagaaagtatacatggaattatatgaccaattcaagaaagcaaatctttgcattacaggagtttgaggcaaagaagaggaagactaagaggtagaacacttacttaaaaaactaatagtataaaactttccaaatctagggaaaggtataaatatacaggtacagaaaagtcaaaattttcaatcagattcaatgcaagcaagactacaccaagacatgctataatcaaactatcaaaaatcaaagacaaagagaggagcctgaaaacagcaagagaaaataagtgaatcaaaaataaaggggttccaataaagctagcagcagattcctcagaagaaaccttacaaaccaggaggaggtgggatgatacatgcagaatgctgaaagaaaaaactgccaattcaacaaacctgtccttcagaaaaggacataactttaattgtatacaaaatctctatacttttactcttgccaacacttatatttttaatgtcaaaattttacatttttaaatattagcttattattaggagaaataaaggaagaataaaaattgtcccaggaaaacataaagctgaagtagttcatcaccagcagaccccttttacaagaaacactaaagggagctctacaggctgaaagaacattaataaacaacacgaaaatatatgaaagttaaaactcagtctaagtaagtaaatggtcaaattaagtatactctaatactgtaatggtagtatgtaaattgcttatatctttagtatgaaggttcaaagacaaaaccattaaaaataatattagctacaacaatttgttaagaaatatgcaatattaaaagatccaaattgtgacatcaaaaatagaaaactggctgggcatggtggctcacacctgtaatcccagcactttaggaggccgaggcaggtggatcccctgaggtcaggagttcgagaccagcctggctaacatggtgaaaccctgtttctactaaaaatacaaaaaattagctgggcatggtggcacgtgcctgtaatcccagctactcgggaagctgaggcaggagaatcacttgaacccgagaggcaaaggttgcagtgagtcaagatcgtgccattgcactccagcttgggcaacaagagcaaaactccatctcaaaaaaaaaaaaaaaaatatatacatatatatacatatatatataaactgttgggcgaagtgaaagtgtagcctttgtatgcaattaaagttatgtcattagtagcttaaaatagcctgttataaatataagccacctatgtaatcctcatggtaatcataaagcaaaaacctatagtagacacacaaagataaaaagtaaaggatcaaagcacaccactaaacaaaatcacctaatcacaaaggaagacagcaagagaggaagaaagaaacaaaggatctacaaaacaaccagaaagccagtaacaaagtgacactaataagtccttacctatttacaattaccttgaatgtaaatggattaaattttacaacaaaaagacaaagagtggataagtggatttaaaaagaacacaacatgacccaactatgtgctgcttgtaagacagtcacttcagatttaaggacatgcatagactgaaaggccataagtcttaacaaatctagggagattgaaatcacatcaggtatcttttccaaccacaatggtatgaaactagaaatcaataacaggagaaattttggaagattcacacatacatggaaattaaacatgttcctgaatgatcaatgggtcaaagaagaaattaataggtcattttttacgtctaaattttaagtactaaaatatcattgagactaatgaaaacagagacagtgtgccaaaacttataggatgtagcaaaagtagttctaataaagaagtttttaacaaaaaaacttttaaattaaaaaaaaaagatgatttcaaataacctaaagttacacttcaaggaacaagaaaaaggagaacaaactaagcccataattggtagaagggaggaaataataaaggtcagtacaaacacaaataaaatagaactagaaaaacaatagaaaagatcaacaaaactaaagttgggtttttttttttcaaaaatagaaccaacaaatcgttagctagactaagaaaaaaagaagacaaaatcagaaataaaaggagaaacattacacctgatacaacagaaatacgaaggattataaaaagctaatatgaacagttatacaccaacaaactggataacataaaaaaacagataaatatctagacacatacaacttaccaagactgaatcatgaatataacaatctgaatagatcagagatgagtaacaagattgagtcaatagtaaaaagactctaatcaaggaaaaatccaggacctgatggcttcattgataaattctatgaaatattgaagaactaatcctaatcttccccaaattattttaaaaagtctaagaggtgaagcttgcaactcatttaacaaggtcagcattaccctgataccaaagccagacaagaacactctaagaaaattgcaggcccgtatcctagcaaaccaaattcaacagcgcactacaaaggctattcaccttgatcagtacgattggtccctagaatggaagaatggttcaatacatgcaaatcaatacatgggatgcaccacattaccacaatgaaggggaaaaccacgtgcatctcaatagatgcagaaaaggcttttgagaaaattcaaaattatttcatgataaaattctcaacaaattaggtatagaaagaatgttgctcaatacaataaagggcatatgtgacaaacccaaagctaacattgtacacaatgatgaaaaattgaaagttttcctctaatatcaggaagaaaataactatgcccactcttgtcctttctgttctacttctctggaagtcctaactggagaaattaggaaaaagaaaggaattaaaaacatccaaattggaaaaaaaagaagttaaattgtcactgtttgcaggctacatatcttttatgtagaaaattctaaatactccaccataaaactattagaactaatagataaatacaaaaaaattacagaatacaaaatcaacacataaaaagtagtagaatatttatactctaacaatgaactatccaaaaaagttatcaagaaaatagtctcattttttacagctgccaaaaaatagtaaaatatctaggaataagtttaaccaaggaagtgaaaaatctgtacactaaaaactacgacattgttaaaagaaatttaagaaaatacaaattgaaaaatattctatgtttatggattggaataattaatgttgttaagatgtccatattacccaaagtgatctacaaattcaatgcactccctatcaaaatggcatttttcaaagaaatagaaaaaaattagcataaaatgtatatgaaaccccataagacccccaaatagccaaagcaatcttgagcaaaagaacaagttggaagcatcacactacttgcctccaaaatatatacaaagctacagtaaccaaaacagatggtactggcatagaaacagacacacagaccagttgcacagaatacagaataaagagcccagaaacaaatccacacatttacagtcaatagattttcaacaaaggtgccaggaacacacattgaggaaagaacaatcttaaataaatggttctgggaaaacaatatccacatgcagaagaatgaaattagacccttatctcacaccatatacaaaaatcaactcaaaatggattaaacacttaaacataagacttgaagtaaatacaggggaaaggctccataatattgatcttggcaatgaatttagtatgtgaccctaaaagcacaggcaacaaacgtagacaactaggattatatcaacttaaaaagcttctgcacagcaatgaagacaatcagcaaagagaacctatggaataagagaatatattttcaagccatatgtctgataagggattaatatctaaaagatataaggaatgcaaacagctcaatagcaaagaaacaaatagcctaattaaaaaatggccaaagaacctgaatagacatttctcaaaataggacattcaaaaggccaatcgatacatgaaaaaatgctcaacatcattaatcatcagcaaaatggaaattaaaaccacaatgagatgtcacctcacacttatcagatggctgttatcaaaaagacaaaagataataagtattggtgaggatgtgtatcaaagagaaccctagtactctattggtggaaatttacactggtacagccatttttggaaacagtatagaggttcttcaaaaaatcaaaaatagaactaccatattatccagtaattccactgttggatctatatccaaaggctgtgaattaaatcagcgtatcgaagagatatctccacctccatgttcattgcagcattattcacaatagacaaaaattagaatcaacctaagtgtcaacagaagaataaagaaaatttacacaagtaaataatattcagctttataaaaaaggaaattctgtcatttgaaacatggctaagcttgaaggacattatgttaagtaaaataagccagacacaaatgacaaacactgcttgatctcatatgtgaaatctaaaagaattaaattcatagaagtagtgagtagaatggtggtttccaggggtgggggcaggggtggggagttggggagatgttggtcaaagacgacaaaatttcagtcagacagaaagaataagttcaagaaatctatcctacaacacggtgactgcaattaataacaacatattgttttcctgaaaagcccttagagtaaatttgaagtgttctgagcataaaaataagtatattcagtaatgcataggttaattagctcaatttagccattccccaatgtatacatataagaaaacatcctgttgtacacaataaatatatatacatttatttgtcaatatacaaataaattgtttaaaaaataaagttaattgggattgcttttcataaagatcagcttgcatacatttgcctttgcagagttttgcatcactaaatggaagctgatttctaacttgtatttccagctatgagaactgctatgttggaattggtcaaaataacgtggattttgaaaccactaaaattatgaaatatgaagtactggatttcgagtataatccaacagactcatcaaagtctagcacatggtaggttgcatagtaaagtgttaagagtatggattttggcattagatctgggtttcaaaatctgcacatgtcataacctttctgtgtctcggttttcctcatttataaaacgggaataataactctgtgtcattgggctgcttaaatgtttggcacagtgcctccttcacaatgagagttcaggacatatctcattttgttgccaggaggaattactattgtcaattgtatatgaaggcaacaatgacccaccattacgagctgagtaaccttaaagagctcactgtatttcagtgagcctcagtttgattatctaaaaatgggaatacgccacacctgctctgcaagactgctgtgaggactaaacaaagcaatgcgtataaaaaaccacacagtggctggcccatgggcttccctttctgctgtagatgggtgttttagagacaacttccctaggattggaagaaaggtggtagaaactgacttctgtataaaccagcaagattataaaaacagctgcctggcattgttcaggatttataagcacatgtatttcacatatacctatgtaaacatgaatatatatacagtatgtgtatatatatataatatgtatatatgcactatgtatatatatatatatagtgtgtgtgtatatatatacccatatatatatatatatatatatatatatagatatatatatatgggtgtatatatatatgggtgtgtgtatatatatatatatatatatgggtgtatatatatatatgggtgtgtatatatatatatatatatatatatatatatatatatacccatcactgacagatatatgagagaaaaaatatggtacatattataagagagtaataaaacattcttacaattctcaaatagaattttagaatccacagaatttctcaatgctaagaagggagattaatttaaacacaagagaatttctcattatagcaatgtaatacgcagctcattctttatcatgtaagagagctggagctataaataatgccttgtagtatgagtaataattcctgaaaaaaattaactggaatgaagcaggtttttaatacagtattcaatgaaatcatctaaatttacctaagctagaaacagactactttgaaataagtgtatgaatacttgcagactataaaagattgaaaagattactactattttatctgtttatgtggtcatataccacaatagagtaaaacaccatatgtcaaatatctagacagctattgaggaatctagctcaacaatacaagtgatcctagccacaagattaaacagttctgacacaaatagtccatctcttcacaggtttctctcttgctctttgaatacctcaatcagacattcagattaaagcaaacaaaaaaaccaaaactctactacatataggatgatagcagccagaaccttccaatctgtgccagcctctagatgaaagatctctgttcttatttaagaaggcactcaccagcaacgcatgtgtctcatttactatgtgggacaaactatgatccaacgtgcccattaagtttctggggaaagtttaagaaataattagggaatttaactttacttttctcttgctcttttccaaaccatatctaagacagttgggttaaagaagcagaaatgcaattaaatttagcaaatattttttgaaaacttctcagatgcatagaaggaagtcatccaagtgtctgtgctggaggtgaagatctgagcacccttctttttttctttttctttttcttttggagacagtgtctcactctgtcacccaggatggagtgtagtgatgcgatctcggctcactgcaatctttgcctcctgggttcaagtgattctcttgcctcagcctcctgagtagctgggactacagacacccaccaccacacctggctaatttttgtatttttagtagagacagggtttcaccatgttggctaggatggtctcgatctcctgacctcacgatccacctgcctcggtctcccaaagtgctgagattacaggcgtcaggcgtgagccactgcgcccggctgagtacccttctttaggaagaaaacttcagcagtactgggagggaggaggagaaaagggagattgcaggaaaaaagtctcaggacaacacatgatttgcttctttttgcctttttcctaaatatttatgaaatagtttctaaatattttgttttttaagttttctgaagaaagccctttaaatacatatatttcataaatacaggatttatgtcttgttttatgagtaacatagacattctagtaataaactgcttatttctgtagtctatgtctttatgtctttcaactgattaagactcctgcttctattaatttttccagaaaccttccaggaataaatatctgttttaaaagagagattaagtgaccagcaagacctcactattgaatgtcaacttaactattttctttccaaatcttacttttctttttctaattcacagcttcatggatgcagacggtactcttgaccttggagatctacatcatattcttcagcatattaaagctccagaagggaagagatggcaccttcaagctcaatcattaataaaggggcaatttacaaagccagtgcagtacccaggggctaagagcagctcaaaactgtcatcttccctaggcatggagggttagtgggcaggagtggtttcagagcaacctgaatgggaaggagcaggtgaaacaaaatcaactctctaacgatactgctcttctgccctatagtctcctgctgatgcctcccattgtggaacctggtaggaagcccatgacctgggagcccattgaggcagccagcctcctggggctcagagcagggtgaagacagggaaagagtgggcttggagaggcaatatggtaggtatgcagcacgaggcttctctttttaaagagagcaagctcaaagagaatttcattgcagagatactccaaacaatatctattactgcaaatattacttcatacagcctaaaggtagaattagtagtctcttctcagcagggttaccatatttagctaatacaggacaccatttcaatctaaatgttagttacataatgcataatttttaggataagtatgctccacacaatatttggaatatactcacactaaatattatgttttgtttatcaggaattcaaattgaactgggcatcctctattttatgtgacaacctcacctctttgtatattaaaatatatattcttcaaatacatatttgaagtattgttattacttctgtcccaaacactagaggaaatgatgcgtttctacccaggtgtgttatatttagtattattcctgtgagctttatatttgtgctccccttttcaatctgtgtcttgagtcctccatttttaaaaattatgctccctacttttattcattgtgatatataaagactgtctccacagagaatgtactgatttcactgaggtcatccatgagctgcctcttttctcatgagaataaatttttaaaggcattaagcttcgtattcttttattttttgttttgagatggagttttgctcttgttgcccaggctgaagtgcaatggcacgatctctgctcacagcaacctccgcctcccgggttcaagcgattctcctgtctcagcctccagagtagctgagattacaggcatgcaccaccatgcccagctaatttttgtatttttagtagagacagggtttcaccatgttggtcaggctggtccggaactcccgacctcaggtgatccacccccaccttggcctcccaaagtgctgggattataggcgtgagccacagcgccggctaatggattattaatgttctttccggctgcagtgattttctaattttgcttttgaattgtatatatcttgaagaacttagaaggtttctcattctttcatatatctaaaccagggactcttaatctggggcctgcataccctctatgcataaaattcaggaagctccctgaagctgggtataggaaaacatttgttctatttttcactaacctctaactgaaatttatcatgttttaaaattattaatataggcaacaaaccacagtagtattagtactgtgacttcatcatcaataaaaattactaatattttcaaaatcacatttcagatatagctctctatacatttttattgacactaataacttcttaaaatttgctatggacacaaatctagtgtgtcatttaataaattaatcaagaagaacatatcatacatcatggattttatctaatttgataactgtattagtttactattgctgctgtaacaaatcgccacaaacttgatgacataaaagaataccaaggtattatctatagttctgtaggccataaatccaaaatgggtcaagctgggctaaaagcaaggggttggcaggccgtcttctttctacaggctcaaggggagaatctattttcttattttttccaatgtctagaggctgcccaaacccctcggttcatggtctccttccatcttcaaagccagcaatggcccatcgagtttcccattgcatcactctgacacgggttctcccgtctcttccttctacttttaaggactcttgtcatgacattggactcacccagataatccacaataattttcttatgtcaaggacagctgagtagcaaacttaattctatctccacctttaatttccccttgccataggacataacatattcacaggtctggcaactaagccacaggcatttttggggagtcataattctgcctaacatatatattagtaataatttgctaaatgatttcctttataatattatgtataattttttttatttaacaaaactatcctgaggagagttccatgggctccatgagtttgccagagagctctacggcacacagcaggttaagaacgtctcatttgcgacagtgatgctgacaattagaaccatagcattcctttaaggaaatatctgctacaaagtcacttgcatatgttctctttacttcctacttcccaacgttacgcattaagaatatctattatgctacttttacagaagaagaaaccagggtttggagagtgatctgccaaaggccacactgctgatgggttgcagggctaaattcaaagagcgctccaccgaccttggagctgaggctcccatgcttcaagtcttcttcgagcattgccctgtattcactcaccgcctgatatgcttcgaccaagaggatattagtaccagatgagtatcagcctacactgtttattccccctcttatggatgcatctgaccagactagaaatgttatctttgaaaaacaaactctagctacctctgtccccagctttcctgcattatcagagaaaactttattaacatgcacttataacaagactagcacatgtttctcccaccaactgttgtagctagaatgagcaagtgagcaggtggcagtgctatcaaggagctgtcagatgccaacttcacgctgcacatccgctgattttcagtgggttaccttacctcaggtagctacaagaactctcaaacaaaaatacactgaagatctggaacacaaatctttaagtcattaacattcgtctctttaatttcagggcttacccagggtcctattttctctggatttctcaagccacaaagattaagatctagctctgattttcatgtatttgtttgatttggttttggttttagttttggctggatagtatcttcactgtgcaacttggaaccgtatttgacctggtaattcaggtctgaattggcactgatttacagccactgtgaattgatggtcatgggttatcattgtagttggtcatttctgctagttcactgactagtggaacctctcttccaggctttcatcagaaagatgctattggatatttcaaaagagcaccagagctccccaacagtggctcataaacgtttctggtagaacaaatccatgggacacaatatctcaccgtgactcactgttctatctggccagctctagaaatgaacagtctgaggcttagaacattgaaggaaaggaaagagaagagaagaggaaagaagaggggaggagaaaagaagagaaaagaggaagaaaagagtggggcgaggagagaggaggaagaggatttgtttatcactcaataacaccaagtctgtaccagggatgttggccgactcctcagccaggagggcatcaagaatcaggtcccagcaatggtgatggccacggggcacacagctgtccctgccttccctgttctccatgccttctctaagtctgagtacttcctcctgcctcagccctccctcgggagaacagtccacctgtcactgagaacagaattctcgatgtggaatactgtggttagcgggcattacattaaaatatacaggatacaacaagctttaacctgtcagcatggcatgacactcgttttagaaagcaaaataaaaaaagaagaacaacagaaaaactacataggcgatgcgaaaggctcaaataatgcgtgacacaagatgttaacagctgtttaagacccgagctgtgcaacttctggggccgctatccatcctgtgttccaatggaacctggactcccccttgaatggttcaatacagaggacctgattatggatctctgggggtgaaactgcaagtgcattttatttattttctcagtaactatttgcagttttaagactatccagtggaaacatgcattactttattatcagaaaaaaatctttttatttgtatttattcccttatttgtatagtatacagataagatatagtaagagttgactgtcataccagctctcatgtctgcctctgaggctggaaatcaagggctgtttatatggttctctggtgctatgttactcagaagattcaaaggaagactgaggccaccaccaggtggaaggtaagagcctatcaatgacttggttttgtggtactgtgtcccacctcctggttgcccatttttcacaggtaattggaaataatgggaaagccttaagacaactttgagaatgagttagaaaaatcagtggaagtggatttagcctatcatcactcacacagtacagagactcaaaccgtgacaggcagctgggttcaaaaactgccagagattcagcacagtttgaaaatgacaatttttttgttgttgcagttttacaaaggaaaacaggatagagttatttccatgtagttgagtattgttacatgctaaaagatttcttccagttatttttagccagtttatttgctgtttgataagaataggaaagtttagtgaaagtcttatgattcacagcattctgagaaaaaaaaaaagtctggtaaattctaagaagaagtctactagtcagagctttctcagtccctttacaacagctggtggcttgcttaaactgtcttatggaatttcagacatatctctaaaaggtaaatactataatgaatgtcctacacttgataaacatttggagtgccttaattttcccacctgtttacagggactcttactaagagaacaggctgttgctaaggtacagggtggctgtcagaaacttctagcttcaaatatgccaattaaattactctttggggaagctcggctcatcacgtaaaatcactcgaggagttactctatgattgtgatatgcagtgcttctcatttaaaatcccactacactccccatatccagtccctctgtgtgtggtgataacaacattcttgacttttaacacttcgccaacaactctattaatcaaagtgtgtgtctacaggagacaagcaaagtagctgtatctgactcattttcattcaagaaaatgttcaaaatgatgcaaagaaccacacacacacaaaacaagatataaagtcactgctgcaaagtgaaccacggatatgatactcttaaactgacttgtgcttttttccagattcttaaagatttactgaaggaacttttttactaacgcacttcatgcttgcatttcaaaaatgtgtaacgcattttataagctactctgttaatctcaaagatgaatgagcatcggctaggcttagctatcaactgatctgaagcccatgcacgaggggacagtaatgacactcatcccacctgattttgagataagcaataaagagtgaatattctagcaaataaaatcttcaatttgaaaggttagatgccatttctcagaatgtgctactgcctgggacgtccatgatgaacatgaaaaataccagtgggagccccggactcactgacttcacggaggaaaagtaaaacaagccaaggttgtttttaccacttatttgctccttcttgcttcattggaaaaatcaagtggctcaaacaaaatcggcttaattcagatataaagtgcttaaatggtatttgataaccagtgaccccagattcaggagagttagcagccctttcacatttccaacaccacactgtcgagtttgtatatatggccaaagaaaatgtggatctgtgatgaggactatgtgtcaagattatttaaagcaaagagcgagtaacagtcgttaggctgcagtaagagaattcaggaatcactaggtatatccaggaagaagcgtttttaaaactgttacattggaaacatcagattggtggttataaagggaaaaagatatattttatcttattgtgttaccaaaatatcaactttaaatataatacaaaaaatattggtctagtggtaatcaaaagaggaaaaaaatattttgccctactattactaaaacataaatcacaaatacaaagcatattatcagagaagttacactttgattggaaaaaaactttctatgttaaaataacagccacaacttggccaggcccagcggctcacgcctgtaatcccagcactgtgggaggccgaggcaggcagatcgcaaggtgaggagttagagaccagcctgaccaacatggtgaaaacccatctctactaaaaatacaaaaattagccaggcatggtggcacacacctgtaatcccagctactcgggaagctgaggcaggagaattgcttaaaccctggaggcagaggttgcagtgagccgagatcacgtcactgtactccagcctgggtggcagagctagaatacatctcaaaaataataataataaaaataaatttaaaaaaacagccgcaactattcaacaccagtagcagatttcagaaaatagtcctatgcatcattaaagcatatagctcttctatttgtcttacgggtaaaaaatacggcatttacaactttacatacacactgctgtatttctatagcaggcaaatcacgtactctaatgtccatcttacatttgtgaatataacttgcatctacagctggatgtggtgactcacacctgtaatctctgcactttaggaggctgaggtgggcggatcactcgagctcaggagtttgagaccagcctggggaacatggtgaaacccctctctacaaaaaacacaaaagttagctgggcacggtgttgtgcacctgtagtcccagctactcgggaggctgaggcaggaggatctcttgagcctggaaggtggaggttgcagtgatcatgccactgcactacagcctgggtgacagagcacagcaagactctgtctcaaaaaaataaatgtataaataaaaataacttacattcacaggagactgttggagctgccctctggacagcctatcacagagcagctttctctgtaccccctcgcccctccactcctgcatacagacccttttcctgaactgctctcctagagcaccaatccctggacctttgtaaccaaaacccaccggtatttgctaaatgtacctgtggaaaaatgggtacagttgagtcacttttattttcctaagtggagccaccctacatggagagagtatgtttaatctggttgtagagaaggggatggagtatggacgcagtgtgggtcccagcagattccattctaggaatttcaacactgatttatttaatttctgactcacactgtcaggcagggaagaaaccatgaactgtgagtatttaccattctgagtcacttctatttgcgaaagcaaatcaccattgcttttgtaacttttagaaaagaaataaatcaataatgaaattactaaaatggaatatgctgacagccacactgcacccacactttaaatgggaatcaatatgctatttataaatcaaaaagagaagggaaaagatctcaaaagtctgtttttggattattagaataactctattatgtatttcaaatgcaaattgtaatggtaaaaagatcccaagcataggttaattgaaatcaaattaaaaatgttaactaaacagtttggcatttaaatatggagacaaacaacattttaaaattagtattgctgttgttgttatcatcattattattatttaaagatagagtcttgccctgtcgaccagactggaatgcagcggtgcagtcatcgctctcagtagcctcaaactcctgggctcaagggaaccacctacctcagcctcttgagtcactcagaccacaggtgcaaaccaccacacccggcaaatatatatatatatatatatatatatatatatatatatatatatatatatttttttttttttttttttttttttttacttttttatagagacaaggtctctttatgttgcccaggctggtctcaaacttctggcctcaagtaatcctcctgcctagcctcccaaagtgctgggattacaggcatgagccattgtgtccagccagaaaaacaacattttgacaaaaggaatgatggcaaaatgctacatttctaaggtaaaattttggttattaaaaattttaaatttggtaaaatggcctgaacatggatgagctccctaatacctaaaacacaaagttattgttgtttcctctttgtacaaaattgcaacttgtgcagttggtttttttctctaaaattctgcatatttttggaagttgatgtcagtccgtgagtgtcacttgttacacaagcaagggaagaactttcatcaggccctcagtttccaagagcacagtcatttgcagccataaattccaagaaaataaaacaaagtagaattcaaaaggagttcaggcagtgaatcctaatgcccaagatgtcaaacctctctaatctttcctactcgtatattgattagcaaagggtctttttccaagacccttttcttttacactggagaaataacggctagatccttgccaagtggccaaaggagatttgattttctatttttcactgggaggaggtgaggggatgacagctccccattgttcctctcactcagagcctggggcctgagcctggttttccaaaaggcctgtacagtactttcaccccactggcaaatgccaatatgcagtgggttcagaatgatgaggaaaaccagacacagacatggacccagtcaataagcagcatttcacacacagtgaccactagctagtaaaatttctatgaaagaactcatatgtaatcacattaaaaaacaggaacgaggcccaagcacaatgccatcctactctgtgaagttataaaaattttatacatgcattctgaaaccaaacaaaactagaacagaaagcaaactttattacacatgctttgatctttctctaaaagaatctaggctgggtgaggtggctcatggctataatcccagcattttgggaggccgaggcaggcggatcacgagttcaagagatggagatcatcctggctaacacagtgaaaccccgtctctactaaatatacaaaaaattagccaggcgtggtggcacacaactgtagtcccagctactcaggaggctgaggcaggagaatcacttgaacccaggaggcacaggtttgcagtcagctgagatcgccccactgcactccagcctggtgacagagcgagactccatctcataaaaaaagaatctaaaattgtccccccccaaagcactctaaaataaataacaaagaaagcactataaaatcactaatgagtatagccaggtccaatatagaaataaacactatataggctaggcttctaaaaaaaagactatgaaattgaagggaaaatttattaattcaacagagatagcatttttatgaggaattttctagtggcattttagatatgactggttgttacattgtaataagtccaccttttaggaattaatatacatcaatttttaaataataagttgctcaaaatgttagtattgttgaccaaaattaagactgttgaggtttgataatggtttgataaacatttgttcgaaatcaaacgtgacgattgacaaaggtttattgaaaactaaatgtgaagattgactcaggaagtcaacagaagttgggtgtgttccagagtcagctaggagttggaaggcctctataagaaagtttagaaggaagagaactcctcacaccagagctgtcctttttcattggagggtacattacagaagttacaatcattggctacagatggcaacatacaggttaaagtgtccatgtgcaagaccatcagccagactttcttcccattctgaaacaaatcaggatccttttcagtgtctgtaagttacatagtaaacagtatgccaacaattggagaactcctgataagaccctacccagggaccgcatgttgccatgaatcacaagacttctgccagatgggttaatttggaagcctgccagatctgacccataggttatcagtattgtgcttatttacgtattagaataaaagcaagaaatttatgtttgagaaaatcatgtcatgtttcttttatagtttaaaaattctacaaaattcctgacctttaaaaaatgtatcagacttgtttttgcactgttcacatatgtgttaataataaaggttggatttatttgggagaataataaaattatattcatttgtttaattctcttcatggtatgttgctttatagttcataaaatgctttcacattttctcagttacttttgagaaaagaggaaagcagaacagatatgatactatccttattttatagataaagaaataggaattttgccacagccctcaagttaacagggctgataaaaagtgacattaaaaatatattcacatatagataaaattttaaatacaagaaattcagcttaatgtaagttattacattaatttcttgattagagtatccatgtcacagctcttattgaaaacaaatgtcataaatttagcatatgttacttaataacaaaaatattcaaaatgaatgtgattgtggttaactttatcatttctccaaagaaaaggtttccttgactacaaacatggaaaagatgaaactagaatcactaatgttgttttcagttctaatattcatgagtctacaaattttataattctttatagagtaaagttacaaccctgcacttccagtaaaacactctctttgcacctctgcctatacataagtcactctttcaccaacctacaaaaagtattctcggccgggcgcggtggctcacgcctgtaatcccagcactttgggaggccgaggcgggtggatcatgaggtcaggagatcgagaccattctggctaacccagtgaaaccccgtctctattaaaaatacaaaaaattagccgggcgtggtggcaggcgcctgtagtcccagctactagggaggctgaggcaggagaatggcgcgaatccgggagctggagcttgcagtgagccgagatcgcgccactgcactccagcctgggcgacagagtgagactctgtctcaaaaaaaaaaaaaaaaaaaagtattctatttgaggtcttgcttttgggggaaacacttgcatgcaaaaagctttctccaatgagaaaggcaagggagataggttacactgttttgcaagaagagagtgtgtgtgtttgcaggaggaaattaacgtagcagtgatctttcccttccaattatgcatgattcagcgattacacataagaagaaattcccttgcccatcttatcctgagtgaaccttgttctttcttacaaaactgagtctattttctttcatatctgttattccacaaacactgacttcacacctactctgggaagtcaccccactgcacactggggatacaacagcaaggacagaggtaggtttactctcctactaaatcttatctctattacttcacgtcattggaaattatgggtatcttgtgatgttctggactctaaaatgtcagagacatgtgaatgaaggagcgaaacgtggtgatcctcaaagcctgtaggagaagtgggagaggagagagtgggaggctgtcttcacgtttgcggcattgttctgtctccatctattgccaagggccagtagaggtcagaatattcttagcagattattgacttctgattatttgattaatcaatgatagaaactgttgtccatttgtcgatttgtaccgttgctcagtgaagttatcatagtaaagttatagtactgtatagttatgcgccataagagtaacagtgctctgacctccctcgttcacacctgggcaaggcctcccccgagacccattaacggcacaactgcgtccctagtggccattcccagaactgcaggggagggaagggaccatagaaaattctcagcttcgacgcttgcccatttcctccactaatttttatttttatttatttatttattttttgagacagagtttcactcttgttgcccaggctggagtgcaatggtgcaatctctgctcaccgcaacctccgcctcccgtattcaagcgattctcctacctcagcctcccgtgtagctggtattacaggcacgtgccaccacgccctgctaatttgttgtatttttagtagagacggtgtttctccatgttggtcaggctggtcttgaactcccgacctcgggtaatccgcccgccttggcctcccaaagtgctgggattcttacatcgactgcatagaaagaggagagaacataacctacctaccccgtacatacttcagcccaggtcctgtgcctcatctgtaatatgaatgaagagacatggagaacagaaaagaaaaaaagaaaggaaaatctatcttgggaacaacaacaacaaaatctaagaacacaactatgcatatatgtcttagtctgtttggtgctgctgtaagggaatacatgaggctggataatttacaaagaaaagattgatttggcttatggttctgtaggttgtacaagaagcatggcaccaacatctgcttctggtgagtgcctcagggagcttcaaatcatggtggaaggtgaaaagggagcaggtgggtcacccaaccagagaaggagcaagagtgatggcaggaagtgtcaggctctcttaaatagccagctcttgcataaactagtagaaaaagaactcgctcattatcacagggacggcaccaagctatacatgaggaatctttccccatgacccaaacaccttccactatgccccaccttcaacattaggggccaaatttcaatatgagatttgtagggacaaatatccaaactatgtcaacatggtgttgaatgaatggacagaataaaagcaaaataacatattagagagagaatttaaaaataaaaaaactgtatgtaacaacaacaacaacaacaaaaacaagtgaagtcaaaaatagtcaaaataccctccaggcaccagatcacagattgggacagaaaacagaaaggcacttcattaattttcaaggctttgcactcaaaactgctacataagcaatgcagtgacagattgcatacagaattcataaggaacctccaaggccatttgtgtgatcaggacagacaacctgggcatgaacttgaaggcacacatttttcgtcaaaaatgtgccaaaatgaaagcaacctcccaaaacaatttaagagaaacagtggcaagtgcaaagaaaactggacaggtatggtgaaccctactccttattcccaaagaagtataggaaagctgttgcagagccctgcatgctcaatttacaattcctggatcaacgtttttccaccctgttttcactgagccagggagccatccaatgcttcatcatcccagggaaaatgaacaaggccatcttattaattggactacatcaccctttttcctcttaaaacagggctcactgttagaaactcacactggattagcgagaaaatgctccaggcttcaacttagcacatcagaaagtcagagcttaactcctaatttaaaataaaccctgtatttttggttgttttcctttttgacattgcataaaatggattatgcaataaatagcagacagactattcacgttgcaccagtgcatattctaatgttctgcagcaacatctaatggtgtaaataagatgaaaaaactaacgatcctttatgaaagattttttttctttatggggcataatagcatgcacaaatggaccctgcagaacaatttgctttcattccttattttcgctcttatactagtaaatgtgggataaatgtataatgtctgttaaacattcataattattaaaccatcaacggagcttatcaaatcccacatattcctctccaatgagctctttaaagggaacaactttgatttagagtataaagatgtggaatgggtcagctgatcattctggccccaaactgcggcaagggtgttgtcttggaaggaaaaggaaaagctaaactaatgcagcctatagcttgtgacgaaaggacatttttcaaattttcagaagcgaagttaagaaaagattacttagaaactggcactgcttaaaaatattggtacatcagtaaaggctacttcttatttcagaatattagtagggtaattcctactataatctgaaaactaaagaagtatacatttacaagtgttgacgttccagattttcaaaaagactgcgaattcatttaagaaaaaataaaaataacttttgcacactgctccttttccttgaaaaagagtttttgcctaaagctatagactacattaacttattgttttgaaaaaaatatataaacgaaggaacagttatacgaatagtacagtaactgtagcataccttccacttccactcaccacttgataacaagttgcctcattttctccactgctttccctttctctcattctaatgaaaacacttattgttactgctgaacaattggagagtaaactgcatacatgatgtctctttctccccaaaggtttcaacattatcttctgagaacaaggacagtcttttatacaaccacggaacggtgatcaatttcagaaaaaaattaaaatttaactgtgatggtctttgattttaagaacttagaggagtgttgtaaaactccaattgaaggtaaaaatactcttaaaaattgcagtcttttctgactcctcactcaaaacaaagtaaaagcctcatgagggcaaagattcaactttattcccgggtgcacaagccctcccaggagagcttcacactcagcgcactcgtaggcaatgttaactgatttcaaaaattattcttcaaacaatatttaattattatgaagtatctcatgtgtctagtataatacatgaaatcattcttgactatgtttaacgtcaagaaggttgttatgacccacattcttgggaacatgatatactttttaaaggactctacaaaactttctttttttttcatagataaccctcaaagattcacctaactcttgactaattttgaaatatgttctgcatgtgtgccactaatttggattttaacatccagtggtagcgtctaatgataaggtagttcacatttcagactgattaaaggatcatttaataattttattcttttatctcccccaccatacacacacacacacacaaatctttcaaaagaaaaccaagcactctctccaaactgacctctattaaaattaatttttttaataactgcttggttttatcactacttccccaaatgctaattaattctaactctaaactatgtaattataatacttctgctgaaatacaaattatctggtgcccctggggtgaacaagtaagaatgtatttcatgttccattcaacagaggaaatgcgatgtttctcagaccatggaaacaatgtagcagcctccctggctcccctcccccaaaacactggcagttcctgtttcttcctctttagcaggaagacaggaacagagttgacagttggcatccagtcagtttaatgcctctctccatggggctgtgaggaacggtggcatgcccagttatttttggccaggcacggcaacacacagagccttgaggagccttcatttaggcagtggcggccaatgtacctgcagaatgtgaattgacgttgccatggaaatagaacaactcttcccggttctgtcaaaatgcatctctatctgcgactaggcagaggtcaggaaggagagaaacacaagtgccagggagaacattcgagaagggaaggactctgcagtgccccagtgtgggagaaatttgatgggctttttctgataacattcatatacactattgtgtttcaaatctggatcttgtttattcattagacagtagcaaatccggatacacacacatgcgcacacacacaccatatatatatatatatatacacacacacacatataccttatatatttatatatacatattcaccttactctctgtaaatatacatatattatatatatacatatatatacaccatatatataccttacatactaacatatgtatatatatatataccttatatactctgtgtatatatatacatatgttacatatatatgcactcacatatatacccccacacataccttatgtgtatatatatataccttatatatttacatataaatacaaatgtacctattcacctcatatacgctctctctgcatatacatatatatgcacacatatatatgcatccacacacacaccttatgtgtgtatatatataccttatatatttatatttgtgtatttatatatttatatataaatgcaaatgtacatattcaccttatatactctctctgtatatacatatatatatacacacacacatatacccacatacacacatctatacacacacacaagcaacacacacacacacacacacacacacacacacagacacgcatattttcttctgggacccaaagccagcctttgcagcctaccatataacattgttagggtctcatttttctcagttttcacacaaggttgactcaggtaatctctaagccctccttttctaatatgtctatgatgccatttaacattctgttttcagtcttaatgtgcatttagcccattctacctggaacttcaacaaaaccatgaaaacaggacagtgcatgtcataagaacacataaataggagctgtgtaaaaaaccaaagtgcttcctctctgatcccctctttggaatgtagttctggggtgctgctgtgggcactgagacctgcagctgtccctaggcttaactcttgaggtggcaggaggaaagtgacagtgctgtgtccctggcagactctcattactggaaatttgttgctgctgcctgttcctgagttcagcctgggtccagcccagtgctctcatttttcatcacctgtttggccctgcacatggctctgagtatgagctttagcccaaatgccaacctctgggtcccatgcttttctggcctctgcagactcttggttcacagagacatgggtgcttcatgcagagggtgggcacaccttgggtccagggacacaggggaccaaggagggcacatagaacctccatgatgggtattagtgaacctcgatactgagtattcctaaacacagagtgaatagccgatattccaattcaataggaatctgtgtgtgcattccaatggacccttgagttctgaccatttgcaagagaccctgaaggcctgagatgcgtcctgtcttgctgggtgaggcacaagcccagtcatctgctgacatgtggcagccagtctgtcaaagagcctcgcagaccatctgcacatattttcaatgcagtttgcccatatatatatataatatatatataatatattatatatattatgtaatatatattatatatattatatatattatataaattatatatattatatattatatataatatatataatatatattttatatatatattatatattatatatataatatatataatatatattttatatatatatatgtacacacacatatacacacacacatatatacatacacacacatatacacacacacatatatacatacacacacatatatatacatacacacacatatatacatgtatatatgtgtatatatatgtgtatgtgtgtgtatgtatatatatgtatatatatatacacacacaccacctaaaaccttaaaattttacttcattgagttataggaagaacatccatccatcatgatacaactgtgcatggcttaacagtgggatatgttctgataagtatgtcattaggcaatttcattatcatgcaaacaccacagagtgtgcttaatgcaaacctagatggcataacctactacacacctaggctttactgtgtagcctattgctcctaagctactaacccatacagcatgttactgcataaatattgtaggtaattggaacataatgttaagtacttcatttctaaatataccaagcataaaagtggtacaataaaatgcggtattataatcttatgggactactgtcatacatgtagtccgatgttgactgaaatgtcactatgtggtacataactgtatttatgaatctggtaattcaagaaaatgtccagatagccctttattttactcttcctaggcatgtgtaaatatatgacggtgagtgttatgtgtgagcttggctaggctgtaataatacccagttatttcatcaaacacgaatctgggtattgctgtgaaggtgttttgtagatatggttaacatctacaatccagtcaattgagaaccttatgaaaaaaagtctcagtgctatggtctgaattattgtatctgcccaaaatttgtgttgaaattcttacccacaaggtaatggtattaggaggtggggatttgagagccctcatgaacggtattgtgcactcttaaaagacacctgagagagaccccttgcccctttggccatctgaggataaagcaagaaggcgctgtctatgaaccagggagtgggtcctcaacagatactggatgtgctggtgccttattcttggatttttcagcctccagtagtgtgaggaagaaatttctattgtttacaagccacccagtttatggtatttttgctgtgacagcccaaatagactaagacacccagaggagaaattgtgactcaagaccataacataaaaatagaaatcattcttgagcttccagcctcttgctttgccctacagattacagacatgccagctcgacaattgtgtgggccaatttctttaagtctctgtctctctcactctctctctctctctgtgtgtgtgtatgcgtgtgtgtgtgtgtccatacacatataaaataccctgttgattattggttctaggtaacttgaatcactagggtagtttaaatcaaatcataaaacacatgaccttccttcttataacattctagactctaaaatttgttgcccctgactcttaatataagcacatatttatattatttcagatcttgcatctattagaaggcatttaacaactctaaatgaatatgtttccttaatgacataattcatttgccctaaattatatgtgaagtagattagcttgcaatagtggaataaattgctcctagaataaattctaggagccataaaactacaaacttccagttgaattttggtggtatacttacttgctctcattctagaggcacacaggtcagtagttataccttactttaaataccatctttcttcaagagaaaataattctctgcaataattatagcaagtcagttaagaggagcaggattcaatgcaatgctattatcttccagaaaatatgcttttcatgaaagtatttcaaaatcaaagattgctgtcaacaatttaaatgcattaaatatttttatattttatagattcttgaggaggaaataaaacacaaacactaacgtgagaatggatgaaaagttatgtagtgtgtggccgggcacggtggctcacacctgtaatcccagcactttgggaggccgaggcgggcagatcacgagatcaggagttcgagaccagcctggccaacatggtgaaaccccatctctattaaaaataaaaaaattagccgggcatggtggtgtgtgcctgtagtcccagctactcaggaggctgaggcaggagaatcgcttgaacctggaaggtggaggttgcagtgagccgagattgtgccactgcactccagcctgggtgacagaacaagactctctctctctaaaaataaataaataaatagaaaatatatgtagtgtgatgtagtgtgtatataaggaattgcaaatcattgtatttgagttagcacatgagaattgagcttaaatggcctttgcttgtttgcttaaaaatatcacatgtaccctgtaagtatgtacaaatattatgtattgctaaaaatttaaaaatactttcatagattctaataaaataaaatttcaaacaacttaaaagcactctttctgtgttttacaataattcaagaatccctactgtatgtagaacagtgtttctcaaccggggtcatttttgaccttctgatgacatttggtaatgcctggagacattctttgttgtcacaactgggagtgagagggtgggtggtactgacatctagtgggtggaggccagggataatgctaaacatcttaaaatacacaggacatttcctttggatgtacactcaggagtgaaagtactggatcatatggtaggtccacttttagttttttgagaaaccgctatacttttttccgtaatggctttactaatttttattcccacccacagtgtgtaagggtttcctttctccacatcctcagcaacccttgttatcttattatgtcttttggataatagccattctaactgaagtgaggtgatacctcattgtggtttggatttgcatttatctgatgattagtgatgctgagaatgttttcatatacctgttgtccatttgtatatcttctttttaattttttttgctgtctttttgctgttgacctgtttgagttccttatgtattctgaatattaacccctcaaataccacgttttcactcatatgtgaaatctaaagtcaatcttataaaaatagtgaatagaatggggtaaggagtaggaatagggagatggggagtggagggtcaatgggtacaaagttaacgatgagaaaggagaagtgctggcgttctgttgcacagtctggcaactacagtcaacaacaaggtacgcacatctcaaaatagctgtcatagaggattttgtatgttccccagaaagaaatgataaatgtctgaggtgatggatatgctaattatcctgatttgatcattaaacaacgtatacacgtttcaaaacattacgttgtgccccataaataggtacaataattgtgtgtcaattaaactttttaaaaaatatatttaaaaatgcataggacagttcgccactccctccccgagaaaaagaattattttgcccaaaatgtcaatgggttgaggttgagaaactctgctataggacaaagctaggcataaggtatgtgtttcccattggcatgtgccgtattaaggagtgagatagaaatctttattaaagtaaggccaatataagcagttagtagacagaaacccagtacaaactcagagtaaatggtgttgttctccttaggagaagagctaagcaaacaaagcccatttcagctcagttaccatgtgctgacacaaatccacaacaagggataatagcaaagcaattcgttccacttgattatagttcattttgctcaacaggaaagtcagatttgatgttcatgatcatcaggcataaatcctacaaaatgtatttaataagaatgcaatgtatttttaactgccttcattaatttgattgtcccccctttaaaacaataaataatgactaaatctaggtcacgttttctctttgggccttggctcctcagtttcaaaagtggagagttctactctgtgagtcctttagttcatgaatccttgctgatgcaggatacatatttttttccttgaaagggaaacagaattgatcagctgataggtgtgatcgtcatgagcaaaacaaacttcgctttaagaagttatcaaatctctgtatctaaagagaattttcgtcaagagttttcgagattcagatgccaaatcttcctgtttccattcgcaactccatcaactctatcttgccaccttgctgcccagagttgaaagcagcctggtactcagggcagggaaggcagaagcacatgtaattgtcacatgcggtaggaatcaataatcgacaacataatgacattcaatgaacaatttacactgaaggtaaataaattgttgatttcatgtttcgcttacacatagtgcaaagagctcttcaccacggctctggtgatgaaggctttgtatttattaattttgttgaccttggagaaataactttactcctctattggagtttcctattgagtaatgctggcagacacctagacacttcataattttaaaaaatgcatactttctaattaatgaaggaatagtgatacagaagcgggcagggaagtgttgggtagaggaggttgtggtccctgactagggctctactcccaggcctgtgcccacggacctaggtgaaggcagacatttctgtttttgtgcccaaatattgcaattcccaagaccaccctggcctgccatgcccccatcctgtgcctataaaaaccccgagactctagcgggcacgcacacaagcagctggatgttgagaggaacacatcagtggaaaaagacacaagtggctggacttcgggaggaatgcaccggcctaagagcacaccgacagaagccagcaggccagcaggccattgaccggtgaatgccgcagagtttcggggaggcagagggaggagagccctggtggctgagcggcccaactccaggggaaaaccaccttaccactccatctcccttctggctcccccatctgctgagagcttcttccactcaacaaaaccttgcactcattctccaagcccaggtgtgatctgattcttctggtacagcaaagcaagaaatcctgggatacagaaaagccctctgtctttgtgataaggcaggagtctaattgatctgatacgcacaagccacctgcacatgctaaaccaatagagcacacagtaacacacaaacacacacacacacacacactggggcctcaggagctgtaaacattcacctctagacgctgccatggggtcggagtcaccacagcctgcctgtctgtatgccctctcctgaaagtttgagcagtgaggcaccgaaaacacgagccacacccccatcacacaccctgagagggggacaaagggacttttcccatttcaacagtatcttaagaacttgagtgaatgtgtgagcttgatttgatgaaagaaattcggcttataacaaaaaatgccagtagctaccatttaaacaatcttagtggcagttgggtccttaagaaaatttatttatttatttattttaaacaaccagatctcatgagagctaagaaaatttagatcatgagcaacttaaagttagaattttcatgaacaaatttttcaaaattttaatctgtcattttccaatctaatagcacataaaaatctaaaatttggaaaattaacagattttccgaaacctttatttttcgttaatgagagaacaccacaggataattctcttttttttccttttctatgtttttatttttaaacttgtcctttttctttgcttgataaagtaatttaaaatattagatattccttaaaaggttgaatagaaaaagttatattacataaaatcttaagtgcttatatacatatataaacactttacatagagttaagatttttcagcgctttctgtgttatcatgtattaacaatcaatacaaactcttggtacacatgtctgctaaacatagaatctggacaagtcaactaattcattctttttttgcttgagttttctggtcaagaatgactttataatagactcagggaaaactttttttaaaaagtagagaaagacaaattctttttgggaaatgcagtattaaaaaattcacagggccaggtgtggtggctcatagctgtaatcccagcattttgggaggacgaggtgggcggatcatgaggtcaggagttcaagacaagcctgaccaacatggtgaaaccctgtctctactaaaaaatacaaaaattagccaggcgtggtggcatgcacctataatcccagctactcaggagactgaggcaggagaattgcttgaacccgggaggtggaggttgcagtgagccaaggtcatgccactgcattccagcctgggcaacagagtgagactcagtctcaaaaaaaaaaaaaaaaaaaaaatccattcacagaagactgtgaaattcaaatacattattttcaattcccatgacatttacaccagtgatatgctagaaagatttcagaaaggctcatcataactttataaataaatctgttcatactacttgtgtttttacatactgttgagtcccaaaagtggattttatttgtgacgtatttaattcatggcaagtatatacatataatacagcattacataaatatacttggaaacaacaaaaactaaacttgaaaatgatgccattcctccagtttttggagaatgaggcatgtcttcctcttttctgtctagcagtggacagtggtatagtcagaaccaggttaaaacagatgtggtcagggaccaaaagagtgtgtgtgagggccctgtaagcagctacaccacgggggttcatcatacaaagtgggtctttgtgttacagatctccaatgtcatgaaacaaacattctttaagtgagaagaacaattatacattgctgataaacacttccgtgaatgtatcaaatgatttgctaagatattaaaactagtaacttttcagagtaatttggtttccatcaagaagccttctgtgcaaggaggaaatagccactctcaatgtcttggatccaagaaactacttatttgtcaccattttctcttttctcctgttaaagaacaaggactttaaaattagacagactcagctcccagctatatggtctcagaaaattcacttaatgttttgaggtaccctcatttcagtctcagccaagagggctcctactgaaaacccctgtggccttccatctgagaaccttctcttggccagcaaacaagacagagcatgaacagacctcagccatagataaggtgggctcctggtatctcagacatgatcatttgaagtgtactgtaccaaatctctcgggggccccaggtgggactgaaccccagtttcccacaccaataaactgctggacaacaccctctctactgacttcttttctttcccatgtccgttccccaatttcctaggatactttctgggcctgcctctgaaagaagttccttacactcaaattcttgtctaggatcttgcttctcggggagcccagcgtcagaggctcccatcaacctcccagctggagctggcccccagaggcagagctataactctgcctccagctgggtggttcacacctaaaccctctgagcactttgcagaacttagtttttttcagggcaagtacttagcagagaggagaaggtgggaatattgttcatgccttgtttgtgacttaccacaaggccaagcctttcagggacatgtcactccctcaaatgaaacccacttttatttggcttattcagggagaagggggtgaaggctactcagagggctccatccaagccttaactgacacaggtgctgcaatgagaatatgaaactggatgccttccccttttcaggtgtgtagaagacaaggacatctgccaaaagaggatggggtgagagatggcatggtaggtgaggccggggggtgggattcagggagataatgagagccctcgaggtaacttcgggctggccaggaactttgcttatcagatttttgcagcagtttgaagagaaccattagggcacttcaacagaggcctgaatacattagttagcttgattgtggcactcagttcacagtatatacatatatcaaaacattgtgttatataatttaaatacagagcacttttatttgtcaaaatcaattagttaattaagaaaaaaaaaacagagctctggatttgatcctgagtcactttctcagtggtacaaaatatgctggcaggggagctatttctaagaatgatgctcagagctttggagccaggaggtcaaggtgcttccctggcctgtgttcctgagcccctgcaaagttagcagcatttgcactgcctggtgtggcttaaagtccctgccctgctgttccatccctctgatctttccaagcaggtggctctggcctctgtgtctctttagggcatttgctctgttaagctccatttttctctgaccttcctattcctgatagtgtccctatatggacatacaggtgaagctctcacttcctaaatgcttccagccacactgccttcagacaaaatctaccccatgtatggtagatgccaaaaatagccataatcctccatgtctccaagtatcatagcctttacaatgatcttcacaactcctcctatcaagtcccatagtcttcttctccactctagccacatggggcatctttgtatttcacattggcccacagaatgtgaaagaagttgctgtgtaccagcactgagtctaagcttctgcacactctctctctgaaacctactgagctaccatgtgaggtagtctagggttgcctgctggacaacaggaaacaatgatccagttctccttatcttcctaacacatagctggcaaccaaccccaggagaagagccacctctctgacaggcagctgctcataaactcatgactgaacctagctgacagcagaagaaccacccaactgagctcagcctaaattgccagttcacacaatcatgaactagacaaatagccattgttctaagccactaagttttgaagtagtttgttatacagtaataaataacagatacaccctggaataaatccagtataattatattgcagtgcctgtttctgctgtcattgctactggtgcaaaggaaacatgaagctcacccttgcctctggaggaagaaccgtgggtgaaatcctgagacagaaaccctgtatgcggctctccttttatctgaagaccacccgcctcatagctgtggaaacaggagcggatgctctaatcatgccactagtcatctccaggagttctgccatgtaaggtaacctggtctggctgccatccatcatctctgtgtctcaaaatatcacagctcctttttaaacctcaaagccaaaaagcaaacctttcaacactggggtggttcagtgcccaaaaccatagtatttctaccatgttctgatgatgacttcataaatcatcattgatttaatttcacaaagctctccatgacataagcacagccatagccacagtcctgacccatatttaatggtgaaattcaagaatctactatgtgttgggattctcctctttcctcctctgtgtggctcaaataaggcataagagacacaaagcgagattcatcatattaacttaaggaataaagtggcttcctctgagaacttggcctccagttctcataatatactatattatactccattatagtaattactggcctgttattttgttatacattattatacatagagtgtgtagaaatgttttataaatagaataatgcatagccattgccctgaattttctagaacagcactaatttaaaatattccttccagtaaatactggatattgctcttccttgagccaagaatttcttctacttcaatcgtcatgtctgtgacatttgctagcaccatagtctcatactgttggtaaattttgtacaagtgcatcttgtctttctaactaactggtctattccttaaggtcacaagccttgagggatggctttatacgtccctactcctccactgccaggtactccatctgtcctttgtttttgctcagttggcctcagtaactcacctgctaagtcattgtctctgctttcagaatcctagaggataaaagacagagcagcagccagcgaggtgagcagcagtcagagcctcctcatggacaggatgaaagacacattttgtctttggcaatgtccaggctttccactttttttttttttttttttttttgagatggagtctcactctgtcgcccaggctggagtgcagtggtgcaatctcggctcactgcaacctctgcctcctgggttcaatcaattctcctgcctcagcctcctgagtagctgggactacaggcgcgtgccaccacccccggctaatttttttgtatttttagtagagatgggatttcactgtattagccaggatggtctcgatctcctgacctcgtgatccgccctcctcagcctcccaaaattacagacataagccactgcttctggcctaggctttccatttttagcccctcctcttcctcaaagcattccatggcactcccctctgggaagtttctccagtaaggcagtgatcactgtgctctccagtgctaagaggcgctggcatgcatctgccattggttttacatgttactattacaaaacagggtgctgtttcttagtggccgttaaatagttttacctttgcacaggaatcatatttgcactattagcttgtgtttattaggagcaaccttaactgcaaagtcttggatccttacaatgtgtttcaaaagcacatggacctccttcatagttggtatggagcagatcaaaggtctgcatcccatcctcagagactcacagtcccttctgcttgtcaaaggatattgcaccatcatgtccctcatatcagcacctgcctggaccataatatgattggatgagaaatgttcaaggtaaatttttaagtatttttagctctttccatataagaatgttccagacgtgactttgagtttggaagaatgtacataaccaccttcagaacctccttttctttttagatgaaatctcttttattataaaatatcagagaattagcataactcttggctatctatccctcgggtatccctctttctttcctttctgcaagaaaagcaaaactaagaacctttatttacttagaaagtcagttacaggaggcaataaagtttatgggaacaggcttgtcgttgcttatttcccattgaccccagcaatactttggagaaacaatttctatgtcacagatatattgctttaactctaagggtgctgtttatttcaagagatgccttaacatgatgaaataataagaactgaacaccttatacaattgccctgggctcacatctcagttgctctctgctgtagctccacactgcccccagaagtgacttgtccaaaccaagtgcaccattccatggtcattgtacgacagacacaaactcagtacaaagaaacaccattgactcctcctgatttggttttctttttagaataattttcttacccaggaactgaaactccatttattgtttaagtcacatacagatttgataagctctcttttctcaatttgacttttgttgataaacaaaactacaggttaaaaaaagtttttaaatattcacaaaaaataattttcagcccttcagttgactggttgtctacaagttgtcttttgggagctctgataacaggtggtgtcttgaactgagtttacactgaaagtaaatgctctatcccattctgtgtcatgataagacaattctgagcaattgcatatccaccctatagaaagactcaagtgcttggctaatttaaaatgacaaataacctaaaataagttctatttgacattaaaatgctctaagaaaatattttttctcatctatagagacagttttcctctcacttggaaatcccaggacacttcagaatccacctatggaataccaaaccaccctttctccaccctaaacccacatttcctcaggcccctcctagagccacagtttccaccacccaccccatcgctcgataagggagtcacaacatcctccctgttttcttcactctgtccacatccgtggtgtccatcaaagctacatgcctctttgccataacatctctcagccctgcctgtccatccatccatccatccatccatccatccatccattcaaccatccatccatccatccatccatccatccatccatccatccaaccatccattcaggcttccctagactcccctcgactgaactatgtacaaggagtgccctgcttctggtgttggtcagcctcgttcccacgactattttccacacctcaggcagaataagagtttacactgaaaacgtgattgtctctctccagctacaatctccttcttggcgtctcgtcaacaccagcagagccaaaaccaccaaggcttgcaggacatggtggtttacagttcctgctggcacctgcagcttgccttttgcctggaatctgcctccctctccccaaggctgctgccggtctcaggcgcattatgcaccctctgggatcaggttccctctgctgggtacaccgttccagccaccacacctgtctcattcttcattcacccctgtctccgtttacctgtcctttcttatagccacatgcccaagctcctgcacggtccttctccagcacccagcacaccccagggtcccacagtagccttgggtgtgtttcccctctgcactgcagactgatgggcagggaccacgtcagtatttccaccactgggcccagctcccggctcagagaggcagctgctcagtgagcttgctcagggcaagggtgaaggaagaacagagcagattccaacaggaaattccaacccagagctctcagctcagccttaaggaaggaggagagatgggcaaaaaggtttggtccccattcctgagtggttgcatcacaggtgggtggcatgcagcacattccctgccatcaaaacacaaatcttgtcatggaaaatgcaggtcttgcccccattcctttccttcttttgcagcagaaattcaattaaactgataaatcagcaaccagtgatatttggcaggttctgcatccagcatcccactcaatgctctgcacagctgtctattgtgggtgtcactttgaagatgaggtgctgggcttggggaggacacacagtgggtccagcgacatgtgggtggcctcaagtaggcagagctggggtctgaccacctcccagattccaaagcctcatcatttaaggagctgcaatctgttcaaagtaaatattttcaaaagactcaagagttcttactttttgctttgatacactcttcttttatgctctcacggctgcttaaaaggtcatacaaattaaatggctttaaatcaatgttatgatttaatactttatataaaagagggtgcttaaaatactttatacaaagaaattcctttaaaattcaaaccactggggaaaacaaaaaaagaacaatgaatctgaaatactaataaatatcagataagacagttgctgacgtcaagttaaaaaaataaataaaagatccatctttttcctccttgcagattgatttccctgaactattttgtgacagaatcacttcaagtctaggtgtctgagatgcctcactgaatgagcagacaacatgaatgttctagacacatggaaggcaagcaaaaaacaacacataaataagcaagcatggggtatgtgcagcggtaatgaaagctatagggaaacataaaggaaaggtggtcagaaatgtctcatgcaggtcatgatttatatgtagtgttcagacagttcttgccgagggctttagctcagtggtccggaacaagaaagcaagcagggaaagaagatcatgggtgatgggggcatgctgctgatataagatggccaagggcatcctgatgaggggacataagtacagagactcaaaggaaagagcaagagagcctggggtaacctgggggagagagagcatggggtgacctggagaagagagaacttggggttagagaaacctgcaaatggaatggccctgggtaggactttggcgggggtggtgcttcaaaacagccacaaggctctgtgtgtgtgtgtgtgtgtgtgtgtgtgtgtgtgtgtgtgtgcacacgcacgcgcatgtgcgcatatgtgcttttgggcatttcacagggccccagggaccaccgtgacagcctcagtgagggatggcacagtcatccgaagcctggacagacgtgggttaaaataaagtcacttaattgaattaactttacaagttcaatggaaaaatgtttcacttgcagttagtcagcaaaagcagggaatctgagtgaaaagggattctgtaggtcctaagattgtttcaggatactgtaaagagaataaacgctacctcattgtcttggcttaaaaataatcaaaactatccttacctcctgccaatgtgtgtgatgaatccaggcatgtgtgaatgcatgtaagaataatttccttttcattgctctatatatgtacaaaatattttgcatattccaggatatatgtgaaaattgtttctttctctgatttcctaattcaagatctgatgcacaaaaccaacatataagcattgttaaaggaaatgaatccacctatctatttccccatccaaacatctatccatccatccacccatcgtccatccatccgtccgtccatccatccatccatccatccaaccagccatccatccatccatctgtccatccatccatccattcatccatccattcatccatccatccatccatccatccaaccatccatccacctgtctgtccatccatccatccatccatccaaccctccatccatctgtccatccatccatccatccattcatccatctgtccatccatccatccatccattcatccatccatccatccacccacccacccacccatctatccatccatccacccatccatccatccatccatccttccatctaaccctctgtttttctatctcttccttcctccatctaggtttgaaaatgaagcttcaaaacctatttaggtgattggaacatgtcatcactctcaatattctagcttcttcaagtggtttccctgaaaggaaatccatttgattttcttttaaataaatcttctgttactaatacctgatgtgctgcaagtatgatctcattttaaaatggccacatattttaaaatttacttgataaatctgcatctactttattcctatggaataacagaattttataaaatagaaggtaaaagctaaataccaccattctgcattaaaagtcaaaatttaaacaggcagccatatgttttttattcattgaaattaggatattcccaggttagagtatgtgaaatttttttatgaaaattgactttcataactagaatagaaaatttgaccccaggtggcaaaatcaattcagattccttttgacattttctaaccttggaatttctctaggagtaaagtagttgcataaagattatattcttggatattaattatttcaagtagtttccacagggaaaaaagtaaatgtcatttgtgacagttcagaagcaagtcaaggttttacttcctcttgtatgtaagaaagggaaaaataggaaattcgactagaaaatgtgcacatctccagggtagctgaagggagtcttcctgcacaaagggtagacttggggtgatccatgtgtgtaccccgccttgatgtggacctggagactccacaggcatgtccccagaactcttgcttcactctgcaggatgatgacatttatcaccaagtgttcatttttatgaacatatttcttgagctctgccttgaaaaacattctttacatttgaagagcaggtatcttgcttgctatccagggcaatgatatagagtgatatatttttaaaaagtaatctattatgttactcaataattttatgtaaggtaattaccccaaaataatcttctatattacttattttaatttaatctattatcaattatcctctgatttagaaataaagtacagaatgacatcaaatcatgggcggttgtaatgatttctcccaatattacctctgtaatctctaaacttacgtggtatcatctagtagtgaataagaaaaatagggggttccagcttggggcaagaggatggacttttctgatagacatacctgggtctgacttggttccccaagaggtggtcacagttaagactgtaacctttgataccaagtcactaggttttcatgctggctggccacctgctccctatctgatctgcatatttacttacattccctgtgtctaagtatcctcattcttaaaatggatacaatgacactctctatcttaaaggtgtaggggagaattaaataagataatacatatttaaagtcttagaacagtgcttcatgtgaataagcactaaaaacaaaatgttcattttctccttattataacatataataacttgagcaaataatttccctagacttatatcctcaaccataatgtcagacaaaaatgcaaacagagttagggtgtggtttaaatgtgatggcgtgtgttcagatcctggcaaatgcctgccacattgtatctcaataagccttagtttccttaactttcattcagcctttaccaatcaggatgtaagagtcacagtgtttgtcgaagttaaaaaataaattatcagcatcattcctactgtagagactcaactaactgtagatatgcaagcacatttttcaaaaatatattcatctcatttcttaatgtacattattagttgagtatcagatatgtagcaagcactgtgctacgtgcagaggagacaggatggataagagccaatccttgcccttgagaagctcaaagtcaggtgggaatgacaggcagataaatacataacatgctgaaggttggtggttgtgagactgtagagagacgcggcacctcagatacacctaaatggagcaaggtgaccaactggttcaaagatagtgagagatgtctaggtccaaccacacctgaaagtatttaaagcaggactttgtctccttgcaaggtcaacatggatcatgatttgggagaaaaaaacacctacttggttgagaagtatttataggcaagaagctggaggtaagtgctgtggccaattctcaaggcaaataaagaagcccctacaaggacacccactgcagtgcagtgttgagcctgagacgttactttacatcacatctctgaatggtgaacctcatgcctttaataaacgtaagtgtccaacattcagccagcaaatgtgcgaaaaacaatgaaagtgggcatcagcatgttcgattttatggttggagaagaagcggaaactgatttcctgtgatgccgactgggacactgttaagggttgagttgtgaccccctaaattcctatgttgaagtcctaaccccaagaacctcagaatatgaccttatatttagaggtcaggtcattacagaggtgatgtgaaaccatctaagattcaaaggttttccaatactctaccaatggattttgaaaaccaaagctgaccggtagagtctttttttttttttttttttgagacggagtctcgctgtgtcccccaggctggagtgcagtggcgccatctcggctcactgcaagctccgcctcccgggttcacgccattctcctgcctcagcctccctagtagctgggactacaggcgcccaccaccacgcctggctaatttttatttttttatttttagtagagacagggtttcaccatgttagccaggatggtctcgatctcctgacctcgtgatccgcccgccttggcctcccaaagtgcagggattacaggcgtgagccactgcacccggtcccggtagattctaatctaattcagggtgaagatttggtcttattaatttttgtaaggacataatataacggctgacacagaaatacagttttgggatgcgtaaagaggacacagaaaattttggcaatgatttctgaacttgatttaaagctctcgaattttaaaaacaagtccagccgtgacagctttgaaggccagaggcatggtgcctccttgtgcatccccagaacaggactgcctcacttaggaaatgccccttaataaatgctcctagaactgcaaaacacctaacttattccaaactttccggatgaaaaggcagaggattttctactcccatttcaggtctcagactccagctcatgacttgagaaacatctttttctctccctggctttccagaacattctcatgggccacagagatacccatgaaagtcccttagcattgagcactttgattaatttattgtttaacaacttatcaaaccctcttttcactgaacaaagttcctggaggcctactgaaatatcatatcactcagtataatttattcaatatgtggtgaggaagggaggtaggtcgagagagagacagacagacagcaggctgatttatgacatagatcggtgctgccttctcctcttgcaaacatgtccacaaatggacagcactcttgagtaactaaactctgagaaaactaacattgtttatttgtgacatctaatgcctcaagaagaaattactgggagagaatgctaccttttataggaattatattccccacccccaccaaaaaactcacatgcttaagtactaatccctagtacctctgtccttatttggaaatagggttgtcacagatgtaattaaacaaaacaaaattatagtagagtaggacgggtccttaatcctatatgcctggtgtctttataaataggagaaatttggacacagacagacacacagagagaatgccctgagatgatgaaggcagagatgaaatcaccaaacaccaaagactcccagaagctgggagagacctggaattgactctctctcagcctcagagggaaccagccctgctgactccttgatctcagaattgcagcctccagagctgtaagacaatacatttctgtcactggctgtacttccttacagcagccccaacaaaccaacgcttcccaagcacctttcgcattatatgaagtagtcctcctccttccatgtggttttggagggccctgaagtgggacccaggtggaattcatctctggatctcagagagagcgctcaataaatgctaagtggtaggtgagtgagtgagcagtggagcaagagaatgagtaaagggatggatgtagtgtttgtctgacacagaggcagagcaggggccactcagttgggtaaaggtctgcttgacagccaaataatttggggatagcctctctcccatcggtcactcactcctgagagcccttctgccctctccactcagaggtcacgtgtttgatcaagagatggggtgttagtgctccttcatttccagttgaaagagatgacagcatctgtatgaatccaaagctaaccccgtgcacagcagcacgccaagcacagcaggaagctaagcaggcccatcacgctgtcctgtaggacccggagctgttggcttcaaccaaaatgcgccactcccccaagtactttcctctaacaatcacaaagctgtgaaatgtccaagttttaaattattattgggaaatatttcatcttttgaaaacaattctggtttccccattttgacaccaagcagaatttggcccaaaactaaaagcgagcaacttttaagtatgaaatcaaaatttgccttgatattgtgctttctgtgtttgccatacaatgaattctggagcaatggtattattttactttattttaattttctgttgtgttttgtttttctttcctcccagtgtggtccttgaaccgcctgctaataaagtcatcaaggccgtggtgttcaaatcagatcttaaggcctctcaggtagaattgcttgatgagactggggaacatggagcacaagggaggggaaggaggagagaagaaagacaatgatacatttctgctctaatttattattcggggtctcagacacaatgaagggcaatacctagttctctgggttccgtctttccttcatgaggtcaagtagtagaggatgaaacagcacaaaggaaaatcaactcgtaaaatgaagagaaaaacgtgtcctttagaggatgaaaagaaacccagacagagactttcatagaacaaaacttgggactaggatggaacctcgctgaccacagcccagtgattacttaagggagtcccatgttttacagacaagctttaggggtctccatgggacaagcttgtggttggggaggccgagagggcccagaccccagatgtccacaccgggtccaccagagcatcgctgagatttgttagaaaaattgggatttccatggctgggcgcggtggctcacgctggtaatcccagcactttgggaggctgaggcgggcggatcacgaggtcaggagattgagaccatggtgcaacgccgtcgtctctactaaaaatacaaaaaattagccgggcatggtggcaggcgcctgtagtcccagctactcggagaggctgaggcaggagaatggcgtgaacccgggaggcagagcttgcagtgaccccagattgtgtcactgcactccagcctgggcgacagagcgagactccatctcaaaaaaaagaaaaagaaaaaaaaaagaaaaattgggatttccagtgaaattttatttgagaaaaggagtttatttcttaaaaacaagtgtgaaagcctgtttgcaaacagaatcagtgaaatgaaatacagctaaaatcacttataatcagggacagatcaagagcaaggatgttttttgttgttggtcctgtgtatctctgtttcttataagatgagaagggatattatgatgttattaattgaaaaaaagacaattcctgagatttttgaaaagggaaaatatggaccagataccttcattaagatgaaagcatagtctctatatgcagataagacccagggcattcctggtgtgtctcgttttacctaatggctttattaacataaaatcattttcccatgtactcacaaatattttcacgtttctattttttcctagatgctatggaaaaatatggccaaaaaacctgtccttacttgcatagtactataatgttagtgtcgatagcctttagcagtttgtttctattgagttgcattatgcatttggggtgctttattttcacgtatgatccatctccaatatctttattagaattaatgagctcttaacacacaatgactaattatcaactgtcatgcttctgggccgttcctcctacatttgatgcccgctcacctccccttcgcacacacaacccaaaagcagaaagcaaaaaaacactctattcattaatccattcactaaacattaattaaggtccgtctagattctgaaggcaaaagttcagatcaaacaacaattcctctaagaagcctccattgatttcccagatagaaccaattcctctctcccctccgctcccacaggactcagagattctattttcacacacagcgtaatctctctgtcgatgttaattacccacatctacgtccctccatgcccctcctcacactgcgctgtgaatctctggaggatgagaagcaggttttatttgcttcctgtgttctaatgtcactaaatatggccttaattcttccacattgtaggaagcttagtgaaggaggcaacaaacaaaacttcctaggatataagagctttaaaaatataaatcagaaaaagatcggtaataaacaaacatgaacaaaagagagggggtgctgcttaggctactgggtcccgcatctcctttgctttctgccaaaatgccctaaaagagctcccccatccctcccagcctttctgtgcaaccctgatccctcttcgatcaacttcaatccgtttttaatgccattactccaccaacaaatattgagccaaccaactaacaactgagagaaaatattttattaaaaggaatcccatatatattacttttaaaggttttttgtttggggtattttttttttaaagatggggtttcgctgtgtggcccaggcatgtctcaaagttaatgagctcaagtgattaccctgctttcatccttctgagtagctgggactacaggtgcatattacaaaactaaatgttataaataaaacaataaaagtgttagaagaaaatccagttgcatatcaatataatcttgatacaggggaagtctttttatacatcaaaatactaatgaatgtcattttacaggccattgttatttttatttttgttcatttgttttctgcatattagataacataaaaattttcaataaaaaagcattcacattactataactagtccagaactttctgcaattgcctctatttcaatacttattttatgccagcctttagtaacagactatatttaaatgcttctctgaaacaagacctatgtggaaagtaagtttacaaataaaataaagtgcgtgctagtaagcatcagataatacatatttgaaacacacgagaataaacagcaaagcttaaatttaagtattttaagagaagaatcctaaacataatgctcttcataaatagttgtctgtaccatttattctggtttagtttacttcataaattgaaagttatttccttattaaaagaatagaggcctttctcagagtcaagaattttaaaatgtttaatatatcacatatatgtgtatatttgtgtgtgtgtgtggtctatacacacacataaatgcatataagtgcgtaagtatatataagacctaaggtcaacattttacaagttgtgatgtcattacatgtattaaaatgaactttaataaagtaataatattatacttaaggaagaatgatttttcagtatattgatgtttaggaagacttggaagaaatccaaccaaattcagcaaaatgtattgcactgaaagtagtagaagacaagtatttggaataaatttaaatttctatttgttttggacctggtagatgtggcaacgcctctaaaacaaaaggcattattttgggataacttgcagtcctgatgatcaaaaagaatgtcacttgcatagatcagtggctgaaagcaaagaaagaaccaagcaaaatacacaaaagagcatggagaaaaagaaataggaactcaaagttttaacaaaagaaacttgttttctgaaaacacatggcatttttgatccacttcttcattgagactatctgcctacatgttctctaactgactgatttcagaagaagattattcaaaatatatagaatgtttcaaaaaataaatactcaatctcaaaaaatgaatgttcagtgctatctatacatatcgttgggaatgacctattcaacatgaatttgaaactgtaataagagaacatttttaggggtaacgatgtcacaagaaacacatttggatgcccagcatctactctcaaatgttgtggaagttagattaatggttttcaaattgttctaattgctcattgctatggactgaaagtttgtgctccccaaaaattcatatgttgaaatcctaactcccactgtgattgtattaggaggtggggcctttggaaggtagtgaggtcgtgagggtgggaccctcaagaattggattagtgcccttagaaaagacgcaagagttagcttattcttcagctctgctctctgccatctgaggagtcaaagagaaggcactgtctgggaagcaggaagcaaggcttccccagatgacagatctgctgacaacctgatctcagacttccagcccccaaaacagtgaggaataattgtctgctgtttctaagccacccagtcttttgaactttatgattgcaacccaaaatgggctaaggtgctcattttgtcaataaggaaatgaaggcttggagcaaagtgcttaaaatcctagttattaaatatttgcaccattaaccagactccaggtcttcctagtccagcatcatgtcacaatattagaaacgaccccaggaaagagctccaggtaggtgtcctcttctgaatactggcccctcacccgggcctctgcggtggtgctgatcacactgtgtggcatttccctgaagacaatatatgctccttgagatatttatctgattcatttttaaggggaaacaatcaatgcattaaataaaatgtatctggctcatttcaaaaaagaatacagaatacatctcacatacaaaatatgtttaagtatttaaaatatttgataggctggaaaggtcagacaagtaagattcctcttccctctgacagtgtgtgtctaaatgccataaatttttaaaacctgatgtattcacctccaacaccccaaaggcctaaacattttagtcctaggaagtcctgccatttccctgattccagcaatcaattatagggatggggacaagaaatgttatgatggccactgggatccaccatttggcatccaggtggcctttagctaagtgatgaagaggacatgggcagccaggtcacagagcattggcctcatgacccagaaccagaatctggggtaggtcatgtcctatcacaagcgaccctctaggggaatgcattaagcagaatgtcaggttgaatggaaatcacacatcccttcttcacacctttattcatacctcatgggaagggggagccacagtgagtctgtggaggaaaggaatgggggggcagggatcccaaatctacaagggaaactaagtcccagcttgaggaagcctccaaaccctgtctacttggtatcagtcttccacctttacctctaaagggatatcaaattagtacttctcatgagtctctggtcacctagccgccaagcattactttagtaattttaggactgtccccaggcaacgaaagtattaaatgacaactattattattcataatctcctgtttaaaagttttatttcatataaatttacataattaaaaatatttgtaaataaaatattgctgctctcggttgtgttcattatttgtctcatctacctacccaaggggaacacttctttcactgttctttcaaaagctaactttttaactttgaaaatgcctgttccatagacagtaagtgccaagttgaactcttagtcagtgtgagttgggtttaaccaagaggatacctggaagtgaggggtgagccatcgcactggtgaaatttcctgcagcatcagcaggagtcaggagggcaggggagaagcttcataatacaggcaggtgggctgaaaataactcaccatgcagggttctagaaattgaggaataagccttggtcacggagtagaacaggaattatgggaggcagtctatgcaaagtatatgcaaatcacttggaagagtctgtcacatcggaaacttcacatgaatagcagctgtactaagttgagcggtgtcaccccaaaattaagaaagtcctctggaacctcagaatgtgaccttatttgaaaatagggtatttgcagatgtaattagttaaggaccttcagatgaaatcatcctgaatttagggtgagccctaaacccaataattagtgtcttcgtaagaagaggagaggccacacagagacatagagaagaaccccctgcgaagatgaaggcacagattcaagtgatacggccacaagccaaggaatgctgaagaatgcctggggccaccagaaactggaagaggcaaaaataatcctcctctagagctttcagaaagagctcgaccctgctgacaccttgattttgaacttcccacctctggaactgtgagaataatttttttaagccacacagtttatgttaatgtgttatgacaaccctaggaaatgtactttagccatttttattgttgttatatatttatcaattgaacctttccaaatgaaaattatctttcaatttgcatttgatagtcaaattgaacttgcgtcacttttttccaaataagaaaactgggtcatgtattcacttttatttaattaaaagtttccaaaaaaaaaaaaaggtagaataggcgccagaattcaaaatttaggaacctattgtttatgtttctccaaaattcatttgtcgaaattataaaccccagtaggtgagggtattaggaggtaggacttttgagaggtgattaggtcatgaggatgaagccctcaagaatgagattagtgcccttatgaaaagacatgagagcttgtgttctgtccttctgctctgtgccatgtagggatacaaggacacagtaagaaggccaccatctgaaagccacatggacatcagcagacacagcatctactggtgctttgattgtggatgtccagcccctaaaattgagaaatcaatgtctgttgtttaagccacccagacgatggtattctgtgacagcagcctgagttgaccaaggacctacaaaatatttattaatcttcacaaatcagggaaatcatttctgcccagacaacctccactggggataggcagccctgtaatatccgaaattttacatatattcactcttccagcacgttaaacagcctcacctgcaaagtcccactttttctttcagtctgtgctttaatagtttataaaagccagaaatgtcatgggaaaccagacagaccacagagaagtcacacaaagaggcatgacctttgcacctgccactgactttctgggaacctcagtttcctcatctctaaaacaggtgtcctgggacacttggcaggggtaagaattgtgtgagatgatgtgtgaaatatgcacaccatcccagcacactgcaggcattgagctggcaccagcaatggtctggctatggctccgagcaccagcctccaacacttactgaatgaggggagaacaaagagtcacctcaaaaagtggcttcagcccctagcccccttgtgtgtagcccagccagtctgtcactgagaaaaccagtgactggagtggccacgtgtcaagggctttgggaacagaaagtcaggtccagtctgggctttctctaccagtgggaaaccttggtgggtttccagccttggcgagcctttgttccctcctccacaaaagaagatccaaataatccctagtaacctggtcgtaatacttaaatgatgtgatctggtaccaggacctggcagtgcataggcactcattctgtcttccctgacaagacccctgcatgaaactcagcgggtacattctcccctcctaggacacaagcatttttaaagagggttaaggtgtagagaagtccttttcttgggaaaatgattcacaaggcatctatggggagatattttcagtaggaagctgtgcaggagagctgggggtccacacactcagggtagctgtgagcagcatttccttgggtcatggggatatgtatctggaaaagggccaccgcccagtcagtgacatctctgccagggcctcaggcagactctggcccaaagcaaacggcaaagtggccaacagatcatgggctttgggtctgacagatctggattcaaataacagccacttccctgccttttgaccttaggcaaatcatgtagacttttctgagccacctcagtttccatgtgaggagtagggggtgacaatacctatgccaccagctatggcttcgcccaagcacagctcctggcatggatctggcagtaaatacatggggttttcctccctagtccatgcatggacctcagtggcctttggtttgtcagtttttttatattccttcgagatgaagttcatccatttaaaaaaataaaatacaaataagtttgatttagcaaaaatctgtgggtgacatttgctaaagttggatttatgtctcatttaatatttattgggattaagtcactgctggcctcaccccaaaacccatagaaaaagagaagctcaggtctttctaagggaagtcacgtcttacacttccccttttcaggagaggcctagtgagaatgtggttttgctccaggggctggggctggggtgggagcctggaggatcctttctaaaggctgataccccccagttattgggggcaagggggctgagaagcatttcttcttgaggcccatgtcaaccccatccaaatcccctcataacatcaagcagagcaactaagacagagccaagagcagcccaaccttggtcatggggaatcctcaccgtcctctctgtccccaaccctgtctatcctggggaagacagcccagaggcagacatgaccccactgtcccccggtgtagacacaatagcagcaaggaagacagcctgctaacctttctagaatccatttttctccacactcccacaccacggccttcctttcttgcttcttacacgcctgctgttagaaagatcttaattctggtgactgagggaaacacaaaatggtggcttataatcaaatcagcccagaagccactctgcacccaaacctatcacccggagggacgtgaaagctaattcttcaaaagccaaacacagtcgtctccttttccaagtcctgggattcagctgtcaggcctcatgaaaaccattctcctcaaggttaaaaccttaatgcactgtttgcacattgaatcaaaagaggtttgcataattaatggagcacagaaaaatcgggagacagaacgcaaagtaggttttaggagaaataaaaggcttgcaggaggaaggcatgccctcctgagtttcctgcacaagtacaaagacaccggtggaatcaaaaggcaggtcatgagaaccagccacaggggacctcttccagccttcagcacagggaggagaggaaacaagatgtctggacactgggtttctggagcaatgcttccactgtccttcaaatgtgcctcaaattgttcaagcaaactcagaacgtctctgccacgttccctggaacaatggaatgtccttgctgagaaaggcagggagcaagacgaaggcaggcaggcagcatttcctctacagacagacactgcgcagtgtcccgcagccccccaaattggggagggattcctcgcgtggcatcagtaaggggcgctcagcagaggcagcctggcatatggtgtctccaattttttagtgacaagtggcatgttagcagagctgcggaggagcggggagagagccggttggttaatcactccccattgcctgcaccctcaggcaaaatcatattgctttatgcagatgagttcataacagtttcttcaatttggcttttatagaaaaaagcgccagctcctcgcactgtgtcaacagccacccgagggcctagcactttacaaggcgagtgtattactatttaaagaccagcttttagctgaacatcagggctgccttcagagtttaattaccgccctccccatggggccaaatgagccatcgactcctcccaagggggttcggcttggtactgatctttaagtaagtgaacgctaaaccagctcatcttaaagcgcccacatctgatttcctgctctgctgcaagacagtaggtgactggtaatgacccgtgagcaatttacaatcctggatgtaattaatcttcaactgaaaataaaccagtaaaaaaaaaaatatatatatgtacaatataaaatatataatagaatttgtatttccttttctaaattatcagagaaagatctcaatagcacgtgcaatttcctgaaacaatttccaattttattacagcagtttttttctttctcctcttactttccttctcaatttgcaaaattgaatagaatgtgtttgaaaggccagggtcacagcctttctacatcctcaacagtgatcatcaaattagtccttttaaagtaccattaggtaggcatgactttgggatatataattgtccgttagaagacaaattaacatgtcaatagtagtacacagcgatattttatctgagagtggcccaaagaattaaaaatctagtgcattttccaaaagccatggaagaatcaaaatagggtaaaacaaggccgggcacggtggctcatgcctgtaatcccagcctttgggagaccaagatgggcaaaccacttaagctcaggagttcgagaccagcctgagcaacatggtgaaaccccatctctaccaaaaatacaaaaaattaactgggtgtggtggtgtgcgcccgaggtcccagctactctggaggctgaggcgtgaggatcacctgagcctgggagccgagattgcaccatggcacttcagcttgggcaacacagtgtgaccctgtctcaaaaaaaacattaaaaatgtcatttatcttcttgttttgagagaataccaacaacaaaaatattaaagatacatacatttaatttgtaacataaacaagcttggcagaacattcctaaggtgttgactgagttccaaacagaccaaggtattacattttcattctggaaaactcctgctgattcttcagtcatttacttcgagataaaaaaaaacaacaatgcatccagggctgtgagggtcccactacttgcgcttaggaagagaacagctgagaacggtaagcagtggtccttacactaccttctctcagcatccatatgaccaaacgaaataaaacaaagttccctgatatgtacatttgtgaccctgagttgaatcagttatgtctgtgttttaataggctgccaaccacactgagatactcaggcagcatgaaagggtatggaagacctaggttctaggcctgtctcataaggtgttacattttgggacaagtcatacttcagctcactcaccttcatatttaacaaagaaatttaatctgttatattgacgtttggaaaccccagctaagctaacagggagaagggctgtggtgaaatggtggtgatgaacaaacctcttagaggtacatcatgcaagacgagataaataatactgttaactaccagtatctaagctgagaaaatgtgctggctaagtcaacaggttgctgtatcctttacacactgacataaatgctgaaatgaatgaaataatgaaaagctaagcaaagagtcttgctttatggaggatccatggagcatcaagccctacgcttggtattttgagttcttgacgttatttacaaatgaaaagaaccctaccaaaatactagtcctacctataggaaatgtccgatatcacccagctagtcattggtatctggatcccagatccacaccaacaccgagccccaggcctgacactcagctcaaccaatatcctttctctgggccgtcctgcctcccagggctttctgctgtttagccatctactcaaaaatattttactagtcgggcgcagtggctcatgcctgtaatcctagcactttgggaggcggaggtgggcggatcacctgaggtcagaagtttgagaccatcctggccaacatggcaaaatcccgtctctactaaaaatacaaaaattactcaggcatggtggcacgcgcctgtaatcccagctacccaggaggctgaggcaggagaatcactggaacctgggaggcaggggctgcagtgagccgagatcacgccattgcactccagaatgagtgacagagcaagaatccatctcaaaaaaaaattgctttttcctcaaaattgccaccaagtgtctcaatccttgcaattgtcccttaggacagacccttctttccattcaacaaggtattccgaacaaacacattacgtctttgtggatatttctctagagtagtagtagctattaaaagaaaaactttagacaaatttaacagagtttaattgagcaaagaatgatttgagaattgggcagcctccagaaccataatatgttcagagtaactgagggactgtcacatggttgggataacatttatggacagaaaaaggaaagtgaggtagacaaaagggacgagaggcacagaaacagcagggctgcttacaggcttatttgagctcagtttgaatagttggatgcaagtgattggctgaaactgggatgctgtgattggctgagactcagctacttgttacagtgtagattacagtccctttacacgtccagttagatgacagttcactatgtacagagaaacctttaggtcaaacttaaaaagtgtagtgttaatgaaaaaagccaaactgaaatatttaaagaggtttattctgagccaaataccaatgaccatggcctgaggcatagcctcaagaagtcctgagtacatgagctgcaggtggttgggttacagcttggttttacacgtcttagggaaacataagacatcaatcaatacatgcgaggtatacattggttcagtccagaaaggcaggacatcttgaagtggttgggggtgttgctcacaggttataggtggattcaaagagtttctgattgacaattggttggaattgtcaattattccaaccaattattatctaaagacctggaatcagtagaaagaaactgtctggattaagataaggggttgtggagactgaggttcttattatgtagatgaagtctcataggtggctgcccttagagacaatagatagcaaatgtttcccattcagacttttaaaaggtgctagactctctgttaatctcttcaggattgggagggcctggaagatgaaagatctagttatgttaatagggattccttacaggtgcaaaatttcccccacaaaagacagctttgcagaaccatttccaaaatatggcaaggaaagatattttggggtaaaatattttgatttccttctttatctgttatgtgatattatactaaagttaggttggaatttggtatcttattgctatgaagaatctttctgtccatcttaggatctctattttaatgttaatgctgctcagtcgtgtctaaactccaaaaggcagagtgtataatgagacatgtctgatggcctctgttcctgtcatggcctgaactaccttttcaggtttccttgggtccctttggccaagagggtgtgtccattcagtcagctggggggcttagacttgtattttttggtttacagtaaggaggcagctgatgtaaagagataaactcagaaaaattgtaagagttctatttccagctgggcatggtggctcacacctgtaatcccagcactttgggaggccgaggtgggcggatcatgaggtcaggggttcaagaccagcctggccaacatagtgaaaccccgtctctactaaaaatacaaaaattagccaggcatggtggcgtgtgcctgtagtcccagctactcaggaggctgaggcagaagaattgcttgaacctgggcattggaggttgcagtgagccaagatcacaccactatactccagcttgggcaacagagtgacacttcgtctcaaaaaaaaaaagagttctcttcccttcctagacccttccaatgaatgagacagattccttgggttcacagagggagttaagaagagctgcctttagcacactgcatttctcaaatctgattcaactggaaactcacgtagtctagaaataggggtttactgaggaagatctgtatatctcccattgctgcagtgtgggaaacatctagaatgtgccacactcactgtcctgaaatcttctatgtgttagaaatgtttctatcttcttcaccaatcacctattctatctcagctattccacctgtgtgctgctgccaaaggttggcagcttcatctactttccatctgaaccagatctgaaactacatttaaatctaacacagctgaccaaatctacatgaaaattcttatctagatgaattagcatatacacaatgtttatgtattttcacctaccttcatgaactaatttcaccataattgatgccacataaatagttttgagactacaattacatgttttacacttaaaaagctttcatttcacccaatataataatgggcattattttctatgcttaaggactgaagtattacagcaattgtagtaaaaaagtaaaacattatacagctcatgtggaaacagctttctaatttttttaagactaagattaggatgcaaatccaacccggaaattgaaccatcactaagcatctttgttcatctgatcactgctcaaaaccatctgcactgaattgtaagatattaataacaaaccgtttaacaatcagctaggattaaaggacaaagcctcttagggacagtttctattggtggattttaaaaataaaagaagaaacagcacaagtcacatttctttctagattgtagaactccacaaaatgtttttgtttatatatttaagcagtgcttttatgaaagtaccactggacttaccttttatgccttggaaagggcatatgtagtatctgaggatcaagttcttctgaaaatttccagcaacttttagagatcaactcaatgacagtatgtcattcaaatcagcattttatattgaaaggcctgtggtgataatgtggaaatccaccaggattcccctgatgcaaggtttcaggaggtatcagttatttgtgtacaggacacatcccaaggccctgcaagaaggcccctgcattacaatgtataatgtaagaaaattcagatgtgtctaactctttgcaaacaaataagatttttacatatatatcattaaccaaatatacctttaattttttaaccaatccttcctcttctagccaacaactgtgatatctaaatgcttctcactcttcattcccaagataacacatccgtttgcacccaaaagtatattgcaaacacctgccagcaattcatgcttcaattctcaaatccatttcaacctgtaaatttttcttctgaattattttttttaacattctgtgacagagtcataggatcactaaaacaagactgttaaaaataaaaggttcatgaaagatcacctagttccattttctcatttatcatatgacaaaactgaggcccaacaggttacgtgacttatcctcctcagagcaaagccaagcggaggaggaaacaaaaaatcccagatcttgaatcagggtgcttgtcattgttgtcatttgtagaggtattgtttaagacagggtcatgctagatgtccaggctggaatgcagtggctatttacagatgtcataacgcttactacaacctcaaactcctgggcttaaacaatcctcctgcctcagtgtccttagtagccagtagctgggactacaggcatgcatcaccatgcctggctgtttgttttgattgttagtttttttttttttttttaatgcgacaaattgttggattaaacgaattaaaaacattttagaacataactgcaaacaataaaattagactgcttctgctaagtcttacttaggtgcaagatccaggggaaagggcagctatcattcttacaaaaatggaaagatagtttaaatcctggaaatacttgtctctgactaggaatgttttcccctggccagtaccatggggaaagttcttctgtggacctagcctttcagggacccctcaagtccttcaccttgtggacaattttggggaaatgagccaatttcgacagtcatctagtcaacagtaacaggaattccattgtgtactgaatatagtactgagtaaagaatatgagtaacaaatctcagaaaagtatatattacagagacggttatccactcacatagagggagacatactctcctcctatgctgtattgcactaaattattttttaaaattatagaggtaattcctatttttaggtattcttagaagatgacagaacaaactatatgtaaaatataaaatggattttggtaaccttctggaggatactaagtgtaatctctgctcccataatatttcatttttgtttttacgtttttgtaaccaccaacatgttgtactggaatttaacacttgacacatggtattgaaattgtttattttcttggtgatttcccccattacattgtgagccccttaaagacaatgttttattaattttccagtaggtagcaccaagcccagtacctagtgcacagaaggcattcagtaaatggtggatgaattaacaaataaaagaatgagtgagtgagtgaatgaaatgatgcatattttatatttcaaaaatctttatagtttatacatgattaacttgaatattttaaattcaatattcaggcattcctatcctcactttccagaaagcctgatgatgttaagtaactagctcagggtctcacatccattacatgagaaagccaaatctagaatccagatggcattccatttgcttggggaacacagggaagaaaaaagcacacgtgatcttgagcatttaaaacacagctctttaatcaggcagatattttccagatgcctataaaaatgttttgatagtaacatccaaagaaaaatagtcattcctcattaccagaacccaatgatatgtcatttccacagtactgagtttttgaggcactagtaattggcttctgaaaccttctaaatatcaagatcgagtaatgatatttaatgatgccaaaataagaatcagaatgaaattttaaacccacattatattgtatttaattatagaaaatgacatattaacttcctcatataaaacgtttattctaaatgtgaatgcagaacattttgtcaaatttcaaaccaacgttttttgttgttgtttgttttttaagacacagcatctgattctgtcacccaggctggagttcattagtgcaatcatagctcactataacctcaaatttctgctcccaagtgatcaacttgccttagccttctgagtagctggcactacaggtgtccaccaccatgcttggctaatattttttttaattttttgcagcgatggggtcttgctatgttgtcctgactggtcttgaagtcttatccttaagtaatcccccttcctcggcctcccaaagtgctgggattacaggtgtgtgagccaccatatacagctcaactgaggtagggggattacttgaggacaagttgggtgagagaggtacctgttagaagatactgttaaatgttccagaaaaattctgtcagtaagaaaaatagagtgtatagaagaaaaagtgatgtttaatatttgcttaaattttctctgcactttttctacctccaaaccaaatcactatatagaataatcacctttgaggaaagacacgtctaataatgtttataatattcagaagatgagattctatgtatttagtttactcttgaacaaagccacagtgtccagtccccacacagttaaaaatatatgtataaattttgactccctcaaaacttaactactaatagtttgctattgactggaagccttactgataacaaaaacaggcaattaacacatattttgtatgttatctgtattaaatacagtgttcttacaataaagcaagctagagaaaaaaacgttattaagaaaattgtaaggaagagaaaatatactactatatgtcttagtctattttgtattgctatgacagtatacagaggtctgggtaataattcataaagaaaaaaggtttatttggctcacaattctgatagctggaaggttcaagattaggcatctggtgaaaaccccagacagcttccactcatggtggaaggcaaaggggaaccaactgtgtgaagatcacatggagacagaggaagtcagagagagagaggggaggtaccagaatctttttaaatatcagctctggagggagctcacagagtgagaactcactcacccctgagggatggcattaacctatttatgatggatccacccccatgacgcaatacctcctactaggccccacctccaacatcaggggtcaaatctcaacatgaggtttgaagggaataaatatccatatcatagcactattcattaaatggaggtggatcatcacaaagttctccatcctcatcatcttctcattgagtaggctgaggaagaggaggggttggtcttgctgtctctggggtggcagaggtgggagaggtggagaaggtggaaggggaggcaggagaggcaggcacacccagtgtaagttttactgaaaaatatccacatgtaagtggacctgcacggttcaaacccatgttgttgaagggtcaactgtatatcaatatttactgctatggtgtggatgtggtttgtccctgccaaaacccatactaaaattttatccccagtgtggcagtgttgggaggtggggccaagtggaagtttttctggttacggggtaaaatacttcatgaatagattaatgccctccctcaggtgtgcattccccttctctcgggaattaattcctgagagagtatgttgttaaaaagagtctggcttatttggcttttgtctcttgcttctttttttcttttttagacggagtctcactctgtcccccaggctggagtgcagtggtgcgatctcagctcactgcaagctctgcctcccgggttcatgccattctcctgcctcagcctcccaagtagctgggactacaggcgcccaacaccgggcccggctaattttttgtatttttagtagagaccaagatggtctcgatctcctgacctcgtgatctgcccacctcgtcttcccaaagtgttgagatgacaggcgtgagccaccatgcccagctgcttccttttttcaccatgtaatctccctgtacatgcgcacttctcttctgctttttgtcatgagtggaagcaacctgaggccctcactggatgcagatgctcaatcttaaactttccagccatcagaattgtgagccaagcaaacacctcttcttaatttgtcagcctccagtattatgttatagcaacacaaaatgaactaaaatgcactgatacatatatacacacgcactgatatctcactagaccataccaagaaagacccaacaatgtggatcaacaggattttgctacaaacgttagcaatacctgtttactgatcctacagtatcttattgtgtagcttcacttaatatatttggcgttgggcatgtaaaaggttttcaaaagaccttgtatatttgcatagataatataagtatacttccataactagtatccaaggatcatcggtaaattagtttccatgtctttcattagtctcagatactttccatcacatatttctatcactgagaaaaacaggttatcatttgattatctctttatcagttgtcattaaaatgatctagaggccgagatgggcagattacgaggtcaggagatcgagaccatcctggttaacacggtgaaaccccgtctctactaaaaaatacaaaaaaattagctgggcatggcggcgggcacctgtagtcccagctactcagcaggctgaggcaggagaatggcatgaacctgggaggcggagcttgcagtgagccaagatcgcaccactgcactccagcctgggcgacagagcaagactccatctcaaaaagaaaaaaaaaaaaattatctaagttaatttcacttataaagcacagactcctatctagtaagtccatctatagaatgagagagtgaattatgttttaaataaacagagcagtctgcaaacggataatcaaatgatctgggatcccaccagtcatatctcatttagagcaagacagaaacattgatagttctcttcatagcttatgcatcaataaaaatattagatacacttttcttttttacacttattttcaaagagatggttcactttctctctgtatattgtaaatccttcaatgttatttttaccaagtttttgtcccttttcacaaaccatcctcgttatttttatcaccactggaattgattttaaaagcttgattattcttgacagggcacagaggaatgtccttcactacgtatgccaggatgaagtgaatttataagcccacaagtagatctgataagcatgcagaaatcatttgtattatgtgcataaaacagtgcccgattaaaggacagtcacattttcttctgacaaaatgtctgtggcactccagaaaacaggctttattttttaaggtttacctcataatgaaacaaagtttgaagtggaaactcttaaaatgcacaggtaggagatgcaatgatacaatccaatgcaataaaataaaataaaaccatgaatgagcacatttggaagaatgaattctccagttaaagtaggccgggcacggtggctcaagcctgtaatcccagacctttgggaggctgaggcgggaggatcacgagggcaggagattgagaccatcctggtcaacacggtgaaaccccgtctctactaaaaatacaaaaaattagccgggcgcggtggcgggcgcctgtagtcccagctactggggaggctgaggcagaagaatagcgtaaacccggggggtggagcttgcagtgcgctgagatcgcaccactgcactctggcccgggcgaaaagagcgagaccccgtctcaaaaaaaaaaaaaaaaaagtacaagtaaagacaaatgattttaagcagaataggaggttaagagaaacagcctctcatatttgagcacctctcaggatccacataggtatagaaacagagttcattagaagtttatgttgtagttctgggatctcatttacacaaaacacacaaatttgcaaacataaatatcaatgattcgggacctataagtcatatagaagtcagcttattgcaacatctattgaaatgaagcagttctaagatacttaagaactttttttccctctctgtaacggctgttttgatgcttttaaaattttctgtcttttttttttttttttttttctttgagatggagtctcgctctgtctcccaggctggagtgcagtggcgcgatctcggctcactgcaagctccgcctcccgagttcacgccattctcctgcctcagcctcccgagtagctggggctacaggcgcccaactaccatgcccggctaattttttgtatttttagtagagacggggtttcaccgtgttagccaggatggtctcgatctcctgacctcgtgatccgcccgccttggcctcccaaagtgctgggattataggcttgagccaccatgcgtggccaattttctgtcttttgaactaaacacttgtgcttaaattctcacccacgattgctctttctacactaaaatgtgaagatgtaggagcagagaggcagcatttgcagggagaccatgcatgttgtctcaatacaaggaaggctcttctgttgctccaggaaattagttgccctggatgtaggagttacctagagaagctcagacagaggctggaagataagcagtcaggtaggcaggtggctccagggggaccccctgtgtggggtggaaagctggaggtaaggatccggaaattcctggccagctctagatttcacaacaccacgttccccatgttcccggggaatattcacaagaaccctgatgccgatgtccaccccatccgtactgaaccaggtttgcacatcggtgttttcagtctacccgttgttaatacagcgactcctcgacttacagtgggattatgtctggagaaactcattgtaagttgaaaatatcacaagtcaaaaggcatttaatacctctaacatactgaacatcatagcttagcctagcctacttgaaatgtgctcagaacactcacattagcctacagttgggcaaaatcacatccaaaaaaagctggcaacacaatgcattgtagagtaccggttgtttgcccccgtgacagtgtagctgactggggattgcagcttgctgcctctgcccagcatcaaaagagagtatggaaccacatattgctagcccgggtaaagatctagtttgaaatctgaagtatggtttctactgaatgcatatcactttcacaccacggtaaagccaaatattgtcatagtaaagtcaaaccatcattgctcaaggaccatatgcttatgtaaaaatcccagaaaacaacttgagggtgtccactttgtttatgaggattacattaagtgtcgtatgttaacaaacattgacaaatgatgctttggggaaagaaggaaaactctgaaacggctaaatttcactaatattaccaatattaaatagcatagtgtatttggtaagagcataggctttcgattgataaggagccaggcttcatttccacacctatctaatgacctaaactacaggtgtggtaacagtgatgatggtaacagtctaaaatggcaacccagtagttcagattcaatgtgcctgcacccagcaccccctggtgttaacttaccctacagtcaacagttcttttcagggtacatgaatcctttgaaatataacctacaaaatatagattcctgtgtgtatgctgactacacgtcgttccattattttctcaccggcagaaagttcttaggaataatgtaaactcacttgttttcatttgtctatttcccctaactttgttttcatggtgacaggccactggttcctgacctgctatttgagacaatttatatgatcatcctttagcttctgcttcattcagtgataccccatttcctctattttcctctggcttttcttcaaatggtttatattttaataaaacgtggggtttgtgaaggtttttgaaaatgagacggttttcttatctttctctttccttttttgtttcaatcttaggtctgagcccagatctcccaacgacatgctttcatgaaacaataatgacgagaccgagtgaactaagctgtcttcagttttggagatgcagaggccaacactggcagttcctgacatcacttaagggaaaacaaagctaggggcaaaaatactaaggcagcctagatttgggggccctttgtatacactccaatttttaaaataacatctgggcatacttctcttttaaactcttcaatccacatatttttcattattaaaaagtgacttcggtgacattttcaaacactaaacaaacttagccatatgtccatttcactgactttccccacatcgtggtctctccttataagggatgggttccactcttgggctcaaatgttttgcttttctgtgtctgctcaactaacacacccctcctgatatggttaggctttgtgtccccacctaaatctcatcttgactgtaatccccaggtgttgagggatagagctggtgggaggtgactggatcaatgcagtagtttcccccatgcggttctcatgatagtgagtgaattctcacgagatctgatggttttataaatgttagtttttcccagactctcacatgctctctcaccttctctctcaggccatgtaagatgtgcctgcctccccttccgccatgattgttaagtttcctggggcctccctagccatgtggaactgtgagctaattaacctcttttctttataaattacccagtctcaggccgttcttcatagcaatgtacttcataatacacctccctagacacaccactcactcagagaaagctcagcatcatgtttactgtgtaatttctcctcactagtcatttgctatttatttctctcacatcatcatctcttcctgaactgatttttctactacctctgaaaataacagctcattagaaagtgatcagagattgagtgagcaattgaatataattacacaaaattatacagaccttaaaccagacgctctgctatgtgtatgagcctgggaaagccaaagccctgtatttcagtacccagtgctgctggaggtcactattgtggccctaaaagggaaagaggaaatgatccctggctgcaatgctcacaaaaactacttggatcctgccctagaaaaaggaccagagacagaaagggcagcaatacgtctgtcgcctgcacgacatgcactaaaagtcaacggctaggagagagagacgcaaaaacaaagcatcttatatttttctttttatttcaatttttattttagattcagaggctacatgtgcagaatttggctgatagagacaatcgcccggatttgctgaagcagggtgagttatccctaagaaaagcttacacagaagtggaagacagtttattatctaggagagccaccacatctcaaaatgtcaaaactgccagtgtgttcttgcacactgaaaccactcacaggtcaaccaactgtcttggtttgtccaggactctctcattttttttactgaaagtcatgcaactggttaacttctctgtccttgctaaacaaagatagtttgtctcccagcttgaagtcacctgagatcaagagatctactactaacacatcatagagaagcagcagaaatactacctatattttgaaatacaggtagtattatcattgatctggtggaactctgagaacttcaatccagaaattctcagagttccaccagatcaatgataatactatctatattttgaaatatatatatatatttgtttatatatgtataaaacaaaataaaaatttgtaaaacaaaatatatctatttgtttatagttatatgtttatatatgtttatatgtttatatatagttatatgtttatatgtttatatgttatatatatgtttacatgtttatatatagttatatgtgtatatatagttatatgtttatgtttgtttatatatatgtttatatgtttatatatagttatatgtgtgtatatagttatgtttatatatgtttatatgtttatatatagttatatgtttatatatgtttgtatgtttatatatatgtttatatgtttatatatagttatatgtgtatatatagttatatgtttatatatgtttatatgtttatatatgtttatatgtttatatatagttatatgtttagaagcagagccataaaaacaggaaaaccaaaacagaaagagcctcctatgaaaaagcacatttcaggggagaagggaggcagagtgagagcagagctgtgagcaaggccagccatgcaaaaggcacgcggctgaaagcccttggttctcaggcttcccgcccatctgagagatgcgtactctgtgccctgctgtttgtaaatgtcaaacatttaatgataaccacaataaatgtgcttggtcagcagtcctaaatatggaaaaagaaatcaacataaaacatctttggtagtttcttttccttaaaatcttgtgtcagaggaaagtacacagttaccactggaaacaaagtggttagggaactctacaaaacagaccactgcaggggaaaaaacaatgattttgagagtatgaattttcctgtgaggaacaaaaatgaaaacaatggtacgtttgtcccttccaagttcttcacggatgccagtaactaatcttcagagtaaatttggagaaattgttctgactatgcacacaaagaagctagagggaagaggcagtgttgctttatttactcagcgttgacctcccaccaccctcctccttcctctacttctctatcaatacttctggccttcctttgacctgttttggggcatggacttagggctgaggacagcaccaagtatctcgcctggatcctgccaaccctgcctcctacaaaaaggtcactttgagccactttgttcctttctctaggtctgtctctactcatgggattgttttcaagactaaatggaatgagcacgtgaaacgggaacctgccaaggctagacccttctgtgtcctattctgccagtcaagaaataaaatttcctaaaattttgtgtcttgccttaaaaacacacaaagccacattctttccataacaaatgcaagtttattttaatacctaattagggtgagaagctgcttggcaataaggagaactggtgtgccagcaaggtgtgctgtacagacctagttgctccctgtgcctccaaggtgagcacctggagattggaagggaagaggcccaggtgggatgggcagaggtggaggggaggatactgctcccctgacacacatgacccaacacggtgccatttccaaaatactttaaggccatgttgtgaagacaacaaagtaaagacataagacaggagccaagaagtgcagcctttgtatgcctgctgccttccagtagccgaggtactggcttctcctctccagccagacctgctctgctacccaccatggctactgggtgtctatagctgaatggccaatgcggctaatagggcttacatctcttgacagttgagcagccatttagggaaattagagacactgtagctcgaagaagaccatgaagaggaagttctactcttatagaacagagaagccatctgtgactacgtaataaactctcaggggtcagggtaggtgatcaggggtttttgagctgactctagcctatccacagcttctgactgatgctaatctcaaccaaagaatgccaagatattaatatgttcacagagaagcctcatgccactgatgtcatagaaataggtcacacataaggaacacccttggataagtgacatatcacacttacattggaattaatttccacaaaattccattgctgtccctaccttctaaatagcttctgaattatcatcagcacccacatgttcacactcagtgcctcgggggcttcaagatgtcccagaaccgcagccagcagcccagagtgtcttatctgaagaagggccatattgcctgtccacatgcatccttaacatcacatggaaagggggattcaacttcaacagagggaaaataccgccaggtgaatcactttcaactacacagaaggaatcacaaatgtctgcctccaaaacttcagagtcccagtttattttgtaaaattggactcttgtcactcctgtcatttccacacatgcaggtcccccagcatgaacgcatgaaccaacaacatgtacccttttatatcaactttacaccccagccaagagaagcttcatgaaaaacggcacataaagataactaaaacatgacttctcaaaccaaaagggtttaagtctagacgtaagccaaactctgtaaaccctctctgctaaatcagtcattaagatgtcatcctttttcctctttcacatatattattattgtcctacatttcatgtttcagggttttctccttagcctgctgtaagcatgtgctttgggagacagggcagaagctttggcactgttgacgctcagaaacggccaccctagatggctagtgatgctggggagtctctctggagacatcataacaagaatgccatggcctgaaacatgcttaccagccatcatccagagaagacaagacactgaaagtaatatcataaaatcttactaacataatcaagagaatcccatgtgatctactctgccagacattgctgaacttttgaccttcaactgcacctaagtagtttaagactctccagacattcattgactcttgcaagcttgcgtttatcacaatttagcttttcacaccgctactcaccacccaacacattattcattatgcaaaagtaatttgaattcatcatgcactggatttagcaaacttatctttaactgagtttcagattatttctaattctccctttagttcagagccatatgggctttgtgacacagaatgctttgaaaataatttcattggctggaacattcagtgggctgatgccacatttctttgaaaaaaagtctgctaggaagagaagtaaatatccccccacccaccactactgctattgccaggttcctccactcatgtattcatgtatttgctcattcattcactcattgaacaaatatgtgttgcaccctaccaaatgctgagcatcatacttgctgacaacagccttggcttcattggccctctgtgagacacaggaaagtggggatggacacaggttgaagatgacccaagtccgtaagcacaagcatcctttcagtgcgaaggagaaatgccaagaaacaacaagcagaaggggtgtaggcaacagaattattaaagacacataagcagggccatgttaagatgctcatgggtcctccctccccaaaaatcagtgttacattttatgactctgtaagtataaagacaaatacaatcaggctggattacatatgtttttccttctgattttaaaagaaattaaaacaattgtcatgggctccaaaacgtatcctggtttcagacactgaacttactgtgcctagcaaatagttggccccggctttggggcctcccggtcttccaccacccattaattgaacggcctttgtgcaaggtagctagctgcttaatgcctccttgtcttccttgctaagacgaaggaaatggaaatgaaagtgcctggtttagtgctcaggacacagccagagctctgcgtttccgcatctcctctccacaccaaataataacaatttgctctagaagacaatggacatccaagtgaaataaggctcaagggactgcagccgttttttattagttatccactagtaaatgcactaaaccaaagaagccccacttcaaggaacacagacaaacatctgtctctataattatccatacgccccaaatgcccctcctcatctcattccccctacttatcactctgaacatattctacaatggacttactcatcaggcccaacatctgtctcccctcacgggaatgccagctccacaaggtcaagggctgggatgttttgtttgctaatgtgttagcattcccaaacttagattagcatcaggcataacataagcactctgcctattcctcgttaaatggcatggatttgaaaattatcagaaacactagtttcaaaaacattaaaattcagtctttaggatattttgttcctttctataagaatttattctctacaaaactaccactcttgatctagtgtttttttgtttggttttttttttgagactgactctcattctattgcccaggcaggagtgcagtggcgcgatctccgctcactgcaacctccgcctctagtgttcttgatagtgtagataatcagtatgttttcctgtctcttcttctttccatttctgatacgtaaactatgtttgattgaagcatttagcaatgaatggggaatgcatgtgtaccacccccttcttcctgtatcaaattcttttctaagtcacaacatcttatctaaattttataccattctgacagtttcccaagaagcaaggagaaagagagcatattagcaaagttacttgtctatccttattaaagcacagtgtgttagtatggttcaaatatatatattttttttctttaagattgctggtctagttgaaaaaagacaatgaatttggattaatcatttccaatattctgattatacaagctaccccattgcctccaaaaaggagttctcccaggtcttagggtgttttttgtccttcccacagaccactgcaggcacagaaacactccaggctgtacattcaaggagatgcttaaggtatttatatgtggagacttatggaaaatacaaaatattaaaatgatattttcttcctcggggaatataaacttgtctccatttttatttaaaatgctggaagttatattgatttttattatagaattaatatagtcacatagtaaaagttttagtaaatacagatgggtagaaaggcaaaataaaaataaataataatcttacactttgagaataaaataccagcattttaatgtctgccctataagcagacaattttgtgcagtgggcagaatgatgtgagagaggccccaggagctcactcagggcaggctagacaatgagccaactggaagaagggggtcctcctttctgttaccacgagggctgtagcaggaggcctcttcccttggcagcagggcccacatattcccatgggcctcagcatctccaggtgctgggcagctggctgtcccagacaactccagtaacagctgatgcctaatcccagataggctgtttatccccctgcctagtagcatttctttggggcttacaagaagggagagtcactgggtgcaggagggtccctcaactggacacagacctacccactgtgcaggagagctggccccagggtgccttgctgttggatgatgtcaggattcacagccctttcattttcttgcttccatttattttcttccttacagtttattctttaacacatactgtgccacactgtggaatagacccttactcttgtgataaacagttttatgtatcaactgggtcaggctatagtttccagttatttgatgaaacccttatctaggtgttgctatgaaggttattgtgtaggtgtggttaacagctgtaatcaatttactttaagtaaaggagattgtctttgatcgtttacgtggccctcattcaatcagtcgaaaagatttaagaggaaaactgaagcttccctgagaaagaagaaaattgctcctgtgaactgcggcatcagctcctgcctgggagttctagccagccctttctgacagcctgccctacggatttcagacactctcagccccgccccatagttgctacagcaattgccaattcctaaaaacacttcaagcgcttcctcttcagatttctatctgtcccctatataacttactggttctgtgcctgtggtggaccctgactgacatacctcccttgtaccagagctgtatcagacctttcaggagcttcaattatgaataaattagaaatgacttctttaggtaaggtttatgaaacttggagtttttcctacttattttttgtgtgttcacactggatttcagatgtcaagagagcaaaatataaatttaaaatataaaaataatatatagaacatagaattagcaaacagcagaaaaaaaaatttgtggtatgaacgtaaggaagcaaggacaaatgtagtgaacaaaatgaatgccaaaagctgggatgagtgcaggagaactgaggtggatctctgcattccccaagtaccctgcagtggccttcaaaggctgagggcagtccattgatgcaaaaagagatctccccaggtacagaaagtcaagaacaggtctagagagcaaagagaatgccccagaaactcaaagagctggcaggcaagctgtaaagcagaaagagatctcccacagtttggaaagctggttactggtcagtaaagcacaaagattcaaagagtctggctggtgctcagatcccaagcccttctgaaggcaaagtgctgaccccaccttcacaccatgtgaacccaaggtaaagagaatctagctcaggatcctaactctgcaacagagcccagcacagcccagccacatgtcagattgactcagccccacatcaccagcccgacagaaggacagaaggagcatgtccttcctgcaagggcaaggtaaacattccttacttcaatctgcacacaatgtttagcataaaacagaaagtcacaagacacacaaagaaacaacaaaacaaggcccatgtttaaaagataactcattaacagaaacaaatatggaaatggcccagatgtttgatttatcactcaggaactttgtagctgcgatgaaggctctagaggaaaatactgacacgtgtgaacaggtgaagaactacagcatgggaagcaaacggtgaaagcaaaactcagatggaactatcaggacgtaactgtatgatactaggtaggaagaattcatttgatgggcttaatagcagactggacatagaagagaaaagaatcaaaggcaggccaatagacaatatctaaaataaaacacaaagaaattaaacatgaaaaaaataaaacaaagcatccaagacctgtgtaaaaatatcaatcaatataaacaattggaatcccagaagaagaagagagatacaggagaaaaaatattttaagagacaatagccaatattttttaagttaaggaaatacagcaaggtacatacccaagaagattagcaaaccacaacataagattttaaaaagttatttcaaaatcacacctaggtacatcagaggtgaaccttaaaagaaaaaaaaattgaaaagaaatcttaaaagtagcaagaaaaaatagcccatgttatatttaggggaagtatgaaaagaatgatggatgagttcctcacaatggaaaaaaaattcaaaatgctgaaaaaaaactgtcaacatagaattctacattgaattctacatttagtcaaagtataaataaaaaaataaaagctatagaagagagcaattcaaatattcttctcataaataaaatatgaatattcaaggtgatagatatctcaattaccttgatttgatctttacacttgatatgaatgcttcaaaaaatcacatgtatcctgaagatatggacatctaatatgtatcagtttaagaaaatgaaagctaagtaaagacattttcagctagagaagaactcagagatttttttagccaaaaaacctgtgctccaagaaatgcttaaagaaatgcaggctgaaagaatatcatacatgatagaagctcaaatctgcaggaaagaatgaaaacataggtagtataacatataggtaaaaataaaggacctacttattatatttaatatacatgtgtgtttgtttgtatacagacatacatgttgcataatatattaagcacatattaaaggttgagcatccccagtccaaatatccaaaatctgaaatattcccattttagtagagatgaggttttgccatgttggccaggctggtctcaaactcctgacctcaggtgatctgcccacctcagcctcccaaagtgctgggtttacaggtgtgagccactgcacctggcccaaaatctgaagctttttgagatccaacatggcattccaaagaaatcctcattggagaattgcacatttcattagggatgttcaactactaagtatataatgcaaatgcaaattcaaatcctaaaagatctgaaatctaaaacatttctggtaccaagcacttgggataagggatactcaacatgtgtgtgtgtgggtgtgtgtgtgtgtgtgtgtgtgtgtgtgtgtttgtgtgtacatatatatgcatttcagcacaaccagtagcaatgtgttataagttttatagaatacagtgaaacaaaagaatacaaagaatgagagaatagaattatataattgtgatagtcttagatttttttaaagtttagtataattgaaaattagactatgatagttaagtatacatactgtaatttctagcaaactcctaaaaaataacacaaagtatatttaaaaagttaattgctggattatgcaaaataaggcaggaaataagaaagagaaacaaatactggtaaaatacttaaatacaattgtattgataattacattaaatataaatgaaataccacttacatactaattaaaaataagattcaaataaatgacttttacaagaaacacttagagcataaagagatagatatttgaaaataaaatgttgaaaactgacatactatccaaccactatgcatcataaatctcgacggctatgtttatatctgaccgagtacaattcaagacaaatagtaacccagagagaaaaaggagtatattctaatgctaagagtcactccatcaagaagaagtaattatcttaaatgtgtatgaacctaataaagagattcaaaatgcatgatacaaaacttgacagcactaaaggaagaatgttgcttttgaaaagctcacattcaccatggaagattttaatatgcctctcattataactgataaaacaagtagaccaaaaatcaaagaacataggagattttaatactgtcaacaaaatttacataattatctctaatagaatactccactcaacaactatacactacaatttcttgagaagatcacatgaaacacttgctaagatgaatcacattctgcaacatgaaaaattccccagcaaatcataatgataaaattcatataaagtatgatagctgaaaacaataatattaaaatcgatcccagcactttgagaggccgaggcgggcagatcatgaggtcaggagatcgagaccatcctggctaacacattgaaaccccgtctctactaaaaatacaaaaaaattagccgggcgcggtggcgggtgactgtagtcccagctactcaggaggctgaggcaggagaatggcgtgaacccgggaggtggagcttgcagtgagctgagatggcgccactgcactccagcctgggcgacagagcaagactctgtctcaaataaataaataaataaacttgaaataaatgaaaataaatagctttaaaactactcaaatatttgaaaattaaacaacatgtttctaaacagatgatgacctatagaaaaaccacagggaaaaataaaatatattttgaattgaatgaaaatgaaaacacaacatatcaaaatgtgaaaggcagtgaaggtggtgcatagagggagattcatagctttaattccctatttgaattgaaaataataagttgtaaaacaaaaagttttagcttttaataagctaagaaaaacaactaaaatataagaaaggaaataataaaaacagcagaaataaaatgaaaacacataaaagaaaattaacaatgtgagaaatttgtttaagacagtttaataaaattggtatacttctagaaaaattgtcaagaaaaaatgaaaagaatctatatcagtaataaaagtagtagcatctctccaggttctacagatattaaaaataagggaatatcataaacaactttatgccattaaagatacagccacttatataaaacagattcctttaaaaacgcatcttatcacaactgatgcaagaaaaaatagaacatctaaatagcctaatacctgttacagaaatggaatttgtaatcagaagccttcccataaaataaaacaaaaacataaaagaaaaaactcctgactagatgtcaatatctaaggaaggcgtaataccaattaccaatccttcacaattttttttttaatagaggaggagggaacacttcccaaatgactttctgagactgcacgacccagatattaaacctacaaaaaacattataagtttaagaaaaaagaaaaatatcccttatggtccaatacacaaagatctattaaaatattagcaattggatgctataaacttaaaaagaataacaggtcatgaccatgtcaagtttattttctaatacaaaattggcttaacattaaaaatcagtcaaaataattcatttcattaacagattaaagaagaaaaattatataactatctcaatacatgtagaaaaagcatttgacaacattcagcttcttttatgagaaatactcaaaaaactaagaataaaagagaactttcacaatctgataaagggcatttacagaagatatacaaataacatgatatctaacactgaattattggaaacattccccttagggttaggaacaaggcaaaggtattcactcatcacttttagtcacttctaatcaatattcaacattgttcaagaagtcttaggtagtgcagtagggcaagataatacatttcaaaagccaaacaatgtcaaaaaagagaatcacataaggtgcctgattttttttttttttttttttgagacggagacttgctctgtcgcctaggctgggtgcaatggcagggtcttggctcactgcaacctccacttcctgggttcaagggattctcctgcctcagcctcccaagtagctgggattacaggtgcccgcccctgcacctggctaaggtacctgatttttaagactgcaataaaacattagtaatcactaccatctcaaaacaattatacaatttgatttctagaacaaccatattgtcaggcctctgagcccaagctaagccatcgcatcccctgtgaccttcacatacacactcagatgtcctgaagttactgaagaatcacaaaagtgaaaatggcctgttcctgccttaactgatgacattccaccacaaaagaagtgaaaatggccagtccttgccttaactgatgacattaccttgtgaaattccttctcctggctcatcctggctcaaaaagctcccccactgagcaccctgtgacccccactccggccctccagagaacaacccccctttgactgtaattttcctttacctacccaaatcttataaaacagtcccaccccatctctgttcgctgactctttttggactcagcccacctgcacccaggtgattaaaaagctttattgctcacacaaagcctgtttggtgatctcttcacacggacgcgaatgaaacatatataattaagacagtgtagttttggcataagacagacaattagattacgggaatagaatagagatctacacatatacggctctttttaaaaatcaaggtgcaaagccaattaggtgacaggggatgaaagcctgtttcataaataatattgtaagaatcagataaatagatggagggaaataaaccttgagtccgactcaactccttatgttaaaattaactagagaaaaataaaagaattaggcttcatcaattttttaaatttgctaattgaaaggcatcactaataaataggtaggcaggctacaaattaaaaacaaaatattatacttgacaaaagattcatacccaaaatatattaaaaaaaaaaactcttgcaactcagtagtaagaaggcaacccaagaaaaattaggcaaatgacctgaattgtcacttcccagaagaagacatatcacgtccaatgagcacatgtaacagcatcattagtaattagataaagacaaatttaaacaataatacaataccatctcatacacactatattggttaaaatttaaaatactgttgggatgaaaagttggagagaatatggagcaacaagaactatcatacatttctggcaagagtttaagtggtaccttttagaagttttataaagttaaacatgccatcccacttagtatttccccaagagaaatcctaacatatgttcacaaaaaggcttctacaaaaatattcataccagcctttctcctattagtcaatccctggaaacagcccaaaagtctggcaacagaataggaaaaatgtttagaaaagaaacaaagttctgaaatcagcaacaacatgtgtgaatttcagaagtattataatttaaaagaagaaatcagatacctaagaatacataccacttgcttctatttacataacaggtaaaactaatttgtgttcaaatcagaaaggattgcatctgggttgggtgcaggctgggacactgataattatgggagcaagggaatcttctttggggacagttaactgaatgttctacatcttgttttaggtggtgtcaacttgggtgtcttccaatgacaaaacatattaagctaaaaaatgatcagtgccttttattgtatataaattataattcaaaaaatcatttaagagaaaccatgagtttctgtttaacacaggagaacagagacaagttaagatagtggcagaatgggagaagacacctgcaacatctaaaatcaacaaaatttaatacttataatatatatatagaactcctgaaaaatccaacagaagaagacaggaagccccataggagcacaatgaaaagatataaatgcgcaatttttacgtaaggttcaaataaattatttcaaaactcctagaattaactaataatcataaaaagggctaagatcacgaaatatctttttatacctttgcatctatcaacaattagcgttgcacccaggcgagttagagaaaacgccacactttgagacgagtatacatatgtaacaaacatgcacgtcatgcacatgtaccctaaaagtataataacaataaaataaaaaaaaaaataagatgcaaattggaaagggcacgagagggtatcttagtgaaaattctatgtgaatttatatatcataaatttataaattaattcatccattcattcatatattatgaacaaaatatatgtaatgatatataaatgaatattcatttatttatgtattatatattcattcaccatcccttattatggagaaatttgaaaatataaaattatttactcaaaagctttattaaaaaaaaaaaaaaaagagtcctttattagccggcgaccaggccgcttccctcttaccagaaccagaacaaagtcaaatctgacctacctgaccccggggtgagaagctgaggactcagatgttgaattttagggcactgacacggtagtcgatccgctctcctccggaagacggtcactctttggggacctgaaaattgtttcctcaggtggcgcccccctccgagccggctgtccttccgggggagcccggagcgagactggctctcgcccagtggcgttaatatcttgctggggcctccattatgttgtatccaggcaagtcagagaaaacgccacactttgggatgaattaagagtcctttattagccggcgacgagagacggctaacgctcaaaattctctcggccctgaagaagggggtagattttcttttatactttggtttagaaaggggaggggggtctagttagaacaattttacagaagttaagtaggcaaaaagttaaaaggataaatgattacaggaaagtaaacagttccaggtgcaagggctttaagactactacaaggtgatagactcggggctttgggcgttatcaatcagacgaaatcctgggaactgcggatacagctcgccacagtatcttatcagttaattgcattcttggatgtgctgggagtcagcttgcacaagttaagtccttgaggaaggggctgccagtcaaagagccaagatggagtctatctggctctcttagctaagggagaatcaattcaggtggaaacaagcctaaaaacagagttagtaaaaacaaagttgggcattacattagaaaaccaggtatttgcaaggattggtgagtatataggaacagaagaaccctcatgcactgagaaaaatagagtgcaggctaacaccgtcacagcctagaggtatccggcagtatctagttaaacccttctgtgaatagcccagagacactcttacacaccttcagaaagggacaagttcaaggatgttcactgtagcaataggaggtgaagtcagttgggcttctgggtagggtggggacttggagaacttttgcatctagctaaaggattgtaaatgcaccaatcagcgctctgtgtctagctaaaggattgtaaatgcaccagtcagcactctgtaaaaacgcaccaatcagcactctgtaaaacagaccaatcagcactctgtaaaacggaccaatcagcactctgtaaaatggaccaatcagtgctctgtaaaatggaccaatcagcaggatgtgggcagggccaaataagagaataaaagctggccactggagccagcagcagcacccagcgtgggaccccttttgcactgtggtacctttgttcttttgctcttcacaataaatcttgctgccactcactttttgggtccacactacctttatgagctgtaacactcactgtgagggtctgcggcttcactcctgaagtcagcgagaacaagaacccataggaaggaataaattatggacacagcaagatgtatgatggggttgttggtcagttttagaatccatccctgggaatggggatacataaaatgtgcagtatagagaccatagagtacagtgcagcagttaggtgtcaggaatttaattttcaagtgacatggaagagttccagaaacatagtgtggatgaagatgaaagatgtataatacaacttgatgatgtaaattgaaacccacatgcaaacaaaacaacaatatgcattgtgcaaaacacagaaagatgcacattagcacatttgtaacgacagagggaggtagagggaatgggctatagggatcaaaggaaatcaacataaccaaaggggaacaattctcacacagaccacagcccaccacagaaagcaagcaaaagacctgatgggtctgtgtttttttggatcatctgaaagcaacaatacatatgaagttcagaggtacataattaaattataataaattaatttggattctgaaagcagatccaaaaaaaaacctcaataaaacttcagagtagacacagaagaaaaagaagcagtgaggaaaaaaagctgatttgatgaaatcacccaaagcataacacagaggggtagaggtaggcaatatgaaagaaaagttaggagatatagagaaaagaatgataaattccaatgtctctttaataggagacctggaagaagacgaaagaagagacaatatttgaagagctaaaatctgaaggagattctagaactgacaaacagccagaatccttggattctagaaagattacaagccaagcaggaaagaaacccatgtcttgcctatatgaaactacagactattacagagccagagaaatatattccaacctatcagagagaaaaagattactgacaaagttaagatcgtcgctagaaaatcattacaaaaattctgaaggaaaataaatgtcaatataggattccatctccatttatgttattagtcaaaaattaagcaaaacaaagatgttttcagatataagaataaaagaatgtactactatcagaccttcaccacaaaaaaaagtgaagatttttctttggtactaagagggtgtcacactcacatgtgggatgtcacgtagaaggtgggcattcagccattgtgagccacgtggtggcccagggtactcagctgatggtcaggcctctctcctgattggctagggtccgtgctacacggatcttcacttcagatcatccaccagaaccaatggtgaataacagattctagatctaccttggagaatccaactttaccatgtttaattttttttttttttttcctgagacagagtctcgctctgttgcccaagctggagtgcagtggcgcgatctcggctcactgcaagctctgcctcccgagttcaagccattctcctgcctcagcctctcgagtagctgggactacattaaattaacttttaaagactactgaggcctggtcggggtggctcacgtctgtagtcccagcactttgggaggccgaggtgggtggatcacctgaggtcatgagttgaagaccagcctggccaacatggtgaaaccccgtctctactaaaaatacaaaaattagccaggcgtggtggcgggcgcccataatcccagctacttgggaggctgaggcaggggaattgcttgaactcaagaggcagaggttgcagtgtgccaagatggtgccactgcactacagctatagcttgggtgacagagggagactctgtctcaaaaaaaaacaaaacagactactgagaacgttaaaaagaaggtagattttaaaattgtaattaaaagagcatggaaagtagaaaaaaatcaatagaacttatataaacttccacaccagtagaagaaataaaggaaatagagaatcatctaatggggacaggaaaggcgggtgggctggaagacaatccaagaccaaatgcagtaagtggaaaacacccaatgtaccagaagccaaaggaaaaatatatgtacctacatgactaactaaagaaaaacaataacagattttgaaaagtatcttgtggagcatagctatggtgtttattagaaagaagtgtataggtttaaatgcatttcttttttgaaaaagaaagactggaaacaaattagctcaatattcaatttaagaagcgagaagaatgcagtaaactgaaaggacttcgaagaaagatgataaaatacaaaacaacaaggaattgaaaatgaaagctgtgttttgtttttaaaaagacgaataatatagtatagaaaaacatctcagcaaaacacaaatgatcaatgggaatgaaaaagaagacaggactctggataaagcaggtccttttaaatcgtaagagaatcctttaaacgaagaagcatatgtggtcctctggcagaagctggggaatgcgctgcagcctcaaggaggtggcgggaaacctagttttagtccccaccctcaggactgagaccaccttttgctagttccatgggctgagcagctgtttatggcactttgtgtcaatctctgagccagaagtgttcacctaggaccttttataaatcttatctctgaaactggtgaggtatacactctcatccctgttttacaggcgaagaaataggggctcaggaatgtcaaacagcagagccaggtttgcttagccagttagtgggcaagccaggtttcaaacccaggtttgtcttattccaaagttcataatcctaaactgtagcaactttctcacttcctcccaggtgtgagaggaggggagtggggatggggacagaaactgggagaaagtgtgaggtcagcattgacatttttcttcactctttccaaaatacgactttctgcttttgccagcccagcagaagctatttttcccactgttaggtgggcacatttgctacccaagccttccaggggacacaggtgttagctggaaacagacaaaaaggcattgagtttggtaattcatggctacgagtttattcttactgcctttaaagctatacagtaacattttcatatagaagaatttctttcttttaatttttccttgtaaaaaaaattaacaaagtaacgcaatcaaacatattttcaattccaaagtcaaattgtatcctctaaggataccataaaatgtaatttatttgatctgcttatttttaattcccagatcccatatgctagggagattagcaaatactagtgaaatgtggttgagtcacaaggtaattactttagataaatgtcattctgcagtttaggattatggtcctaaagcccagtatttaacggtacctgattaagccctactgggattggctatatagtcctggggactgtgtataataaaactctataaagtaacatccataaatcagttcttcttcatatattccagtggttgatttcaggcctaaatctgcatcttgctgaagtgttacaatagtgtttaaataatgagaatacttattatttttaaaatgcatccaaaaacacctatatcaaatattttcacggtgagtttcggtttgcaggtttttaattttctgtgagtccaaaaatgggacaaaatatacaaataaacacatactcacatacacagaaaccagattcagagaccaagataactaacagtcccagccgaaaggatcaagagcaacacattcttaggttatgtattataaatatatacacatagtatgtagtaaacatagcttttgtaacaattcccaaaaagtggttttaaagttcaacattaagcatacaaggagagatagcaaattagagacataaacacacataatacatattccaggaatttgcagtcactgggattctgtacatatactatgtacataaagataagacctggagaaaatgagctctggttagagagcatctgcgttttactaataagtacttactagaagttgagatgatattttgaacattgccttactagaagcaagagtgtctagaacacagtgccctatatttggaaacactaagtgaacagaacccatcccctgggccagatggagcaatagatttaacctagtgggaactgtcctttggtaaacaaaggaattgcctttatatgtactgcacactgatatttgagcaatggaaaagcaatccgatatttgcaacagactattaaagtcattactagatgagagatgaattaaacttaccaaaaaattttaggaatcagtaaaaaaatatatatagatcaaggatgactgactatgaatgaactattgaagaaagatcacttcagaattcaggcaagtacaaagtagaatcacaaaaggatgtttagaaaaccagtactgaagtttccaagagatccattttataaatgtaaggcaaaagaaataaacatcctgggcacagccagcaacgcaaaggttaccaggggccagtacacattgtaccatctgaagcactcactgctttttctgggttgaggacagattatattaacaattccagactgggtttgatttccattgatttcgtatctggctgttcaatttccagagagttgtatttgtggtatatcaactttcggaactataacccacaaacgaacccacagacacgaatatgcttctcggcctggtacatggaacacgagctggtcctctgccctcccttcttccaccacacctgactctgctgtccccacctgtctcttcccaccctcacctcaactttaagggacctcagacctaccaggggagtgggaaggaaaaaagagaagaggataaagggagagaaaatgtcctagtttttaaaaaatgccagtttccttttggctggaaaactggttcagaaggaaattccttgagtctttcaaatattcaaggaaactaataaacacccagagtgaaccttaatatacactatgtccactgggtaataatgatctttcaaggcaggttcattgataacaaatgtaccactcttgcgggggatgctgataacaagggaggctgtgcatgtgtgggatcaggggtgtacaggaaacctctgtaccttccactcggttttgctgtgaaatgaaacctactttaaaaaataaagtctattaaaaaaaaaaaaaagcccagatagtaaaggatcaaagtgagtaaaattcagtggcgtttttctgtattttgaaaagcatgatacctctgcattaaggaatgaggcaaaattgccagtgtgcttggaactatgcccccaaaaacctgtaggggaaaacaattctgtatcagtcagaaaagacctcatttgatccccacttcccatatgtgccatggaaaaatccataagaaaagaagcacagagaagctgatattcctcccatgaacttgcctgttggggtcaggttccgctccttggtgttacacaggggcacaggcatagctcacctgaagcaccagtaactccagtttcagagccctagttacctcatggtagaagtaaccaggtcaagcctaggtgataaatgaattacatatattttgcaaatccatctgcaagtcagataaaaggaaccttggaattatctcaagatgtgaagctggagtgttatcagaatgacaaggattgagatcaactttcatctcagaagcgtcggcagcagggcagtgaggtgctagaaaaagcatagaaatcaggaagaatcgcagaatggaagaatgaaagcagagggtgcccatggcgatgtgcggagagctgcagtctgcgaagtgcttttacattcatcaacatcactgttctcatcacacctccctccctcaaagaagcagcagggactctgcaaagtcaggtcagcagggcccaaacatggcagctccctggaagccctgaagagctctgcacagttaccaggtcctgcggagggggttctctcggtccaggaagcgctgtaggtgggagctatgaacctgaaattgtcaaaaatccatcttggtgattctgatgctccacagatacaagaacactgatacagtttggatgtctgtcctctccaaatctcatgttgaagtgtgaccctcagtgttgaaagtggggcccagtgggaggtgtttgggtcataagcgtggatccttataaatggcttggtgccgtcttcacggtaatgagtgagtttcagctctattaattccagagagagtgctcccaagagctggttgttaaaaagagcctggcaccaccctcctctcgctcttgcttcctctcttgtcatgtgggaggccatgtcaccttgcctttcaccacaagtagaagcttcctgagggctcaccagaagccaagcagatgctggggcaatgcttcttgtgcagcctgtagaaccgcgagacaaatcaacttctttttttttttttttacaacttacccagtgtcaggtatttctttacagcaatgtaaaatggactaacacaagcacaaaaagggttggagagatgggaaatattggagctcattagatccatgaagatactctattgagtgttaaagaaaaatgctgcgtgaacccgggaggcggagcttgcagtgagccgagatcccgccactgcactccagcctgggcgacagagcaagactccgtctcaaaaaaaaaaaaaaaaaaaaaaaagaaaaatgcttaaaagaacacatatgcaaaagtttacaagtggtaatagatctacaagtcttttttaaagcacagcaaaatacatgggcaatttcagagaggatctattttttcttgtttaatgctgaatgaagaattattccacccacctctcagcagtagtgactgaccaaataagagggtgttacggtttggatatagtttggcctcaccaagttgtaggtcgaaatttgattcccagtgttggaggtggggcctagtgagaggtgttttggtcatgggagtggatccctcatgaatggcttggtggtgtttttgcagtaaagaatgaattatttatctactagttcccatgagagtgcccctgagagttggttgttaaaaagagcctggcaccttccctgtgctcattttgtttgtttttgtttttgagatggaatttcactcttgtcactcaggctggagtgcaatggcactatctcagctcactgcaacctctgcctcgcaagttcaagcgattcgcctgcctcagtctcctgcgtagctgggattacaggtgcccaccaccacacccagctaatttttgtatttttagtagagacagggtttcaccatgttggacaggctggtctcaaactcctgacctcaaatgatccatccacctcagcctcccaaactgctgggattatagacatgagccaacatgcctggtccgtgctcttttgtttctgttcttgccatgggatctctgtgcagtggctcccctttgccttccactgtgaacagaagcagcctgaagcccacaccaaaagcagatgctggcaccatgcttcttgtacaacctgcagaaccataagccaaatgaacctatttctttataaattacccagtctcacgtaatcctttacagcaacataaaagcagactaacacagaaaatcttgtttgactgttctgtgtcccagagacagagttgattaaggaaaatgacaacactgcatcttgggaaagagtgttcagaagcaccccacccaaagctgttatgaaggagaaggatgtttcagcccagcgctcctcaaacttcatttgcataataatcactagaggatttgttaaagttcaattccgattcaggagatctgggtagagcctgagattttgcattcctgaccagcttccaagtgatgctgacagtgacagacagccttaaggtgcaagatatttctggtgacattgctgtatatatttccaagaaggtgcgagaggtgtggacaaagatccatgcttgaaacccaacttgcccaagaaacacatggaacactaccctgccatgtcaatacttacgcaatcctcagtttgtttctaaagcaaatttctgtacctaacaacacaatatgacagtcttaatagcatataattagacaacagaagaaggctggactctaagtggtagcaaatatgaacatttggggcagtaaccacatcacacagcatctaaaaaggaaaacaaggcactaattccagatacaaaaataaagaagagcagatgagtaattcaaggagtacattagaggacacaaccttttcaaaaataatttttaaatctagtaaaattattatacttaaaataatcttgtgatcaacaaacatacaaaaaaggctttgggagcgaattaatacgtgtaataatctcatcaatgaaacaagggtccattggagaggatatgaaaaaggatatgtatcagagacttttaactgaaaattacctcaaaatcatctaatttgtatctacccgtatttctgatgagaacactagggtcatgtcttagctttaagcatctaattttcatgacaaaatctgggttataactcacataatcacatatttttcccaatacaatgctaatccacacactgattttagtgagtataggttaattacagcatccattcatgttggaaaatgtttattaagttttatacaattttttatcacatcagttaaagaaaaaaatggtgtgtaccccgtaactggctgcattaccaaataagtgggaatgcatagtctttatcacaaaatgttgtttatcatttgataaatccttctcaaattttaagaatgcctttcaataaacatcatctctacttagcatctctgtcattgaaattttatgaaaagtataatcatttaaatagtaagagtaatttttttcagtgatgctgcagcacaagttttagcccaaataaaatatattgtaaaggtcattttctgatgtacaagccagatattcttttttcaagcacttgcaaagcctttgggtgtgagctggagttgaaagttaaacatcaatttgcatttggtttaggaaatccttgtcaccttttcatgaaatttcagctgtctcagtggatttggcaagatcaaagcccagcactcagtcagccccagttttaatccctgccaacagtcatcatttgattcttgagcacaaagagctactactggtgcactgctgcccacagtgctatgacttcatgcggccttgttttcacctgcttccattcagctgggtgcatggcttccaatattgcagagatttgcaaaattggtacaaggagaatctaaactgcagatgccttcagctgccaggcatggacttaaaggcgttcctgatccacatgactcaggattacagccacagaccttggcgggcccctcagctgctctgagaagaggcaggatctacctgactccaaagaacactcacttacaattgcattacctacccctctgatattaggttggctcaaaatcatggattttggcattaaaaggtaatggcaaacatcacaattacttttgcaccaacctaatatatactgtcatatattcaggaaaaaattactttgtgaatgtcacatggttaatatcaacattagtcagaacatctaaagggggaatacccttgtgatgaatcttaaataccgagcaggatggcaaaagtctttataataaacatgaacaaatgcagtaagtttcagcaagtggtgatgaggaaaaactgtggtgaaatggacatttttagagcaacagactctccttgttgaaagcatggaggctgtttacttttgttttactatagattcataaaaagtgatggataaaaatggttgtttagcaaagtaataaataatgataatctaatacaaatatttagtatggaatgctcatgaagattctagtttttcattctcccatgacctagacgaaagaaaaaaagacaggttgttgtttttctttttttctgcatgtattattcaatttgtaaaattctacatgtggaaaaacatttaacaagaaaactgaataagaacaaagggaattatgttgacagaggaagaaaaagaaaaactttattctcattgaaaagaaaatgcaaccatttatgtgaagcaaaatgaatcacaatcaatgatcagtattctgtagccatattttcaggagctggatttttcaactgattaattaggaactcaaactgtatgtgtatgaaaaaaagtagactggggcaagttatttcctgtgacaatcccagccgtgctaccatatccctctccacttctctgtcttgttttccaaagaccatgaaaataactattattcacaacgaaattgcaatcaacaagtcacttttttctcatggggaataatcagtgaagaaacagcaacccaccctgcagctctcacctccaaaatacaatttctatgctttggcagccaatacagtacaattaatgtttaactccatgctttctatctaaacaaaatgaaataataaaaactaataaattagttcgggcacagtggctcatgcctgtaatcccggcactttgggaggccgaggtgggtggatcacgaggttaggaatttgagaccagcctggccaatatggtgaaaccccgtccctactaaaaatacaaacattagctgggtgtggtggcatgtgcctgtaatcccagctacttgggaggctgaagcaggagaattgcttgaacccaggaggtggaggttgcagtgagccgagatcacaccactgcactccagcctgggcaacaaagcaagactccatctccaaaaagaaaagaaaaaaacacacaaaaaacaaaaaaccaactaataaattaccacccttttaagatataaggtatcataactaaggaaagtgagactagaagcttggcatttttgaaatcatctttggcaatgtatatgacatcaaatgtacatgaatagtgaagaatggagtttgcaatctagcatgtgcggtcattacaaaaccatcctcactgctaaacttctgcacacaaactatttgagaatattagatttattacactgctttgtcctctggtagcttatgtctggataacatagccaaaaattatgtacaaatgaactggctcactttttttaatctgtcactccaagttaacactctcctctcctatcactcagcagtttcttttaagatgtaaaaataaatttaaacctaataactcctcttcctgagaactgaattggtagatattgtgtcttcaatcaatgggaattagtaggcagtttccgtcattttgtaagaaattccaaacactgaatatgaatctccaatgtaactaagaaatagacccaaagtgcaacaggatttttacccacagggaagaccaagcctaggctcaaaggcctagattcatatcccaggtctgcgacttacatggaagtatgtaaatataaaatattaacatgatatggacaatggcactttgataaatgcaagattcgaatatcccctatttagtgctctatcattaggtccactttcttaacccatgcttgggccagaggggcacattaatgagccatggagcccctgcaggggttctgccccatgcatttacagctggaattaaatcccatctccaccactctgctcccagtgtgaacatggggaaagttgattaaactctctgacttcagattcctcatgtaaaatgtggggaaacagctctgacttaatggtgtcactgtgaggagtaaatgaggtaacatatttaaaggattttgtatagtgctggtgacagtaaccagccaatagatgatatagctagtaatagcaataataatgtcacttactattactttaaaaaataaatctcaaagtcaaaaatactaagaaactaacaagagactatacttgggtctcccttttgtaacttttgaacattatctcacttctgaaagtcctgtaccaatattatcctcctcatttctcaggtgaagcagcatcttagaggggtattgccctgtctaaaccatctggttatcatggtgaggtccaggattcttccctttcctcatctttgccttaaaaacatgtattctaaccaactgccttagtttgtccaggctgctataacaaaatgccatggcttattgatatggtttggccgtgtccccacccaaaatctcatcttgaattgtaatccccattatccccataatccccatgtgtcaagggagagaccaggtggagataatggaatcatgggggcagttgccccatgctgttctcgtgatagtgaaggagttctcacgagatcacattttttttaggtgtttggtagaacttcctgcattcaatctccttcctgccaccttgtgaagaaggtgccttacttcccctttgccttccatcatgattgtaagtttcctggggcttccctagccatgaagaactgtgagtcaattaagactttttcctttattaattacccagtctggaaacagaataatacacttataaacaacataaatatttttcctcatagttcaggaggctgggaattccaagatcaaaattccctcatcaccattgccaataaagtactgagtatccacctgttacctaaacacgcaatactagttgttatataaagccatttgttaaaagcctccttaccattcgatataagtaaagaggaaaattgtatgttaacttgttttctatcccagtatgacagacatttgaaacagataaaaggagtgtacttgtgagggtatgttatattgtgtggaatagaaagtgtccactagggttaaatttcttggaataattctattaaaaatgagtttggaaagaacaaagtgaggtaacaaggtataaatatacataaactctagggttgttcccaagaagtggtcatagttataatagggacaaactgaattctaatttaatatttttcacttcaatcccttaaccatatgccaagtatacgttggcaatacaaatggcccaggctatttggagaaaatgcattcgatttctaatagcttaccaataatatgtattagcttgttggacccattttacaaatgaaggaattatgtgtcatagaaactacattatctgcccaagaattaaagagcaagaaagggacagggtcttactttgaccttagccaggactctcccccatggcccagctgccttctggcattcagaattgctaaatgtgtcacatttaagaaggtagtctacaacatcctgctggcattcagaattgctaaatgtgtcacatttaagaaggtggtctacaacatccaggaaggcagtaataccccattaaagttttagagctaagtacaattttgttttctttttcaatctgacttttgcatatataaaatgttaaatttttcaggtgagaaattactctgataatgcaattagtctgtaaggagtttaggtagttatcctaaggcaaggtaacagtaaggatacttcaaatacttgaaatatctgataaactatattaactcaatatctatcaaatatcacatactcatatgagcttgtatgtcttatttttaataagttaaagagactcaaataggaagcaaaaggtcaagttattatttggttttggacaatggcttcctgctccaattgaaataaaatgtaaagacctcgctatcatttttaaggtgtagtggtttcacccctccctgtctctcccacttcactgaccacttccttaactgtccactccgaaacaccccttcttcctgttcttccaatacaccaaactctttcttgcctctgtgtgcttgcccatgctgttccttctggcttcttccttcacattcaagtcttgacttagatgtcacttgccaagggagaccttggagaacccttcctgaccatctcatccatcaccctcaccccatgtcatctctacagcatcactctgggttattttcttcaccgcacttgtatcaccatggattatatgtttattgtccttccctctcacagaatataagccccatgaagacacagatcgaattctaacttattgctgtccccagcccttaagagttcagaagaactcacaagcacgcacatatttgttgagctaatgaattgcagatattgtaccagtgattaaatggaaacgaggttttaaaagatgcaaaacaaaatacatttgacgaagttaaatgtttgaagagccaaaatagtttctggattagagttcaaaattagtactaaaagtattttctgccctaaactgaagtgtggtactgccttagaaacctgttaacttaaactacactatttaagagttaaagcatatgttttatatattggaacttcacaaaaaaggattttttaatttttttttattaagtctgtgctattaataattcttgaaattgttggtccttggaataaaggccaaactcctagacttatgtcatggttttgtagcctcaactatcagcattccaatccttcaccttttcatgatgtttctcttttttttttttcctctgtttttgagatggagtcttgctctgtcgcacaggctggcaggcagtggcatgatctcagctcactgcaacctctgcctcctgggtccaagagattctcccacctcagcctctcgagtagctgggtctacaggcatgctccaccacaactggttagttttctttgtatttttagtagagatggggtttcaccatctttactggtgaaaccagttggccaagctggtcttgagctcctgacctcaagtgatccacccaccttggcctcccaaagtgctgggactacaggcatgagccactataccaggctatgatgtttcaatattataaaactatttaaaattatctgaaagcatcatgtatcatggtcatgagttcctcactgttattttactattcagagctagaatgctcagtctgagccagttcagcttactttacacacaggaaatggaggttgaatttccaagcgaccgagtgatccatttctgatgttcatcagtaagtcagacttacatcttaaatagctgctaacatttgctacctatctacagatgttttccgctaaatctcatgttccaaaatagaaggttttaatcgactcctatgaacacaggttaaatagcatattttgttgttgttgttttcgtttatgctttttcagaaagttacttaggtccattcatttatccccctatatttgaaacaaaattctgctttcttacaagccccttttcagttaatctcaggtggctatcatacttaaaattgtggagaattattttcatccataaggcctgtaggaagatgcccctacctcaaaacttattgggataaagtcaaaaaagggtcatcctcttaaaggtaaaacaggaaaatattaatcaatcctagatttggaacaataatacactgtgcaatagagtctggacatgtgtggctggtgggtggagattctgcaaagccatgagtccctggaaggtaaccagcagactaattttacagtgtgacatagcttatcacaatagcggacaggaacctgggtttaaagaggactcacttgggcagtaatcctggcctgtcgtttcaggaatatgaccttgggcaagatacttgtattctttgaatctcactcttatcatctgaaaaataaaaacactaacgactgtctcaagactgctgtgagtattcaataaaataacagctgtcaggccattagttagcacaatatttggcacagggtagggggtaataaagagtagccatagagataatgttgggatgatggcctaaagaggatgctggagcacagttaggtgtgaacagagggtcgcatgccataatcataatcaataacttgtagataatcaataacttgtatgtagataaaaacttgactgtctacagtaacagatgtgggctctcaactgggtccagcaaatggaacaaatgattgtgtttttggtgttactcaggggaggggaggctgatgccaagacagtaacctcagtctttgtagagggaaccccatatgctaaagagatatcgcttgagaatgtttcatgctcttgagcccaattctatgtgctccctgatggaaggacaggtaggtattgggtgaggtgagcaaccaacacttactgggtgcaccttcaaataggacaccttctgaagtccccctagcccaggcagcacagggcaggccttctttggtgccaccaagtgcaattgtgtttccttcttattttaccatctgctatgcatttctttccatatccatgcctataattccatgagtttgggaggctgaggtaggtgaattgcttgagcccaggagtttgagactagcctaggcaacatggtgaaaccccgtctctccaaaaaatacaaaaattagccaggcatggtggtgcacacctgcagtcccagctactcaggaggctgaggtgggaggatcacttgcgcccaggagatcaaggctgcagtgagccctgatcacaccactgcactccagcctgggtgacaaagtgagatcctgtctcaaaaaaaaagaaaagaaaagaggaaggaaggaaggaaaagagaagggaagggagagaagagaaaaaagaaaagaaaagagaaattgctagggaaaggcacatactgggtttccaagagccatctctattcgaaggtgtgcaaaagactcccagtgcttaaaggcccagccaagctctgccctgaaggccagggtgctgtttgcctcaggaacgggaacacaacctttgtagctgaaagtcagctcttctgaacctcctcacataaaacacttatcaacagaaaagatgaggcacaacctaaccacatactctggttccaatttataagaggatcagatccaaatatagtttattacattgaaagggatgttctgatgagaatccatttttaaaagaaaggaaaatagcaaagaagcaagcaagttgtagcattactacagtctttggatccaaacatcgcgaatgagaaatgctttaggcaaagtaaaagttttgacctgaatgagacgaagtatcctggtacctaaagtcatccctgttggtaatgggatccacaggcggcaaactgtggcctctgtgctctgtgtgagtgcatgtgcgtgtctggactgattcttaggccctgctggcctgtggttttcctttgcgcaagaactagcacaaggcagagcactaggaccagcctgttttctctgcagtggtttgctgagcccatgctctgggggtaagccttaaaatggcacatgagcttgtagcaagaaggaccctaatatcgtcacatcaacacggctgactcacttgtcccctaataatagacaggtactacctagaaaagtagatgttttagaaaaacactaaagatatttttatatctgcaggatcggtaccactctccagctttctgatacttgctttcaaatataagagtgcttcccctacatgacacctttttaaggaaggactaattttaaagcatattagagcccatattctgatattcattgacgggtgggagttgatgagcgtaaggtgactcagaggccctcaatggccatttttgtcaaagagcttattgaattttgtgggtattattcagttagctaaaagaaaaaacatcttatctactcagagttccacagcacaaagaaccaaaagttctttcttaattggagaggttggaaagtataattatgccgtatgcttggcaggtaaatatcttaaaaacaagaacaacagaacacagaattgtggtaatttcttgcaacaagaaaatgtcttgaagatgacctacctcctgcacccctgaccatactgggtgatacgaaatgtgcacattaagaaaaactagtgaactctatttagataattttaagggaaacatagaatgatttttatgtgatctacgacctgaccacattacagttttatagctgaaaatcactcttggggaaaaataaaatagctcccagtttcctcattttacaaatatttcatatatatatatatgctcatgttcctcagtattccagaattcatcaaaagataataggtaaggcagcatgatgttatattaaaaataaaataaacagcatcatcttctacacttgtcttttcccttaaaatgaaaaaatgaaagtttataaactcatttgtaattaagattatagctgtttacaaatatttttgctagttaattttaccaacccaattaatttatcacattttcagaaacccaaatctaataaaacacactctcaataaatagtaagcactcacaacataatgcatatatttagccgttatttctaagccaggttggctattactagcttcaactaatttttgcctgactggagggcactgctacaccctgagagcaatattcacagggtaaagaaaaataatctacttttcctacatgaccttgtgtatttcatatttatgttttatttcttgggaaaatatcttcttcaaacgaaatgtctcctttgttggtttaatgacagaaatggggtactaagtatttcacagagttttaggataaaaaggttcatggttctaaatcaaagtttgcaagccggttttttttttttttttaacctatcttttttacagtaataggctttttttttttttttttttttttggagacagagttttactctgcctcccagcctggaatgcagtgacatgatctcggctcactgcagcctccacctcctgggttctagctattcttccccctcagcctcccaagtagctgggactacaggtgcccaccaccacgcccagctaattttttgtgtttttaatagagacagggttttgccatgatgaccaggcaggctggtctcaaactcctgacctcaggtgatccatccgcctcagtctcccaaagtgctgggattacaggcgtgagccacagtgcccggcctatttcttagaacagttacagatgtatagaaaaattgaggcgatagtagagagagctcccatgcactgtcccctgccactcccctatactcaacttcctatattatgaacatcttgcaacagtgtgaggaatttgctgttaactaaaggccgcgatttacattaagctgtactctgtgtgttgtacgttctgtgccttctgacaaatgtataatgtcatgtattcaccatgctagtgccatgcagaatagttttactgcctcacaaatccctggggtttgtcctgttcatctttccccacctgccaccttcacatccctggcagtcactgacatttttattgtctcagcatttgccttttccagaatgtcatatggttggatccacatacgatgtggctttttcagacttgctttccttgtgtggctgtatgcatttaaggtgcttcctgatctttttgtagcttgatggatcattcttctcatcactgagtaaaagtccacagttcactcactcagttgctgaagaacacttcggttgattttagttcggttgcctttagtaaacattcatgtgcagatttttacggggaaataagttttcaaattatttgcatgaatgccaagaagcgtgattgctggatcctatggtaagactatgtttagtttgtaagaaactgccaaactgtttttttttttttttttttttttttgagatggagtctcactctgtcacccaggctacagtgcagtggcacgatcttggctcactgaaacctccgcctcctgggttcaagtgattctcctgcctcagcctcccaagtagctgggattacaggtgcacgccatgacacccggctaatttttgtatttttagtagagacaggttgtcatcatgttggccaggatggacttgatctcttgaccttgtgatctgcccacctcggcctcccaaagtgctgggattacaggcgtgagccaccgcgactggcccaaactgtcttttaaagtgactctgccgtctctgttactccacatctcatcagcatttgatattgtaagttttttgaattttagccagtttagtagctatagagtagtatctcgttattgttttaatttaaaattatttaacgacatataatgctgatcatcttttcatatctttatcttccacttctgtgtcttcttaggtgaggtgatcttccagatcttttgttcttttttaacattggatcatttgttttcacattgttgagctttaaggctgctttatatatttggatacaagtctttttccaatatgtgtttcacaaagattttctctccatctttggcttgtcttttaacgttctcaattgttcaattgtgtcttttgctgagcagaaggcttttttttattattattattttactttaagttctgggatacaagtgcagaacatgcaggtttgttacataggtgtacatgtaccatggtggtttgctgtacctatcaacctgtcatctaggttttaagccccacatgcattagctatttatcctaatgctctccctcccttggcccccaaccccctggctggcctcagtatgtgttgttctcctccctgtgtccatgtgttatcattgttctgggacacagctaaagcagtgttaagagggaaatttatagcactaaatgcccacatcagaaagccagaaagatctcaaatcgacaccctaacatcacaattaaaagagctagagaagcaagagcaaacaaatccaaaagctagcagaaaacaataaataactaagatcagagtagaactgaaggagatagagacacaaaaaatccttcaaaaaaatcaatgaatccaggagctggttttttgaaaatgttaacaaaatagatagattgctagatagactagtaaagaagaaaagagagaagaatagacacaataaaacacgataaaggggatatcaccactgaccccacagaaatacaaactaccatcagagaatactataaacacctctatgcaaataaactagaaaatctagaagaaatggataaattcctggacacatacaccctcccaagatgaaaccaggaagaagtcaaatctctggatagaccaataacaagttctgaaattgaggcagtcattaatagcctaccaaccaaaaaaagcccagaatcagatggattcacagctgaattctacagagttacaaagaggagctggtaccatccttctgaaactatttcaaataattgaaaaggagggactcctccctaactcattttatgaggccatcatctcctgataccaaaacctggcagagatacaacaataaaaagagcagaagtttttaaattgaaggaagtcaaactatcttagctagcttgggttgctataagaaaataccatcaactgggtaatttatgaacaactgacatttctcacagtgctggagactggatagtccaagatcagggcaccagcagatttgctgtcttgtgtggagctgctttctggttcatagatggtgattcttgctacgtcctcacatggtggaagagacaaggcagctctctggggtctttattatatgggcactaatctcattcacgagggcagagacctcatgatttaatcacctctcaaaggccccacctcctaagactatcacaacatatgaattttggggagacacatacatccagaccatagcaccaacttattaatttgtcctttcattcgtcatacttttgcggttgtatctaaaaagtcaaaaccaaacccaaggttacctagacttcctcctatattatcttttagtagttgtattgttttgcactttatatgtgggtctctaatcaattttgagtttttttgttgttgttgttaaagcacgtattgtaaaatatttgctaaattttgtgtctagtttctttcacacatggattttcaggtgttccagcattatttgttgaaaagactatcctttccccattgaattgtctttgttcctttgtcaatattcagttgaatatatttgtgtgcatctgtttctgagccctcattctgttccattgacctacttgcctgttcttccaccaacaccagaagctagtgattaccaaaagtcttgaagtcaggtaatgtcagttctctcatggttcttctacagtatctccttgcctattctaggtcttttagctttccatgtaagctttagaatcagtttttcaatgtgtaaaaattggcttgctgagattttgattgggatgactctgaatctataaatcaagttgagaaaaactgacatcgtaacaaaattgagtcctgtccatgacaatagaatctctctccatttctatatatcttgtctatttcattagagttttgtagttttcttcatgtaaatactgtccagatgtagttagattaatatttaagtgggttttttggtgctaatagaaattatattggtttttcatttcaaattccaattgtttattgctggtacattggaaagcaattgactttcatatattagtcttgtatcctgcaaccctctatgactacttattaattccagaaatttttttgttaactgtttcagattttcaaatagactaccatgtcatctgtgaacaaggacaattttatttatttcttctcaatctgtatatattttatttccttttcttgccttcctggattagctcagacttccagcacaatgttgaaaaggagtgatgaaaaggaaaatcttttacttgttccaatcttagagggaagaaacttattttctcattattaagtatgatgtctgttataggttttatgtagattcttttttccaagatgaggaagttcccctctattcctagtttgctgagacatttttatcataaataagtgccggttttaccaaattcttttttgcatctgttgttatgatcatatgattttcattcttcagcctattataatgcgataggttacatttcctcattttctaatgttaaagcatccttcaatacctggaataaatccaaatgcatcatggtacattattctttttatacattgttggatttaatctgctagtattttattgagtaattttgtatctaaattcattagagctattgatctgtagttttcttgtgatgtctttatctgttttggttttaggataatactggcctcatcaaatgagttagcaaatgttccctctgcttctactttttttttttttttttttttttttgagattgggtctcactctgtcacttagtctggagtgcagtggctagatctctgctcactacaacctctgtctcccaggctgaagtaattctcccacctcagcctcccaagtagctgggactatagccatgtgcctccatgctcagataattatttgtattttttgtagagacagggtttgtcatgttgcccaggctggtctggaaatcctgagctcaagcaatccgcccgctgcggcttctcaaagtgctgagatcatagtcatgagacataacgtcagctcagcttttatttttaggaagagattgcaaagaattggtatcattttttttctttaagagttggtagatttcactagtgcaaacactggtgcctgatgctatcttttttggaaggttattaattattgagtcaatttctttcattgatataggcccattcagaatatctgtttctccttatacaaatcttgatagtctgtgtccttcaagaaattagtttatttcatccaagtattcaaatttatggctacagggcttttcataaccctattatccctttaattattatccttttaacatctatgaaagcattcctgatgagttctcttttatttccaatattaataattcatgtcttctttttgcttgatagccaggttagaggtttaccaattttattgacatttttaaagaaccagattttagttttgctgattttctctactggtttcctggtctcaatgtagctgatttctggtctaagttttattattttctttcttctgcttgttttaggctgatattgcacttcttactccagttttctaaggtggaagcttcgactattgatttcaaatcttttttcttttctaatctatgcattcaatgttataagttttctgtgaagcagtgatttcattgcatcccacattttgataggttatattttcatttagttacaaataatttaaatttcccttgagatttctgctttgacttatgtgttatttggaagtgtatttttattctccaaatatttagagatttgcagctgtctttatgttattaaatttaattccattgaagtttaatttcattataatcaagaccatattttatatgatgtctatgattttaattttcttgagatgtcttttatagtccagaatatagtcttggtgaatagaccatgtgaatttgtaaagaatgtgcattctgctgttgttcatgaagtattctatgaatgtaaattagattcagttgtttgatggcattgttacataggtcaactataaccttactgattttctgtctgctggctctgttaactactgacagaggggtgctgaagcccctaactataacagcaagtttttctaattctgcttatgcattttattttactgtcatttattcctacgaaactcctccttttgttatgtaaatctgaatttctgacccatgctattttcttctttctgaatacattcttttaacctttcttaaatgttaaaggcaggtttactggtaacaaattccctcaatttttttgtgtctgacaaaaatctttatttctccttcacttttgaagaaacattatgtagacagagaattctatcttggtgggttttttgttgctgttgttactgttgttgttgttcaatactgtacatttcactccactctcttacttgtgtagcttgtggcaaaaagtccagtataattcttagctttgtctctctacaggtaaggtgtttttctctggcttgtttcaatattgtctctttttctttagatttctgcagtttggatatgacatgcctaggtgtagacttttttgcatttcttttttttttttttttttttctgagcctcttggatatgtggtttagtgtctatcattaattttggaaagctgtcagctattgttatttcaaatatatcttctgctcccttttctcctttttctgggattctcattctgcatgtgttataccttttgtaattgtcccagagtacttgaacagtctgtttctatttttccattcattttttttctctttgcattttggtttaaaaagtttctcctgacgtatcttcaagctcattgattctttcttgtttatatctagtctattaatgagctcatcaaaggcactttttatttctgctacattgcttttgagttctagcacctcctttaaattcttccttagagtttccatttctgtgctgacattatccatctgttcttgcttgtcatctacttttcctattagaaccctaattctgttaatcatagttaaattccatatccaataattccaaaatcactgccatatatgagtctggttctgatgcttattctgtctcttcatatgtattttttcttgcctttcatttcttgtcattatttgttgagagtcagacacagtatttgggtaatgaaagctaatataattagacttttagcatgaggttttacatgaatctgggctgtatttaatgtttgatgtagctgcaggtgacacagcctttagtttctttatctcacttttctctcttgttgtctttgtgtttccctaggaactcattcttgaatagaggctgcatcttgcagctctcttagctgtaattcactggtattattttggagccttgttgatgtgatgctgaggtgttagggagaggaagctctccatactcttaagataaaatctcagcttgcagtatacccaagtccctggattgtgactttcagatgtgctttgtggttgtgtttatttgtttgtttgttttttagcttttcttcctcctcctatgtgaggcaggcaggatagaagggggcaccagtggctaattttcctttcctcaagttggacaatgttctggtaaggtagccttccttgaaggacatggttttcttatagagaatgcaatgggcttgcttcaaatacttaccttctcacttcccatgctcagaactggaggggatttttctctgaccttcatgtgagaatctggtgagcttcctggaggaaaaactcaagaaagctgtaggggctcctaggaaatattaactctcaagcctcacatacttagtctccagcaattcattgaacttaccatttacgtgttcctaccaatcactggctccgcaagcttctgccccctgtaagctgaccttggctctcattctctgtgttgacctgtctctccagattgcagaccagtggtttgccctgtgacctcaatcctctgatgaatccagaaaagtcatagattttcattctgttcagctttttttcatgttatgagcccaggagtaatcacttccaagctctctgggtgccctcgctgaaaatcaaagtcagcaaactttttcttacgaagggccaaatgataaatatttttggctttgagagatacagagtctctattgcagctcctgaagtgtcctattgtaatatgaaagtagccataaacaaaatgcgaataagtgaacatggctgcgtcccaatacagcttcatttacaaaaaaaggggttgggccacatttggcctgtgagccccattttgctgatccctgctctatacaggctacagaatgaaaggccatcaggggccaagacattagtaaacatgagcaaaggtgaatgggttttaaacaaaaaatatgttcttcacttatatatgtgcttaatgcacattctttttttttttttttttttttttttttttaagacagtctcactgtattgcccaggctggaatgcagtggtgcagtctcagctcactgcaacctccacctcccaggttcaagctattcttctgcctcagcctcccgagtagctgggattacaggcatgtgccaccacgcccagctaatttttgtatttttagtagagacagggtttcaccatgctggccaggctggagtcaaactcctgaactcaggcgaaccacccaccctggcctcccaaagtgctgggattacagatgtgagccactgtgcccagccaatgcacattcttatttccataaaaatgttatatttcatttttctttaaacaaatactctactttagataggaatatgaatatcataaatcatttaatgcttctgaattataataaagagacagccacacaattggcagctggtactctgtctcagtgttggtgttggggccacgagggggtgatggggacattgatgagctggagtgaagagcaccaaagccactgctggagctgccaggtgggaatgagagcctgcattgccagatttataattcttccagaggagctggaaatccagattttatgttacctttaaaatgtttagtgttggcaactattcaaaataaatttttaaacattgcccaggtcaacagtcaaacacaaatatttgtcaagtacaaatcctctagctggctaacattggctggcttgtggttgaatttggcctccaacccaggccagccccaagttttaccaaacgggtgcatgggagttaaagaaggtgcccaaggtcacacagccaggagacagcagagtgtgacctgggctgtagtagctgagcagcccacttctgtatgcgagctcacagctcagagcaaatgtaccttttagcttccatggaatgaacatctctctgctctgttttcagtctgatatggtttggctgtgtcatcacccaaaacttatcttgaattcccacatattttgggagagacctgctgggaggtaattgaatcatgggggcaggtctttcctgtgctgttcttgtgacaatgaataagtctcacaagatcttatggttttataaagggcgagtttccctgaacaagctctgtctttgcctgctgccatccttgtaaaacatgacttggtcctccttgccttccaccatgtttgtgaggccttgccagccacgtggaactctgagtccattaaacctttttcctgtataaattacccagtcttgggtatgtctttattagcagtgtgaaaacacagtcccaccactgagtcattttcttccactgatattaagaatcctcgtgtttacattcttacataccttttcagaaatcaactaacttcacactcttttttcaaaaagcacaattatgtttcagttaatcagcaaaaagaactaataaaacaatcacaattatgcctgtgctgtgaaatcacagcaagataaatggttccaatcagtcaaaggaattctacaaagaacatcatatataagaaatgtgcttcaagttatttggatccaaatttcatatgcctcattctccctttaattctgattttttttttttttttttttaggaaataaattccatcttttcagggatttcatctttttagaaagcgatattctttctttaggggaaaaatgaaaagaagcatgatatggtttggctgtgtccccacccaaatctcatcgtgaattgtactgccataattcccacgtgtcatgggaggggcccggtgggaggtaatggaaacatgggcgggtgggggtttccctcacactgttctcatgctactgaataagtctcatgagatctgatgtttttataaggggtttccccattcacttggctctcattctctcttgcctgctgccatgtaagacgtgcctttcaccttctgccatgagtgtgaggcctccccagccacgtggaactgtgagtccattaaacctctttttctttataaattaccctgtctcgggtatgtctttatcagcagcaaggtaatgaactaatacaaagcaattggttagaatattcccacattgagaggcgccattccataggtgccactttggatggagaaggaagttggtacagggccaaggtcccttctcagaggctgcagtgaagagtgagtgaggaaggggggagtttcaggagggccctggcttgctcttggtgttgccatcactcttgttcctgtgatccagagatcttcaaaagacagaattatcacctctaaagagcaccataaatggtaggaggagactgattataaaatatacataatcctcatgaattctgctgaagtatttttctagtggcagtgagaaattatcctaaaaacgtgatgacatcacatctcattctatttcatggctacaattttgaaatgccatagcagtgtatttttctggcattagggataaaaattaatattttgaaaatatatttgaaactgcaaagaacagcaaaatatcctgtgattatatgcaaaattaaaattagggagaaatggttaggtgtgttgagcagagtaacaaaaaagaaaccgtgccattgtataccaggtaacattgtatattttctcatttcctaaacggtgttctaaggaaaaataagagatacagctcaaaataaactgttttgtgcccagataagctctggaaaaggttagctgaagtgaaacaggtgtgttgacaacagaatatctcagcacttttagtgtgcttgtatgcgttgtattcttagtagatctctactatgaggtatttttcaagtctattgaccatcaaagcccatattcaaatgcagaactttcaaactctccctgagaagtatttaatggaacacaatttgggaaacattgattcattttaattgttgggaaatttaaataaattcacatatttagaaagttaactttgcaatactcttaaaggatacaacaattttggtttgaagtgtaccagggacctcttctcttctttaaatttaaggttattaattccaggagctaccactcgttttcaccctgggtaatttgcaagttctttctgggtaaagtgttttgaataagttgaattgcttcagattgttattaattaattaattaattttgggacagggtctcactctgtcacccaggctggagtgcagtggcacaatcatggctcactgcagcctcgagctcctgggctcaagcagtcctccatcctcaggcccctgcatagcttggactgcaggtatgtgacaccatgaccagctattttttgtatttttagaaaagatgggattttgccatgttgcccaggctggactggaactcctggactcaagtcatctacctgccttggcctcacaaagtgctggtactacaggcatgagccaccgcgcccagcctgcttcagatttttaaatcacgattttgccgttgttgtttccccagatgggtttagaaagagtgaaactatgcacatcatatgaaattttcaatgccagaagaagcaattcaacaaaattgttgccataaaatttgtactggagcaagatagaacacctgtttagttatcaattaataccttttcattatgttttgcctggctttctgtctcctttgcctggctttctgtgcaatgatacctgggctagggttatttatgatttgtagcaaggacggcaattaagatttatgcttgtggggaaatgcttggcatctctgctctgtgagaataacacaaggtagtgatctttctaatcctgcagtgtggaagggatgaacttctgtgagaaaaggaaagatgactcaggaaggggagagcattgttaggactgaattgttggggaagatggtaaaaaagatgttgggaaatatcaactggaggagaggtaagtggataaaatagaaacccttattagaattaggagctaatgggaggccagcatttgctttgacagaggacaggcaggccttgcctgggaaagtctagctccaggatgggcagatggtggtgagactatcacggctgcctcaagctctggttagattcttattactcagtgctcttatatcaagatgattctggtgacagtccaacaaagaggtcacagttcacgtgggattaatttaaaagaggccacaatcctgcctcatagggagacggactatttcttaggttcacaggatacctttcttgacaaccaaacacctttaaaacaagcacggggcttgggacatagtccacacgaacatctcgaggattctgggctgagaaacagcatatttaaatctctcatcaaaaatgaaattcagaaagcccagcgagacaatatccactctttactgtagaaagaaaaaaatgcccacatttctgggaggaaattgcagaccatctgctgccctgacggccactcggtgtacatttctcccctccatctcggacactgcacccagccgttgtggacctgaacttgtgtcctacctttggtttgccccttcagcaaactgagcaaactagagaaataaggcaaaccaaggaacagccctagatgtctgtaaagagcccagcacgggctgcccatgaccctggggctggcaaggccccatcccctccatcagagtagaagcggcttccagcttccggtgggaacatatgtgcttatacgactttatgtgtggggctgtgtgattctgccaaagtgcttgaatttggcacttctcctgtgtctgattccatcccctcccctcccccaataaaaatgcacttccataggctctgcctctaatctgcataataagattcagttttacatgaaccatgtccacgacctcagggccaggcatcagggtggccgtcacctaatcatgtttccctaagtgtgtttcatgggaggtgaatatccaaggtcttaaaaagatgagacctatgcaaggtccagtcagctttgaaatgcactggcttagagttaacagcagttttgctgcaggacttctcagggcttttgatatgttcattgcaaaccctctaaagagtgagagtgcttgcagaatttctccaagtacatttcaccctagaaccttctcttcagagcagctttgtcccacaaaatataacatgagacataaatgtgaactgcatatgtggtttcagattttcaaaaagtcatataaaaatgtaaaaagaaacaggtgaaattagttttcaatttttttttttttttttttgggatggagactcaccgtgtcgtccaggctggagtacagtggcgcgatctcggctcactgcaacctctgcctcccgggttcaagcgattctcctgcctcagcctcccgggtagctgggactacaggtgcacgcctccacccacagctaatttttgtaattttagtagagactgggttttaccatgctggccaggatgggctcaatctcttgacttcatgatttgcctgccttggcctcacaaagtgttgggattacaggtgcgagccactgtgcccggcctagttttcaattttaataatactgttaggtaacacagcgtatcaaaactattatcatttccacatgtaattcatatgaaatatcaatgagacaattgataccctttgatgtgacaccatgtctttgaaaaagggtatgtattttatggcaccctcaattcagaccagccatactttgactgcccaacactgtgtgtggccagggctaccctactggatggtgcagatccagcatgtctcaggagactattatttcacaaagttggtgtcatttgagatgcacaggtaagcactctttcctaaggttggctaatgtaatgttgactcattagtaaatatttagtaagtgccaactgtgtgcaggacagttttctaggtgctatgcaaatagctctgaaccacacactatgcccttgccctcatgggacttcagtgaagcatatactaaatcacacaactaattatttgataattctggatgctaagacagggaagcttgactgcacccatgggtcagtggaggttgcccctactaagtgacatttaaacagagacttggaagatagcttggctttagctaaacagtgtgcaaagagaggaacatgaggtgggacaaccaccatagttagagaaataaaggatcagtggatttgaaatacacagagcaggactcagagagcacattgtgagatgagtctggtcagcaggaacatacaggctgtttggggtgagtgctggattctatctgaaaagcaatgggaagccttggaaggttgtacgcttagagggtgacatgatccaacacgattttatagaaattaaatatgtcttcaagttctttgctgctctgctcattgagatttataatttaattcccctctctctttgaattctgactggtcctactgacttgcttgaccaagagaatctggtggatgtgaggtcctgagatctccaagttcgggtccttagaagccttgcagtccaccccagtctttgggagaacattctcttgaagccctgaagtgtgactacccagaaagcaccatgctagagatagcatgtggatgggacacttggcaatgagctgaagagaagcaaatatcagctcatgaatgacaatgacctctacaaatcccaagtcagatttgccgcgaggagaaagagatttctgtctactggccattggtgtctacccagcagaggtcctaggcatcctggagcagacgggagttgctccactgagtcctgtccaaatctcatgtttacaaacatagccaatggcagttttaaggggatgtttgttatacagcatgaggatgtctgttatatgttatcaaagggttttgataatccctctggctgaagtgtggagatggacaaactgcaagggaagaaggacatgtgtggacaatagtaactgaaccagaatgtggcaggaatatggaaggcagtggctgagtgaagacacactgagaggtcaccctgaaaaccctccctgtcttggtagggaggggagattgttgttttctccatttctgttttctcctccttcattttttctttccaggttcaagaattaagacaggaatctttaatccttgtccctttactgtctttcccatatgttttcaagttggctcaagagtattggtggccacttgaccaagagagtaacagatagatggctgtgacagatggtgtgtagtatgtgatgacgaaaatctctattgattcagcctcagaaagaatatttgggtttatctgaaaactgcacatcatggtcaagtggcttaaaaataaaattaagttagataaagattaaaacatatactctcacctcattgtagctaattaaaagtcactaaaatgttttaaataggaacaaacattattaatggcaaatagggaaaagtgttcccaaaaacctaactgacattccattgggtacatttgtctatggtttgtgcaccaaagcaaagccacatcccagcaccactttggaaaatacatatggaatgctgtttcactggttcatttaacagtgatattttcatttgtgtttatctatagtggttttatattcctaattcttaaaaaaaagattttttaaaaattgtaacatctaaggcaaaattaaacaagagatttctcagaagtctctaagaaaaccttctgtcctgtgcctcattaattcatcaatataatgcaaattaattgccactgcattaaaaaaaaattgttagaatagagatccggatgtaaaagttgccctagcatgccgcactgctgagacgagctattacagcccacttttccacttcactttagggggatctgtagctactagttcttctttaggaagtaaaattggctgcacctgggcatattattagctgctcaccacagggaatctcatgctgatgggctataatttagcagagaaggaaaaaaaaaaaaggcaatccaattaaaatgaagcacatcacttggtgcccatttgctgattgcttgtcagaatctattatcttgtatttaacaaatatgggataattagaaaaggaatgagtatgagacaatcaaaatttggggagcaaatcgttatccttgcacaaaagaaaaactctgagtcctcctaatccatcctatcaaaggaaaaaagcacacccatatattcccctgtgagatgcacagataatttgagaagactcctgtcaaccagtcccaccccagtcccaatcctggcactgcccccgggggcccagcctaaggtggcctgtcctgctgagtgcagccccaggcctcagtcatgaggccatggaagtcagatgcagtcatggaagtcatggaagagagatgcaggctgtagaccaccctaagggttttttagagtcaagaaatttttgttttgttttccttttcatgtacttggtaaatttaaacaggctgacatcctgatttaaaacaaacaaacaaaaaataccagtaaggttttgtttaaagggtttctggctactccttaacaatcaaggttgttttaattataatgaaaagctacttacaaacaccaaactgttgagattttttaaaaattagaaatcattaagattggcaagttcatgggaaaaaagacctactgtgtgaaatttggaacaacttttatggaggataactggccatgagtttcaattgtttgaaaaatgtgctcactctttggttcagaaattctaccaccaagatatagtctggaggtaaaattatatatgcacatagatttgattaaacatgttaatcacagcctgacatgtgactgcaaataaatggtaacagttgtatgtccagtaacggaagtgctgactatcgtatgagatgagatggaataccatgcggccattctacattcttccatgatgcagaagaatattgcaggtcgatgtggtatcaatgaaacaggcacatgtttcagaagaacatcaacaggattacatgatatacattatgtataaattgctgcataaattatgactacctgtgcatgcatctctatatacacacacttatgccacatgtataaatatatatttatgtttttattatatattttatatacattatgtatatatgtatgcatgtgcacacacacacacgttttaaaagtagatgggggccaggcgtagtggctcacgcctgtaatcccaacactttgggaggccgaggcgggcagatcacctaaggtcagaagtttgagaccagcctgaccaacatggcgaaaccccatctctactaaaaatacaaaaattagccaggcatggtggcacacacctgtaaacccaggagaatgccttgaaccaggaggtggaggttgcagtgagccaagatcatgccattgcactccagtctgggcgacagagagagactctgtctcaaaaaaaaaaaaaaaaaagaaaagaaaagaaaattgatgggaatattatataccaaaatgttaacagcaattttctctaaatgatgaatctatgaataatttttatcagctttatttttttttaaagttctgctttactattaaaatctgaaaagaaaaaaagagcactttaagagtgatctcttcattatcttcaatggctctgaaaaacaaaaaacgtggtgggtaagaaagtcagacaacatggctaaatattccccaacaaattcgtaccctttctttccgagatctttcattattttgagtggtgatattgcttcctaagagattatgacacatcttacatgcatgagctgcattcatttcaaacctaagaaaagcagggtacctcagaccacagctaagctggatgtattaagtggcctgggatgtgtaataacatgcagacagatggagctaaagtctttcctgggcagagagctctatatcaacaaacgtcaaaaatgtgatatgggcagtctttgcctgtgtcctgggtcttcggctctattaaaaaaagaaaaaatattttaaatgcatatcattaaaggccacgggcagataatgtgcttccctagaacaccagcccaaggactcatgtgtggctgtcatgaagtcttcaagaaagctccctttctgatagaaatgataacgttttgaaatcaaatcaaacacacacacacacacatgcatacaagatccatgcaaacaacacaagaggcctcggttattatttttgaattaccttgtgtatgagtcagctcctgttcttggttggaagcagaaataactgaacttgtctgactttagcagaaagggcttcactgaaaggttactgaagaaagcacagaatgactgggaagtttttgacaactgcagtgtgcaggaaagagctagctgcctgacagtgccagagtctcacatctcttcaggaaggcctaactgacccttggccagctcctgaaaacttggccctgcaatattccctgcgctgctaattaataaggttgttttgtacacccggggtcctgacacatgctgcccaagcttatctagttggttcgtaccaagtcaatagcatgatttacggtggtcacgtttcctcctggaaataggtgcctgtgtgaccagctcctgataaaagctctagcctctgagacccaagctgccctccctgggcttagacacttggcttacatcactgaagttcattgctggaggagtgagtgtgtcttgcgcaaatccacaggaagactttggaggccactgctgggtctcctctagacactgcctggtgcatttgttttccttgctgatgccactgcgtgttttttcactgtaatgaaccatagtcctgagtctccctgagccctgtgagcccttctagtgagtcacggaacttaagaatggttattggccgggcgcggtggctcacgcctgtaatcccagcactttgggaggccgaggcgagcggatcacgaggtcaggagatcgagacaatcccggctaaaacggtgaaacaccgactctactaaaaatacaaaaaattagccgggcgtagtggcgggcgcctgtagtcccagctacttgggaggctgaggcaggagagtggcgtgaacccgggaggcggagcttgcagtgagccgagatcccgccactgcactccagcctgggcgacagagcaagactccgtctcaaaaaaaaaaaaaaaaagaatggttatgagacaccagaaatagactctaagacagccaggcagaagccaacacccagaacaaaggccaggcacagaaccagtcttttttttttttttttttttttaagacggagtcttgctcagttgcccaggctggagtgcagtggtgcaatctcggctcactgcaagctccccctcccaggttcacgccattctcctgcctcagcctcctgagtagctgggactacaggcgcccgccaccacgctcggctaatttttttgtatttttagtagagacggggtttcaccatgttagccaggatggtctcgatctcctgacctcgtgatccacccgcctcggcctcccgaagtgctgggattacaggcgtgagccaccgcgcccggcccagaatgagtcttgagtaaatgttgctgctgccatcacagaacaccagaggccacaatctaccccctcccagctccttctaggacccgagcaggacactggagatccactggctcccaggtactgtaactgagactagggtttctcaagcttggcgctgtagacatttggagtcagacaattgtttttcgtgggaacattctatgcatcatagtatgcgtaagcagcacccctggtccttgcacactaaatgccagcagctccctcccagtcgttatggttgaaactgtctgctgacattgccatatgacttctggggtcaaacttgtgctcagttgaggagcactgacttagaagaagctaggtcaggtgtccatagagtagctacaagcacatctagaaatagagactctgctgactcagattctgcaacttcttccttcccaccaaaattcctactgcagagcaatgccagacagaggacgggtgttccaacgcgaagcaggcaaaacaccggcacccacccactttgcaacacacttggggcttttgtcaatatggctgcctgggtgaaggtgaagcctcacgaaccataggaattgtcaggtctgctttctaaggagaactttattcactgacattctggctcctgaattaagagctgtgcgggactgattaaaaaggtgtcattgtattaagaaatgaaagcctcgtgtttcaataagcatctctgataagaagaaaattgctagttagtacacatgaaatcaacaggctgcttgatgcctatcgaaatgtgtgctccgttttcagaaaatccaaacgaagaaggaataaatacattttaaaatgttactgggtaaaatccactgatgagctctccgtggtctttgcctttatggaacttccacatgacatcctctaaagggggagggcaggaggggtgcttgttgccgtggcagcaggtgcggtgtggggaatggtctctagcgctgcatggcagcgctgtcctcacagcagctgccaccctgctttcaccctgatggcctgggaggcggagtttcatgagagagaagcatgaatctgcatccagaacatctgggtttattaggcctaggatttttctgcacatttgtgctttgtcaaataatataataagttcctaaaagtcagagggtagatataaattaattgaaacaggagagcacaacccaaaacatgcttttacagagaactctgagaaaaaaaaaaaagtggagaaacaaaagaggctctccaagcttccagactgtgagctagcgcagagacaatgatcagagagattgactgggagaatggagaggtggcagctggtcagtttgctgcatcgccgccccccagtcctcattcctccttcttatagcaatcacagggcacttggctgcagaactcaggcaggagcagcgcctggaggtggaagggacaacatggcagaaactcaagtgtctaccaagacccaggaagaaggggagagactttgcagctcctggcatgacaggcctcgcaatctgtcctgcctctacctcagaattactcgaaataggctgaagcaagcagtatgccacttaaacccaccgggtaaaaggaaagctcaaatataaagataagcaattttaaaaaaaacaaaagcaacaccattaaagtgaggcatacacatttaaaaaaagtagagtaaatagcatctcatgaagtggggttaatataacaaaaggaagtaaactttaagtgaagtatagcattctgagatgaatgtcagaggatccttctcccatgaaactataccagatttattataatatgtgatatttctaaaataagaataaaatatacacatttaataatatttataaaacaattattgttgacttaattggaatatttttgatgattacattattttgaatttaattactaaggaacattcctccagctagacagattcaaaaagattaatatgttggggtaatagtttttcaacaaaatataatttacctattgttacgcagttcatatttctccattttgttcacaagcatgaaataaaatatatctattcaactattctaatataaaattaagttaattcatgaaaaagaaaggaaatgggtccctttacattattcattcttagtgaatccactctggcttgagttgattactgctttaatatctatgtattaaggtactacaaaataatctgttctaggagtttgtttcgccattgcatccacaggcattgtaaatacgccgatcgatactttctagacttaatgaattcatatttttggaaagatagaatttgaattggaaagcttttgaaagagagcccagtcaaaagatttgaacagacacttgaacagagaagattttaagcatgtaaagaaaaaaaaaaaagctcaacatattagtaattaaggtaatatcatttaaaccgtatgagataacactatgaaatctagtagaatggcaagaaaggaggaaaggaagaaaaaaggaaaaagagaaaaagaaggaaaagaaaaagaaagagagagagaaagagagagaaaaaagaaaaagaaagaaagagagagagaaagagagagaaaaaagaaaaagaaagaaagagagaaagagaaaaaagaaagagagagaaagagagagaaaaaagaaaaagaaagaaagagagagagaaagagagagaaaaaagaaaaagaaagaaagagagagagaaagagagagaaaaaagaaaaagaaagaaagagagaaagagagagaaaaaagaaaaagaaagaaagagagagaaagagagagaaaaaagaaaaagaaagaaagagagaaagagagagaaaaaagaaaaagaaagagagagagaaagagagagaaaaaagaaaaagaaagaaagagaaagagagagaaaaaagaaaaagaaagaaagaaagaaagagaaagaaagaaagaaaggagggagggagggagagaagagggagggggaagggagggaaaggaaaggaaaagaaaggaaggaaggaaaaagggaagggaagggagagagagggagggaggggaggaaggcaagcaggcaggcaggcaggcaggcaataccaaataatggtgagaatataatggaaaaaaagaaaagaaaaaagaagattgagtaagggagggaggcaggcaataccaaatgatggtgagaatatgatggaacaactggaactctcatatactgctagtgagaattccaaatagattagctattttggaaaacagtttgacagctttttatagaattaaacacgtatttatcatccaattcagaaacactacactgtgttcatataaaaaatctgtaaatgaacgtttctactggttgtattcatgatgtcccatcactaaaaacaacccaacaacctccctttcagtaggtgagacaataaaccgggttccatttatacaagggaatacgactcagcgtgcactgatgcgtgtgacgacattgatggatctcagatgcattataagtgaaagaagccagactcaaaagtttgcatttctaggattccattgatatgacattctagaaaaagcaaaatatagagacagaaatcacaacagtggttactaaagttgggagaccagggataaaaatgacaaaaaaggggcaccaggaaagtttgggtgtcccacagaaacattatctgattgtagtgtgactctaagcatatgttcaaaagaagaaatacacattaaaaataaattttattacatgtaaattatatctttataactacaaaaaaacaaacaaaaaaactaccgtgggataagtggagcccgagatttgagatgagctcataaagagtgatttggggtgctctcctcataccaggcattctcgtgaactcctctccacattgtgtctttgggtttcatgactactatcacatgaggtgagatttcattctgaggcaaacagcaagaaaacggacattttaggaaagtataaattcccagtgacctgactggagaggcttgaggatcactggttcaaagctccagtgtacaaagcaatgctgactggatgccctttgcagccaggccaggccatggctgctaagcaccctctgacttctgcttggggaccagatgggatggcacccagagaagagtgctgtttgccaaagtcatatagtgctttcaggacatggttccaccagacccaggtgtccccgttcctctcttagggagccacccattcatctatatctcaattttgcaccaaggggagttcgtaaatttatttagaggccatgtacagagatggccccaaatggcaaatccaattgagctgttaagaattgctgtttttgagagtccaatgtacaaagggatggatcaagatgaaaatgtgaactggcactgaatgaggtcatggaaaagaaagaaagaaagagagagagagaagggagggagggaggggggaggggaaggaaaggaaggaagaaaaaagaaaggaaggaaggaaagaaaggagggaggggaaaaaagagagagagagaataaaagataaaattcaaagtaggaaaaccactttttacatcaactaccaccacgatgacaaaatttctagaaaagacaaaagacttttaaatactcagttgatgcattgctattttaggtcatgtttccttttcacttaccagaatattactggaagcccacaattatcacctgcctcctattttcttaccccttgaccttcacctgacccctgaagtcaacgtactttcctgactttaaagacaaaaagaaaaggatttgagtgtccgccccactgttggaggtgtacaaaaaaaggtgtgcttcaatgggaagcgccacaatttctagactctagaggttatcacattctaagttttcattgtctttgagctattttacaaacctatagtctgtaggtaactaatgaacaccataaattccacctgtcataggggtttaattggtttccctccccaccgacaccattcccatggaaaaaccagttttgactccatttgcatattcatttcactattactgacaaataaatgttggttttgatccccatttcaactgtttataatgttttcctagctccctcactgaatgaggtaaataaaatctttaatgcatgttcatttgtacatctgcaggaggtatagcctgcccgaataccagcacgaggggtctagttggaaagctggattggacagctcctctgtgcagcccacacttgaccacagtcagcacttttggcctgagaccaaaagtggagcaaactcagctctgtcttcccagtcgtgctttccactgagctggctccgagtctgcccccaggaaatacctgtttagagttaaaagcacttaacactgatttgtatgtacatgatacaaaaaaaaaaaaaatcagcattaaaggttataatgtgctcattctttgtcatataattggacctaataaacaaacatcacattagttacctagtaaatttcaacttattactaaattagtagctatcctcacatacatcaaatattgtcaacactttcctggaagctgccgctacccacaaattgagccaattaaataattaattgaagtaaaatgactcctgtccagcagaatggatgtgagatgtgtttactcgttcaatcaaatccttccttttccagaatgcatcattttcaaagaaggagatctgaagcggggccctggctgactcattgaagactgcataaaatattttgaagctattcagaaaaaaaaaaacacattaaaaacaactttcatactggaggttaagaggcagaaatctttatagagcaaagttcctttgttttgtatgctatttcctgagtgcagtgaacttattaagcactttgatgtagcaaaaattgtgatgtgtatatgtacaaatgatccaaacacagcaaaaagcagctaaaaaaatcaataaagcagctttttaacaaatgcattccaaactggatcaaagagatagcctggcagctacatgctactgatctaacactcattacattttcatttcaaggaaacatcttttgcaacagaaaggtgaagtctatctgtaatgagcttcttctaaggcaggaggaaagcttcttttcaaataggaactaaataaatatggggcctgtgtgggtctctgcaaacaaatctgtgcagaagggctcacctttgaaagaaaggcctctacaaattcaaagagggagcttttcattgatttttccatcttcctcactgtccttccccagaatagactttcatatgtaaatatgtggtcaagagaaaacacttgcctacggatagtggtgtttttgttttgttttgttctttaagggatagtcactgggaactggatgctgtaaaagcttacccatatctgatttgataatgatattcaccattgattttatagcccaagggaggggcccctttcagaatgtttccaggcacacaagatttttttcagtgagttcactcagaaggttggtttgtctttcagtcttcatatggcgataagtcttgaggatggttttttttgccctgtgttctgatcatatacacccattccaggttatcttacccagggcttcctgcctaacagggacattcttgcctctcacagaatgttgtatcaatcagatttttgtgccgattctcattttgcccctcagcctctacacatctcattttcccattttactaacatgcaaactcatcattgcctgtatcactgggttaaaataaaataaaacataactgactctcaattaccttctggaaatatgacagaaggaggaaatagatgaaaaaagctcagagacagaaagatctttttttaaacttttttttaagaactgcctcatgcaaacatctacctagaataaaatgtcaccagcactgctgtaagatcggattgaaaaaagagtaagactttccatgttttggccaggcccttagaacagaggcagggattaccaaagtaggaaaacagagcagcctcatctccaagtggggtgagaggcacctggacagcctgaccatgtgaatgatgcttgggagcagggtctcctggaatgcagaacattctcccaaagaaaagaaggaaggctggcaggacatgaaagccaatacccagcacttttgagttcctaaataacctaccagaagggctaagaaaattgtgtatagaagtcaggccaaaaaagaaaaaagaaatattagattaggaaagaagaaacctttgtgtgcatacacatccaaaagcacatccacacaaacacacactcatcactccaaccttccaagcacctgcaaattgggaaatatctccaatacattttgaaagaaatgaggtgtaagtaattgaatgataatctaaatagcatattcataccagttattttataacataaagaaaattctttgattatataaagtgagcttttataatctaagagtatatttattatgttagttgctgtgttgacataaataggtattatacaaatatattctcaccataaaaaaggcaaatagtatatacattttgaagttaaataaatgtttagtttaaatcattattatttaggtgtccaaatgtgaaaataatgaacatttatgaacaatttctgaaacaggaatgagtaacctgaaaaaatgagagatgttgatgaagttcaattgatattcaactcaaaacaaaattaatataagagtaagaaaccacagagatatacatggagactaactgtccacattttccaaaagaaaatgaaagatcttggggaataagagaaaaacattatacaaagatgcattataatgtataatacagtaatacttaaattctccagaaaccagctatccggcactttcctctatggaagagtcgctcaacaaaggcccaccatcctgtgtctaggagtctcctttttcactccctgagatgagattctatgtttctcatctctggcttccctcctaacagctctctcagtgccttctccagccttttctggagtgcaagccctcatcctaaacttgctcagttagaatctctctctaccctgcacccaccccaatcacccactcaaggcggatcctgctgcaggagctggaaagcccccaccctgtggccttctcaaggatgtcattacgtctgttcttttatctttcttgtatctgcaccacgacagcttattctctattggatcactgtactcactgggcaaacatgctctactgtatctcatctttacaaaaaacacataaacaaataacaacaacaaaacaaaattccctttagctggcattctcctttactactgctccattttcctctcaattttccccacacaatcttcctcacctcttcctcctctcgggaaatgggaaaccctattcacctatgtctagcaggctctttttgaaattaagtacatgtttattaatagtttaaatctttattatttaggtgtctaaatttgaaaaaatatggactttacacaatttctgatagatgaatgagtaaccagaaaaaaatgagagatgtttatggaattcaacagatacagaacccaaaataaaattaatataagaccgattcctgatttttaggagggaaggcagagttgggaaatgccaaatcgcatcacagggagtggacagaggagtgttgcgcaacccaggaatattcttgattttaccatcttcctgcctcatccctgccctcagcccatgtcaacacacccatcagcaggtcctactcctgctatctgaaaatgtatctcacatctctccacttacctctacttccatttgaggtcaccatcatcccttatgtagacacctgaaataacccccatctgatctctctgcacccatactttcccctctacaacgtactccccatctctagtagcaagtgtgatcttcttcacccacccactgtgtcaaaccctatgttatactccttcttagaactctttggtgactttccattgaacttagaatcaaatcaaaatgctctccattgcctcccagcctctggtgatctgaatcatgtctctagtcaacctcatcttctttttagtttcacttggctccagccatgctgtctttttgcattcctctttgacaccacttatgtggctcgttctttcccattctattgtacatagagagaccttcctgcttccctaatctaaaatagaatataagcttcttaaaggcagagggttcattgctaccaagttttccattgtatttccaaagcatcaatcacatagtggatggtaagtacatatttgctgctaaaatggcgaagaatcaggagaacagaagaaataaaacttctcaatggggtcaaaacaagtagtacaaagcgaatgctataaaacttgaaaacttgattcataagaaagcatcttgagtttatggatcttttctttacgtatcaagaaaacaacaactaaaattaactgggaatctggtttccatatgctcagcctactaggaagggagaaagagctccagctgccccctcaagtaacagattctgactgagagatacaccgactgaggacagaagccatatctacttcatgagctttgtgtccctaacatctagtacactgcctctccataatagacagccacacgttagttgaatgaatggacaaataactctaataacctgtggcaaatagaagtgaatgcaaagaactaggagaggactgaaaaattgataacagatttaagttgggagatcacagtgatagctgagtggaccaaatcttaaaaattatgtagcattagaacttgtggaataggcaagaaaagctgtcaactctatgaaaaccacaagggcaaatccaactccttccacccccactatatgagtaaatatgttgtggaaagccttaacaattctgtgagtcttctctaaaatcacttgggattttaaaagctagtaattttctttaaatatgcaatttaaagactcaattacagcgagtacatgtttggattcttccttttctatatgcagtcaaccatacttaagtcaccttgaaatacaacaaaagcaaaacccttatttctaaggacaatccagtaatagcgatgactttacatatatctataagatgctgtaatttagccaacacttgcacttacttaaactcctttatcattcacagcacatctgttagtagatatactatctccatgattcagacgtgaaagctccgatttggagaagcacggggatttaagcatggttgcacagagaaatcgaaccattatttggattcagatttactaactttaaatcagctgtttcccaccacctaagcatgccataactactctttcccattcttggacagagtttttctgctgtgtttttgtcttctcttctaccctgctgggaagggtagaaggaaacttgaagacccccaaagttgtgtgtccgtgtatgtcaagaatgattcagatggtacatttgaccactttgtataccaccttgttgtgtatttagtgtggctcagtaaatcacacaaccccagcacaatgaaaccacaaataatttgtgtcttttgtctttgtagacagaaaagatcatccataaaatgagcaaatatattggaagcccaaccctcttttctgatccatacttcgatagcttaactgaattcagcagagtagcattattagagaagaaatgaatcctaacagttgggatcatgaaccctggagccaacttgcctttgtgaaagcctggctcccccacttaccagatgagagaactttgacaaatgattgaacctctacaagcctcaactgcacttctacaaattactgtacctctacaggcctcttcttctataaaatggggataacagtagggttgtcatcagaataaactaagttaaaacagaggtcaaaccagctcactgtttgtttttgtaaataaatccgtattggaacacagccaagatcatttgtttatgtattgtctgtggccacttttgcactgcagtggcagagttatgtagtaataacctagatctcatggcccacaaaacctaaaatatctagtgtctgttactctacagaaaaagtttgttgactcttgagttaatagatgaaaaacatttagaatggtccatggtataagcacttgctatctatctatctatctatctatctatctatctatctatctatctatctatctatcttttcttgtgttttttgagacagggtcttgatctgtcacccaggctagagtgcagtggtgcgatctcagctcactgcaacctccgcctcctggggtcaagttatcctctcaactcagcctactgagtagctgcaactacaggcatgcaccaccatgtagctaatttttgtaatttttttggagagatggggtttgacatgttgcccaggttggtatcaaactcctggcctcaagcaatctgccggcctcggcctccctggccactgcacccagccctatatatctatctttttgtgtgtgtatgtgtgtgtagtatgtgtgtgtgtggtgtgtgtgtgtgtgtgtgtgtgtgtgtgtgtgtgtgtgtgtgatattacttactctatggcaagcacttaggatgtttactctacttcttgtcctataaaataatttagtctctactcttatgcagaggcccagagattgagagtcatgggtcaaaccatttgggattggacaagattatccttatacatttcttcgaaccctttaattctagaaaattcaaaaccaaattcaaacagaagtaatcaaatttactttggaagggttttgagtctcataaaaatgtgcaattgtgcatttgtatgtatagcctgtatatccagttaaacgatacccaaactcctcaggggaagattacatatctatcaaccattgaagccagaactggccgtgtcacttgtttttgccaatgaaacaagaggagaagtgaggaaggagttttaagagctagtttgagacttactgtgttctctttttctcagtgctcctgatatccaaaattccccagatgcagcatgctccctcagtgtggaaggtccatgagtaaggaccatgaaagtcacagctgagccaccagggcaaatggagtaagcaagaaattaatcagcctttgttgttcgaaggtgctgaaggttgttagcctaccacaacatagcctattctgattgatacagtgattgttcaatgtctgccctttgtccagagtataaaacttccatgagaaaaggagacaaatcatatttaatattaataatcatattcatatttactattggagacctggcatctactatagaacctgacatatacatacagattaataaaagaagttatctggtagcatgtgaatagttaatagaagaggtaaatgacaatatagacaacatagagatgttacaattactattaagtgctataaacaaagagggtgccctttatgacctagattccctgggaggcaaggagtaaatgctgatggatgtctaccatggagcccaacaggaagaggtgtggtggccaggaaagcagaagtgaaaaggaaagagaagggctgtataaacaattaattaagcaggaaagcacaaagtatgtctaatattagggaacggacacatttgacagaagcagaggcagagagttcatacagaggtgaggtgagaataaaatctacaggaaatgcatgcattgttggataaaacccgaatttgcaaacatttttgttgctttaaatggtgtatagtcaacacttaaaaatggctcaaattgtggattttatgttatgtatattttaccacaacaaaaatctctgtctccagggttcaagagattctcgtgcctcagccttctgagtagctgggattacaggtgcacgtgaccatgcccagctagtttttgtatttttagtaaagacagggtttcaccatgttggccaggctggtcttgaactcctgacctcaagtgattctccctcctcggcctcccagtgtgctgggattacaggcgtgagccactgcgcccagccaaagtaatatattctaaaaaaataaataaataaaagttcagtgttgatccatcacccacctggatttagggcagaaagttactgttcactgagcattcggccttcactgtacttgtcagtgggggatataggaaaagtgcatgtagaccccatcagctttcctggaagcctggacacaaacaaaaacgctggagagagtctcagatgaacacggtagagtgtcacccaaaggtggacagatcattacaatgtaatttgatttttgagggagttgggggaagaaagaatgggctcagaggctatgaaacgaagtccccgcttgaagaattcaggtcaaggggccaaggagagaaagactctgggggttggagcatctgtcatcaatctggataataaaagtattatcattttataaattagataacatccactttctccctgtgcttttcagcagttatggccattaaggacaccatgttatgtagcagaaattgtgtatgccagcaatgaaccttctgtgcttacacattttggccaagtcacttcgtattatcttatacgtggcctctctgcatggctcagtggctcccctcctctgctccaccagcctgcagatcagctctgccacagtgcagctctatctgccccatgtcatttgtcttcttgttccttatttgactcttgccagcaaatctcaccgcttgataattgagccagctactgaactgctctagcagctcagattcctttccctagctgtcaccatcaggtccagtctttcactcccacatcttgcctcattcaaccacttttgttatttctttaaaataaaatgtgtctgaattctgggcatggttttgggtgggattctgggcttgcatgggtgattcaccgttttcctccagctgactcagagcacccctgcaacccaataagacttcccagtattgggtctactcttttgtcctgtccctcaggccccacagtcatggaattggtgagaaggaattaagacactgaaatcagtcatggaaacaatcactctgttcactccagcacatttaggtggtgttccatgtttactggaatgaatctggatgatagaatctcaggactgggagggccaaagaagtcatccattttatctctgtcccaaagtaggaagttatacagcaacacatctgatctctgtggggaacctcactccccatgaggcttcccagtcatatcaggagacatgggcttgtggtgcagaaggaaaaataaagggtgatggcaacagaggccatggctttgacactatcctcgccaccatgggcaagttcttcagactgtctgcatgttggtgctttcctagtaaaatgtgggtacaattctgacaaagtctgcctccctgcgctactgcacaggttctgtgagaaggtgcatttgaacagcacgcgtccacgcagttgaagagggcatccttttacagctctgagtttgcaagggtagtgccctgggcatggggcctccaaagagctatgctggcttccaaggctgctgaccaggtctatgctgaccccagtgctcaggggttcatgagcctgtcagaaataggagggcaaaataataaataaaactacccccaagacaaatccagctattgtagccaactgatagaatctgcctatacctggctttatgaatacttgtcattctgtaaataaaaaaatgaagaggtagagaaagtcgtttacaagaataaaaggaaattgggtggggggagggtgagaggacagttgttttatatatacatatgcatacacaaatgtattaaaagacacactactatcacacatatattggggagttgttctgctcacataataaagagctgttttacacacacactcagtaacgaggtaaaacatataaaggacacgacagttcctgggacacagtatgtgctccatagtaaatgctggttattatcattgttttcagtatatccaacactgagcccaaaataaaataacgtgttttgcttattggaataacaagatcacacgacagcactgaaattgcttagtcggaaaatgcaagaggtctcactcactcttcatccctaggccggtggctttcattccacgttgattgacaagcacctgtgcggtgcttttagaaagaccactacacttaactgtgctgcatccacaggaagcccagcgccactggaatggaaagatggacgtgaccatgtgcgaatcccttcaagaggctgtgggttccctttgcacactatgacaccaccgatactccatcactttaagcaccaacactcaatcatttccttaaggttttcatgggcatcacttttcctctttatttgtcctaagagaatttattctcagagattttgtaaaagagcatggcaggaacttaattatccatttcctggtaattttctacatccgttgttccatattgatttgctatttaaaaccccctttaggttgtttactgatgtcctcccagcctgtggttcttccctatttaatacatcatcaccagcgaacacaaatgctgggtgacagttactttcatcgattccaaccaatgtgatacttgggttttggaagcagagagtggcagtctgaaacgactttttctattgcatctggcacatggtcacgtgaaggaatgcacacaacgtataatcaaatggcggtggtcctgagaggaaggcggtgacttcacaagatctcacagcaagacccagttccacatctctctgcaagagcagggacccacagctcagataaaacaagatggctatactcttcgttcccaatatgtcctagaaattgctgttctcagtaaatagcatcttaataaatcaaataaactattagtaaaacaaaatatgtacaaatttaaaaagaaatatttgggacatcccacattaaagaatgtgttaacttcaatgtattcatttgaagcctgtgtatccacagccacgtacagtacgtgcacatggcgatttttctattttggcaataactgagtgagaagaaaggaggggttagctagacattgagaataagatggctgctcagatgggcctccgtcaggactgtaggctaagaactgtttgatggggatgcatggagtcaaaacgcaaatgcctggagtgaattttgagagcgtgttcaatggtgtaagatgcttggatgtgtgtaacttggaatgaaccatacacagaaaacacaaggttgtcttttcccaaagggaggcagtctcctattagattgggaagcctcccagggaatgatgcgccccagagatcccatgttgttgctgtataaggtggtcttctcccaaagggaggacacaaagggtttactatttcttattctcgacccaggaacatagcctaacaaatagaaagaaagagaaagcctagcagctatttattccttagtgggatatgctcctttatatcccaatataaaggaatctcaaagacacaacatataagtctctttattgaaagacgacttgatgaacggttaatggaggagtaaaagcacaagagttacatttaagaactttcaaaacacagaaagtttgaaaacaataagaggaaagatgtttcaggaatgagattcagaccagctctgtggcttttgttcctcttgttctgtccgtaatttttggtggcagcggttggcagtaggcatagagctggcatcagcctctgtctgcacacagagggactttgtgacggaaccgtgtttccccactcagctcttcactaccaaggcttctaccagcatgcagtggtactacactcccacttgtgcacttacggttctgtttgcctacaacactcttcctccaaagatttatccttttccctcatctcttcacatttctatggggacccacagctcagatgcaacacgatggccatacttttcattcccaatatgccctagaaattcctgttctctgtaatagtatcttaatacatcaaataagctatcagtaaaacaaaatatgtacaaatctaaaaagaaatatttgggacatcccaggttaaagaaatgtgtgaacttcagtgtattcatttgaagcctgtgtatctacaaggttgtcttcagcacaggcacgtggtgatttttccgttttggtaataactgagcgagaagaaagggtgtctttgcacccacgtccacctctcagaaaccttcaccaaccatcctgtttaaagcattaaacagcctcaacctactatcacccttccttgagttatttttctctacaacacttttcatcaaacatagcatgttacatgtttattttagtagttgtctgcctgctcccactggaatataagtttcacaaagataggaattttgtctctctaaaattttctgtagtcttccagcccctggaatagcaccaggtacagatgagttcttagtacttctgtgttaaatgaaagaatgacggcatctgggaacagcctgtagagaggtaggtcaccattcaaggaagaagggacacagagaggggacagacaaggcagaagaaagaagggaaatcccatcgacaggagagaaaggggaaaataaagaagagaaagcgaagacacacagcagacagcctggagggagggatgtcagcaggagggaaaaggacagggcagcagtaccaaatgctggtgtgcgggccagacactggagaccgctggatttcaaaactcagtgcctgctagggaacttcaagaaacacgtgtcagtaaatgatgcagctgcaaattgctaccgaggtaaagaaagatttagaaagtagagttaatgaaaataatctagttaagaaagaaagagagagggaggcaggcagtctggccagccagccttggcagcacaggcctggagagcaagcttgttactttagcagtgtatgccggtgtgtgcgtgggcaggtgtgtgtgcatgtgtgtgcatgtgtgtgtgtctgattcgtgactgtggattgagaatgtgtggacagttatttcaagtacacaagatctgcaccatgttttcttttataagcaaatgggagaaattaacactgaattaaaatgtggtgtgtattttagtttctctctgtatttcaattccaggaaataaattatcacaattttcacaacttcaattcatttagagcctttttagataaaaattttgtaatcgctcagaactgcacttccaagtcaaaagaattaatctaaatatgtgttgctgactcaaatagagaagagtaggaacaaagtaaactcctaaaaatttttcttaaggcattttaaaaaactaaaacaaatgaaaagccctataggacccaaacacgcaggcaaaatgaattctctgaagagaaaaatgcattttgttctaatattctcttaatagatttttttaaaaacgtgataagaagattgaaagaaacctgggtaactcgagatagattatgcaaatgctcatttcattttcctacttctgagtgaggcctgggcacagttttaaagctgcaagaccccagcactcgctatctctgctgcccagctggcgcgcacaaccaaaggattatgcataagatgcacgtggttcacggagccaagacatttatgcggagctcaaaggaatctggcatactgtggttctcgggggcttagaatgaagattttaaaaatacatttccatgattttcaccagcttatctcaaccaagaggttaaatattagagagagagggagagagagagaaagaaagagagggaagaaggaagggggtggttcactgcttctgcagccaggaatggaaataactttgattcttaggttatatttgatcatcaccaagtcctttcctcatctcctctctttccgaaaatgtgagattcgtatcagtgaatcttccataccaaattttactataaccattcctttttccagggtagtccctctaacatagaaaaatatgccttggcatcactcaggctcagaggaaggaaatgaacatactatgctatattttcattgtctccacttctatatctataaattaaatgacataacttgctaggaaaaaaaaaatgccacgctagtctgaggattttggccgggggtctcatgactttttttttttttttttcacaacatctcattcaacaaccactccatagcttgaggatatgctccctcaaaataaacgcacctgtcatcagtgttcccggatcagagacaggcagctaataaaaggttcatcaggaatggctgagaagccagggatccaagcggaatcaagcccagctttgtcatctcagcactatctctgtctgtggtgagttacagttccctgtatagaccaaagacaggaccccaaagagaggtaacccagaaaatctacctttgctagaatgtgaaaatatgaaaaacataaaggttgggtatttttcaaaaatagaaggaggcccttctcattcatatatatatatatatatataaatatataaatatatatataaatatatataaatataaatatatatataaatatatataaatataaatatatatataaatatatataaatataaatatatatatataaatataaatatatatataaatatatataaatataaatatatatatataaatatatataaatataaatatatatataaatatatataaatataaatatatataaaaatatatataaatataaatatatatataaatatatataaatataaatatatatataaatatatataaatataaatatatatataaatatataaatataaatatatatataaatatatacaaatatatataaatatatataaatatataaaaatatataaatatatataaatatataaatatatataaatatatacatatatacatatatataaatatatacatatataaatatatataaatatatacatatataaatatatatataaatatatataaatatatacatatataaatatatataaatatatatctatatatatatatataaatttttttctttttctgttttggagacagagtctcactctgtcagccaggctggagtgcaatggcatgatgttggctcactgcaacctttgtctcccaggttcaagcaattctcctgtctcagcctctcaagtagctgggactacaggtgcgcaccaccacgcctggctaatttttgtagttttacaaaaaaccccgtagagatggggtttcaccatattggtcaggcaggtcttgaactcctgacctcaggtgatccacccacctcgacctcccaaagtgctgggattacaggcatgagccaccatgcccggcccccattttatattgatagaattctcattttagatcctattaaaatgatatcagcattttaggcaaaagtagctatagttctatgagaacatcatagaacttagtctttcttaggtgaatctcagagataaaataacatactggaagaagaaataaaccacagctctatttgtcttaatctttgatttgtaataaacagaaacaatcaagggagattcttttttctgtatttgccctgctgtgtacgtcaggtgttgactacccatgtgtaatcctaaactttcaaatggaatttccctggtaacgagatggtaacataactgctaacagacccctgcatatcagtgaaccatgcataactttaacaaatgcaatgcaaagggtggtggtctgcatggattatttctatcaaaaatgaatttatgcattcaccattagaagcagatgcaagactatagcttaaaagcaaattagaattcaagctggatttgcaaacattccagtttaacatttggatagcaaaggaactcagagtttataaaatttaaatataagatagacagtcacaattctgtgcaagcagtcagggttaattcagatcgtttcctctgctcttgcattccctgatttcaagcacggcgaggctggggctgtaattacggaatgggtagtactcactgttcaccagttgtgtgtaagctttaaactaataactcagcaattacgagaaaaatgagcggtaattacacccattttactcgcggctagacagatgggacattttctcctcgttattggcaaactgtcaccacatttatttcatttttactgtttactatttgttgtgctttgattaagagtaattataggctaggaaaatatgaaaaacatgaatgttgggtatttttaaaaatagaaggaggcccttctccctgttttatattgatagaattctcattttagatcctattaaaatgatatcaacattctcaagatatttccaggcaggcttcagttctgtgacagcttttcagcaggggattcccatgtttgctcattatttgggtcgtcatagacccataaatatcctgcattttttttttttttacagcagcctctgtgtccctcacactcgtccattttggtccattttggtccattttgtgtctgatgataaagcacaggagaaatccacccgtcgctgggatccacaggggagtaacgccaaaacacggcaccgctactgtcttcgcagcttttaggatgaggagcctatttctctcccatcactgtaaaataattttatgtatgttgtccagtagaacaatgatgttgagagttctttctacaatttgcctcagaagctttttagtatgtgacattagttttaagatcatgtgatacttagatactgacaaagtatgagcagtactgataacaccagtgggaaaaatagatttgaatttattttgtgcgctcatgtttgtagaaagtactattaatatttaattgatgtgggctagaaatttgaacgattttgaaagaaatgtgaataacaaatcagtacatatagaatgaacatacaatgagcacaagttttagttaatatttaaaatggtatctattttagagtgagcctccatgtgtaaaataatgtacaatttgtatggttcttcgtgatgctttgtgtatgtgtatgtgtgtgcatgtgtgtgtgtgtgtgtgtgtcatgattagctaggctgtggttccaaattctaaacccttaaagttacagccccaggagaaataaaagccatcacaattcacaactggcctgcattgaagcatgattttgcaaacaaaaatgctttttccctccataaaagtcatacttgaaaatatctgagaagttatttttggcatcagtttttcttaatgggaggagaaaaaaacccatgccttgttctacacgggctccatatcgattcatggaagtgccatgtgttaagcaccgacttgctaatagtgctgcctgtgtggtgatctgctgagctagcgccatgcacagaattgattagttcccttaatgagctttagattgtgcttctaccagaataaggacgcaaagcaggggaaagtgtgcatctggagaaaacccacctcaaagcagctgcagagaggaaaatcaagagaagtggcagagaggaaaatcaagagaagtggcagaaaactatgggaaggtgggacttgaggggagacctggagacaaggccaccttttctttttcagaagatgctgcagcttgctccatccctgactttctccccagcggagggagaacagggcagggtgatgtgcaaacctcagtccccagcaatgaccatgtgcagcatggaaaactggggtcccctcttgtctctgcccttaccatgtgggtaaccctaacacccctccctgatccgcagcttcctgtaaacgaggggaagagacggaggatgcagccatctgtgtcttcatttgtgtgcaactgcattatgaaattttaactaaaaatgttccagagaaagcaaacagtgtaaagctattaaggaaggcggtttagctaatggataaccgatgactgatgtgtgtataagtgagagatggggatggagattctgggatgctggcggaggctctgggagcgcaggtaaacaggcccaagagatgtggagagcagaggttgtcacagacacatgccatctgcatagggctcaatctgccgttagtaatttggataagtatccaaagtttacagagaaaggaagaaggcagaaaaggaactacagaatcaaacagctcccctttcctctctgccacactcacaccccacacacacaaaaacaccacacgcacacacacaccaggggacaatgagatgtcagataagcctcagaacttctacggtgttttacacagtacgtgaaagcaatttaggaaattattcctactttcggaaagaaatataaacagacaacattatctagtctattgtgttcatgttgaaagagaacaactgcataagagccctactgtttgtgtaaaaagaaactgtcttcatgtaaaataaccaaacctagtaatacataggagaacgatgctgcatggaattttacatatgtaactcagcgtttattttgcctcttgcctttagtaaatatgcaagggtttttctaatgagataaacagagcgcatggcagtgtggataagatgcacagagcaagctgctctagaatgttggtggccccatgggtgtggtctgggtggtggacgtttaaatctacctcacggaagcagctagatgagtgttatacaaggaaacggggcgagagaaaacagacatgagctggtttccactaattgtaggaaaaggtatcttgattaagtattcaggatgctttctctttctctagaagctcaaaagaagccttttgtttcctgtagcaatgcccatttgccagatcacatttaagtcaagcagacggttatttgagtgaaaacaaaccaatttgcttttgctggttccagttctttcttttggtcacaggctttcaaaagaagctttcttttctccttctcttaaatatgtaacacaagagattcaacatgattgaaaatatctagaagagaagttctagaatatcctaatcttaaggcttggattttcagataagaatttatttgactcctatttggtggatttatttactctgacatggagagccttactacacactgataaaagccaagttaatatgtatttcaaagtttacactcatcatgcctgtaatcccagcactacggggaggccgaggcgggtggatcacgaggtcaggagttcgagaccaccctggccaacatggtgaaaccccgtctctactaaaaatacaaaaattagctgggcatggtggccagtgcctgtaatcccagctactcggtagaccgaggcaggagaattgtttgaacccgggaggcagaggttccagtgagctgagattgcgccattgcactctgcctgggtgacagagactctgtctcaaaaaaaaaaaaaaaaacaaagattatattcatgtattcctgttgtggattgggatgggaaaatcaaggctcagagagggtaaatatttgtccagggtgatacatcttgtactggcacagctgggccctggctgttggactccacagccctgaaggaacacagagatgaagacttcaatactggtgttcctcatgatgcaggcttccctggtgaagaggggcaggtgctagtctaaagaatgaagaaacactggaggcggagagcacagcagggtgacatggctggaacagaggcacgataagtatgtatccagcacaagcaagagggagcagctgatctaggtcatagttaaaagcacccattaggagtactgagaaattacaccggaaagagccatggtttagaactagaatcacctggagagcttccaaaaagagaaatttttctgcccccagttacaggagtttttggttccagaggtgaggaatgaagtccagggatctgcctcttcacaagctctcctgtaattctattttcatttttttaaaaatgattttgagacaaggtcttgctctttcatccaggcttgagtgcagtggtgtgatttcaactcactgcaaccttcacctcccaggctcaagccatcctcccaccctagccacccaaagtagctgggaccacaggtgcttgccaccatgcccagctaatttttattttatttttttagtagagttgggggttctgccatgttgcccaggctggtcttgaactcctgagttcaagcaattggctcaccttggcctctcaaagattacagcctcctgtgattctgatgtgtgatgagaatgagaatcaccagggcagagggcctcccaggagacccagtgatgggctctgtatttgctttgataagagcatagagcctggactcagggctctgggatacataggctggggctgctgtgtgtttcaggctcctggcacctgctgcagtctctggagtgaactaaaactgttttctattagagggatgagtggcggggtgggtagatgaagagacactagagattaatatgataaaattccagagtgcagctcagatatgtaggaataagatctgtctgatggctactgcctgtaaatacacaatgtttttcctactgtcttgaactgagtaagacagattgatatctcatctctaagtcacatttgggtggccttcaggaaggggcctgacttcttcttgttttattttctctagcttggagaaacaacatattttacaagtgagcaacctgtttgagaacagaaattttgcaaacatcagagggtcatggtgaaattattgtagaaaactttggtttaaattcagtttcgcgagctgctcaggaggacttcagagccttaactgtgcactgagaagctctcaggggagaaactacctccacaggtcacccaccaatttcagagtggactgcaaagctctggcttgagatggcagaggttcaactaatttgggatgccggccaagagtggactcttttgctttgctgttggctgaatggtgtctcaccaacaaaattcatatattgaagccctcagtcccagtagaatcagatttgtagacagagtcttcaagttagaatgaggctgttaaagtgagccctaatccaatgactggtgtcctcataagaaggttggccacacacagagataccagggatgtgtgcacagaggaaacaccatgtgagcacacaatgagtatgcagctacctgcaagccaaggagaggccaaacttgccaacacttagtcttggacttccagcctccagaatgtgtgaaaatacatttatgttgtttttgttacccagtctgtggattttgttacggcagcctgaacagactaatccatgcttcattccatccacatttgttcaattgagaccagcaggctcaccatgcataaaaaccatggcagatcttgttaaactcccaacttcccaagccccagcccagacattctaattcagttggtccaagactgagattcagaatgtgggtgacttcagaactccgcctagagaaacagatttcacagcttggcagagtgagcaaagccagcacacagcaggtgcttaataaatgctttctgaatggatgggttaatggatgaacacgctctttcaaataaaagagtacaaagccaaactcagataactttatgacatttctcacttcagcaagcagtgtttggtgagtcaagtggtttatctgtagttgggaccctcatcagagtgagtgaaaatagaaaatggatagctaaccaatggtgaggcaggagaatagggtttagggtaaccaagggttaaggcataagcaagaaaacagcaggttcggccagttctaggaaagattagcacacaggccatgccctcactcctgtgatggcaaaacagtagtttccacctcagcctctggtccactgtgggccaagtcttcacttcagcctctgattggtggtgggccaatctttcatagggtgtgactaactggaggcctcgaaagggcacctaggggtgttaccaaattcttttagcttaatagaaaccctaaagaacattgcattcggggctcttgagctgcttgcttgagcctgctcccactctgtagagtgtactttcacttcagtaaagctggacttttgttacttcgttcattgcttcattccttgttgcattttttgtggattttgtttagttctttgctcaatgcaccaagaacctggacaactcacagtcaaaacgttccatccctaaaatctgaggagatatatagtcattcttctttttaaaacagtttcaaaatacaactgccaaattttaaaaattgttttcaagttactaaagccaagcactcatacccttctaccaaattttgcaagtaaagattcaagaaaaaaacacttcattttattccagcttcaggttttggccacagaagcatacacataccgggggctgccaatctaggacactttcctagcacagcctagaaagagcatgatgggctcttttgagaataattaacgtactctcttcttgcatcctttctccctaatatttcctttcccttccttctgtggtggttgtttgatgtcctgaaagccacagcaattaaagaaaatgttcttgagcatagaaataacaatcagccctgtttcttacagttttgatgattgagtatgctacacaggcatccgaaaccacagagatgcaataactgaatgtaaagtatccgataaagagcagtataaatcatgaaccaagagtaaaaatgttttattagagatgatgatacataaagatgaaattcagctggactgtagaaggctgttaattgaattagggtaaaatagtgaaaattggaactgatccatatttgtggaatcatgtgatgctttaattcagttttttttttagtaggcatccactatttagtaaagacttataactataagtagtatgagaagaataggtaggacgattcctaaatctcatagcaatcaggcaggcatacacggtgcccctcttcatgttttatgttagaaatgcacaatccaattctctatctgaggtaaatactcctgtaattcacaaaacactgtgatgtgttttgatgatattaggtcatgggtctaaaaaatcaagtggttattatacaattattttaccatattcacttctaaattcatttcaatttagaaaaatggaaaaattgagcaaaaagtattttgttgtgtccagggaatattccaaaacaataaattatttaaactgtcttgggacatcaaaaatatttcctctataaaatacaatgggtgcagagtgaaaaacaatacaagtattagaaccttagagcctttagcctataaaattaactgcactaaatgaaaagataccgttcttggaggcggtggaggagataaagtaccaccatgaagtttgagccgatgaagggagcaggctgtgaaactaggattgaaaagaaagacacagggtggaacataaggcctagaaattaatcctgaaaatcactaaaagaagtggctcctggctgcaatcctagcactttgggaggccaaggcaggtggatcatgagatcaagagatcgagaccatcctggccaacatggtgaaaccctgtctttactaaaaatacaaaaattagctgggtgtggtggcatgcacctgtagtctcaactacttgggaggctgaggcaggaggcttgaccccaggaggtggaggttgcagtgagctgagagcttgccattgcactccagcctgggcaacagagtgagagactctgtcaaaaaaaaaaaaaaaaaaggggggctgttcacctgataccatgagcactgatttcttgttagcaaagagaactcacgtggcattgactgatctggagtccatcgtgttgcccaccaaacttcctacaaacttagtttctgttctctagacatatcctagcttttcttccttggatgaaatatttagagatgacagaaataatgacttccaacatgaagcatgtaaaagcgaagagtggctggcagaaaggattgcaggagaaaatggaacacaaaattaacatattaagtagaaagctggtgtgcagttgaatttcagtgaggctgactggccttgctcagctgccagggaacactctcgactcttgtttccaatctcttccaggccctccaggggccctggaccatctcttgggtcccatcacagctgagagcctccatgccctgcatgcatgaatgcatccacttgcacacacagctcgggaccagtctccaagggtttctgccaatattctcttctaaagtttcgctttgctctctgccatcactctatactttcttgccaagaatttataacatcataaagacacaaagttgttcaaattttgctctgggattttgaaggaggaaaaattcaagccacaaatatgcatggggctatgcaaatttatcactgtgagaacaagtttttcagtcctattatcatcactttattggtggccgaattggaggagttgttaaagttcagaagaccagcattcaccacacgctgttattaggatgtctacactaatcatagcttacaaaggccaatcgatttgctctgaaattataacagcaacaatctttgccttagttcctgtgtgggtgagcactgtttgtatatttatatccttatttctggaacattaaaaactcttctgtaatatatttttccatcagatatagttgagaaaataattataaatagcccattaaatgttatgaaacaataaaaaatctgattaaacatcaatcccagactaagaatataatgtaagatttgatgaattatggctaattttatgccagtttttatggttattaaataagtttaatggaccactcgaaattccattacataaatcatagtccaaagtcaggttctcttgtctaaaatagcaaaatttctagtgataggacaaaaatttaatagtgctagcacagttataagacaaaatctttggtgtagttaggataaaaactatatattatttgagaaattatgtccattcaaaatattccttctagaactacataccttcaaacctcatcagataatagtagctaatagctatttttcatttcataatgcagaaaccctaggacctttcaacattaatacaaatgtggctgctttatataatgcctcacatctgcatgaaaaataagacacccaacagcatccagctgactctaaatgtccagatgctgggaatgattcacccatgtgtcttccacattgaatgtgccaaacagtgacgctgagtgggcaatgatgtgctgcatagggggagggagagatactgacatttgttagggaaataaaatgaattaacttggtgcatgcaacagcacatgcaccgagtagcaagaaaacaaataaatagagaaagaaagcagttgtagttcacatacttgcaaaatttggaaaagtaaaataaaagactcagtaactgaaaagattcaataactgctgtgctgcatgtatatctggggtgatactaaaataattcaacaacctgcacaaatacataaattagtaattaaaaactttcctctaatttcatacatatccctgtacacacacacacacacacacacacacacacactcacacactgctcagcaagtttctgaagctatagcattgtttacccaactgtcctgacacttctgattttaggaattgctagggtgatctctcgtttgggcagatgtcccaagctgacgtccgtggctgagctgttgatagtggcaggagacagacaaatccctaggcagacagtggtgggtccccattgaaacccaaccttcaagccgaagacagtttaaagcctagctataagtcctgggtacatccacagactggattgagaacctgtctttccattttggtgcacttttctctgattgatccccacccttcatctattttacatatacctatcctttcctaattagttttctacactgtcgtgcctttgagtggtgtcttcattttaaccttttttgcacactcataaaccaatcagcacacactctccattttgagtccataaaaagctccagacctagccacactgggagataaacaacccaactgaggggttgggggaccacccactgtatcccctctccactgatagctgttccatcactcaatacaattcttctctgcccatcctcacccttggaattgtcagtgtatcctcattcttcttggacacgggacaggagctcgggaactgccaaacatgggtacaagctataggacagcaagctcagcgggtgggggtgcctccaatggcaggcccggggctgagcaaggcccaggcagggggatatcgccagccatggaggtctcttgttggcaaagtggctgagaaaaattctgcatcactgtgatttagcctcacacactttattgacctcccattaagctaatagtcatcaggccagtgcactacatctggttacaaaagaaggtgtctgggctgggcatcacccagaagccagcacttttcagctagcttgaacttaaaagaccattgtcttggtcccaaccccaattcctcaaggttagcctcagcccccaccctgttgggttgtccctgccacctctggcccactccagagcagcaggaggcattgcacacatcccacctggaacctccacctctgtccacctccaagacagccccactcccaagaccacaccaccaccacagcctccatgggccaacgtcattagataatgcgtggtctcaagtaaactatttctgattaccaactactacagaagaatttaaaatatatatactttagcaacacattatgccacattgttttatgctggctggatacctattctggatacgcctctttatgtgctctgacaaagaaatcccaatgcaatgccctggcaatgagaacagtgacacacaaacaataatatgcaggggtggaaaaaaacatgccaaggtagttcacattaggggaggtctcagaagcgctttgagaggtgagtgtgccacagtgaggtcacaaaatagagatgttgtgcaggaaaggttcagttgagcccagctatgccagcaagcccagggcactgcaggccaggtagttgtctctctggattggatggcaccagctcctcttttcactatattttgtctcacctattctgtcagcagtgccttctgcaaggaaacttggagagagagagagacagagtagagtttgctccaggtacagacctggagattgcagaaggctggtggccttgagtctcacttccagggtgctccacactctctgtgagatgagcagcacagaggaggtcataaggctgtgaccgacaacaaagcttattgcaggggtgaaggagcaggggagaagtgagcaatcacttgcaattttaccaggtgctataaaatcactgacggggactttttttttctttttttaattgaactgcttcccaaggtcaaatgcccaaaacaaaaacctcttcatctggacaaggctttatttcatccaagcatctctaagcatttattccctatctgtcacattttgcatgatgtagaggcaacatttccacttatcattaactaagtggttagacaaggtagttatcaatttcacaagggtggaggtatttaggcaattttcatcaatgacattgtgatgggttaattttatgtgtcaacttgactgggttaagagatgcccagataactggttaaacattatttctgggtgtgtctgtgaaagtgttttcagaagagattaacatttgaatcagtgaactgagtaaagaagattgtcttcagccacgtgggctggcgtcgtccagttctttcagagcccggatagaacagaaaggcagaagaaggaggagtttttccactctcttttcttgagctgggacatctgtcttcattaataaagaagtggggaggctgggcactgtggctcacgcctgtaatcccagcactttgggaggccaaggcgggcggatcatgaggtcagtagttcaagaccagcctggccaatatgatgaaaccccatctctactaaaatacaaaaaattagccaggcgtggtggtgtgcgcctttagtcccagctactcaggaggctgaggcagaagaattggttgaacctgggaggcggaggttgcagagagctgagatcgcaccactgcactcaagcctgggcgacagagcaagactccatcataaacaaataaagaagaggggaaaggtggagcctggagagtgggtcaggcaggagcttggtttaggagttttcccagttctaggggagggttcctaaaggttgtccagctgtccagttcaaaatctggagtataacccatgatccgaggaaaagttgaggtctggcctgaaacactatggctaggattctggggcagctttgtgggtgcacagctgaagatttgcagctcaggtcattgcctcatgagctccaagcacacagaccaactccaggccctgtctcctggggtggagaagcatctaacacatggacggccttggctagatttgggttttgaatcacaatgtttaacaccgcaaggcttgagggtcttcaggcaaattactgagcacaactatgaaggcagccactaatagcagcaaaagtgtattcaatatttatatttcttatgagccatctacatggttcaaaagttagcacattcttccttaggctcctgcaggctttgacatacctttatgaactgctccaaggattgggaagtcttcattctcatttgcaaaccgtatatattctgaatacctgctcatatcccatctcgattatctcatcaataatttccatccctctgatttacacctgtaaaagcaactcacttgcttttcccaacctaaagagtgctgtggagtccctggagtagagctactgcaatttcgtcactctctgacctgttggaaactcagtttcaccgcagctttacaaggctgcagagtcttatatcttacatgcatattatagccaacactgttgactgattgctcaagaaatatcttggttttgttctgatggatatatactcagttttagggaatacattatgtttgctttaagtcaaatacaccaaaatcagtttcttctgccaggaattagtctaagtgggacccaacttcaatgagataaagacattttttaaaatctgttggtgacttctgggaaaggatttcctccttaataagggacaggcacaaaagaggtcagcccccccacctttttctctgctggccccacctgctgacctcagcactgttctctagggccatacttccccatttagttggtggcattcttttctcaggggaaaaggtaaaagattataaaggagtgagaaagtcaagttacttttagctggtgagaacacatggacacatggaggggaacaacacacactggggcctgttgaagggtgggggtggagggaaggagaggatcaggaagaatagctgatggatgtggggcttaatacctgggtcacggaatgatctgtgcggcaaaccaccgtggtacctgtttacctatgtaacaaacctgcacatcctgcacatgtgcccctgaagttaaaattaaggttggaaatttgaaaacaacaacaacaacaaaaaaaaaaaaaaacaacttctagctataagaatcctgctttgagcttcaaaagcctaatctctgtgtcatgtcatttagttgatgacatgaacaacagatgccaaaagctatgtgatcagccagaaccatttttttccacccagactgaataacgagcccatggctaacagcagagaagccctgagtcaaggacctatccacaggaggcacatccaatgggaggagacacagtggaaaccacacatggctttgggcttagctgagagcccagggaatctaggcctgtgtgcagtaaagggttaatcccacaggcttagggggtccaaatcccacacattctaaagaaagatcttgcccttgactgactcctaggaggtaacctctaagctgttgcaatttccagcctgataaaagtgtcattacagacctgaggcttggggccaggcaagattgtttatgccaacaattggattatgacgagtgtctgtttttattcttctgggaccctgggccacgctgtgtcagttgaacctctggaggaggggttggagactcaagtgttaaggtaagtcatctgagcactctatgtgactaacccctaatgaaaaccctggacaccaaggcttgtatgagctccctggttgatgatactctgtatgtgttgtcacaacttcttactggaagagttaagccctgtccctataggtctccgggaaagacaactggaagcctgtgcctggtctttcctggactccttcctatgcactttttcctttgctgattttaatctgtatcctttcactgtttcataaactataaccttaacaacaatagcttttcagagttctgtgagtctctccagcaaatcatcaacccaaggggtggtctcaggaaactccaacacagtccaacatttccacatgggttcctgttaacgacacggtcttggagcagtagaaaaaagatggctgctttgatgtgcccaggtggatggtcctacaacagcctaagagagttcctccacctctggagagggtggtccacagccaggcattttcagggtgtctcacaaggccatagatgttgttgaaagagccttttgtggagaggctttatattaatagttaaggacacaagaggccagaggcaatctgactcaatgatggaaacttggtagctgcagatgccggccgtgaattggtatcagtgatggaaagaaggccacaccctctctacttggtctgctgagatcctttagccccaggttagactcctaaacacagaggaaagcacccagacacagagtggagaagaccccgcgttgactgtgatcatcgtgaattaaatgaaattaagattctaccacctggcatcatgcagtatatgttacaaattaagttgaactatacaaaaatacaacttcaattctaaccatgccgtctttgtggattaaaactcatacctggccaggcgcagtggctcacgcctgtaatcccagcactttgggaggccaaggcaggcagatcatgaggtcaggagttcaagaccagcctgggcaacatggtgaaaccccatctctactaaaactataaaaactagccaggcattgtggcgggcacctgtaatcccagctactcgggaggctaagggaggagaattgcttgaacccaggaggcggaggttgcagtgagccgagaccacactattgcactccagcctgggtgacagattgagattccatctcaaaaagaaaaagaaaaaagaaaaaaagaaaaacctcacacccattacatacatgaaaaactgttagctttttaacccaatcaccaatacgatattactgtctggtaaaaatatttttgttttcctttaaaaatcatattggctatcagggaaatggacccaaatatgcagatggaagttgtttatcaagagcatagaaatggagctctaggttgagtcctagaagcatgctctctgctttctggtgctagtacaaaatcaatagcagtactttctcagcacctctttgatgtcagcacatggcacatgtgaagcaagaggctgttcgattttgattgttcactgcactaaatttttacagctgcggtaacaaatcactgcaaacctggtggcacaaaataacacaaatttgttacctcatgctttagagatcaaaatcctaaatggatctcactggactaaaatcaaggtgttggcaggactgtgctccttctgaaggctcgaggagaaagtgtgttttgtgttttccagctcttagaggccatccctgtttcttggttcatggctgcttcctccatcctcaaagtcagcagtgcctggcggagttttcctcacatctcatcatgctgaacttgactctcctgactctgactttcacttataatgacccttgaacaacaccgggcccatccaggtgattcatggtaatcacatctccagattcttaatcacatctgcaaaatcctttttgccatgtaaggtgaaatattcaccttccagaaattaggacacgcacatctttaggggccattactctgcctgccacacttactaagtaccagattttccaccaggggttaaggataccccctcagctgtggagatactctcagtctagacagggagatacgtctggaaatgcgtatttgtactaggtaatcactagctagcttagggagattccgaagcagccagagaaggagagagaaaatggagcctgctttcttgcagtgcacagtccacagcgtgccacactcatgcacccatcttgacagcaactagacatattaggattctgactctcttctctaccctgcttaaggaacctaaaatatcatgcttgtcttagtccacatgtgctgctataacaaaacacaagagaccaggtcatttagaaataacataaaattatttctctcagttctaaaggctgggaagtccaacatcaaggcacagacagatttggtgtctaggcaaggcttcctctctgcttctaaaatgtcaccctatagctgcacctttacatgggagaagggcaaaaggtgctattgtgctcccttcaatctgtctctcttttttttttttttgagacagggtctcactctgtcacccaggctggagcacagtggcacaatcacggctcattacagccttgacctcctgggatcaagccatcctaccacctcagcctcccaagtggctaggactacaggtgtgcaccaccatgtctggctaatttttttctttttttttaatttttgtagagacaggattttgccatgttgccaatactggtcatgaactcctggatgcaagtgatcctcctgctttgactttccaaagtgctatgattacaggcatgagccactattcaacctcttttttaagaccactaatccacctggcatggtaggtcatgcctataatcctagcactttgggaggccaaggtgaggggatcgcttgagtccaggagctccaggccagcgtggcagcatagcaagatcccatctctacgaaaaatacaaaaattagccaggtgtggtggtgcacacctgcagtcacagctacctgggaggctgaggctggaggattgcttagcccaggaggtggaggttgcagtgagccatgattgcaccactgcactccagcttgggtgacagagtgagacactgtctcaaaacaaaacaaaaataaagcactcatctcatccatggaagcagagtgctcatgatgtaatcatttccttagtggccccactgctcagtcctatcacattgggttttaggttccaccatatgaattttggggggacacatacattcaaaccagagcaactcttatttcattttgttctttctacccccttttgaaggctacattcaacctttcttaacgtttccattttattttcacacgcaaatgctgatgatctttagtttcctcaccagccccttcaaaatcctaatgtgaaaatgttcatcgctttttgcaaaccacacagccaagccctgttgtgcatgagtgaaagctgttgttgcttgcttcattaatagccacactgtcaaacaagctgtgtgtgttatttcttcactccatcctcaagttgacaagaaaaaagcttaaatgcactagaagatgcttcaatagaaaaaaaaaaaaaagttctgtctgcacaagtccggtatgttctcctctcttaaaagagcaagatggatcatttttgtgccttctccatcacgcttctgtgtcaccgttgcagaagcttccaccttaagacagtgaattgcaataataaaatgtctcttcctcgctgtctttgatggtggcaatgtaaaggctggagtttaattacatacaacatatggacaaaaattgtcatgcctactcatttcaggccaatggcgaggaaagcaagaaatagaaatcaagagaatcagctcagtttaagtaagagcatgatgctggagtgtatcttatcttatctcattttaaactaaaggagatcaaagttgagaatgttttcttttcttcactggacaaaaaatatgaaatgctaactgtgcatgaagcattgttccaccttaaccctttaatgcaagtatgggacttgaaccatagtatgtctatcaaaaatattttttaaaaatcaaaatctgtgctcaataaagatttttaaacttgttaaagtatttcagattccccattatagaaagttttgcatgtttgaaaggatgagccactgggcataagagtgagttgatgggtgtgatatttacactctctcctaggtggatatctttctggaccctaatggggtaggtaaggttgccttacatgaccttgtgtgtgttgaagcctagagaggcatgaacagtgtatattcatgggcaggcatactctgcctaatcttctatccccagaggttacttttgagctgacacaaggaatatatcaataattagcccttaagatgcaattctctgttggtctaattactcaggccattttcacaggcaataaaagcaaataaaccagggtacgactccttttaaaatgtaaaaggagtaaaaagcaacattagtgggctagttcaagtgcctttcaaactgcaagaaaaagaaaaagtgaaatggaccaattccagggctttattttcagctgagaacaggataccagagggctgcacagacacaggcgcagctacaccctttggtgacttaccctaaagcaatgtgaccactattttctggaaataaaattgacaggcagaaagaaatcttccacaacgcggcaatctgatcagggagtaccccgcaggagtacccatgctgaaatgatttctaaagtactggtggtacaaagtgatacatttctatttgttttgtgtatatacaagagaatttctggaaggttggataccgatgaataactattagtacctgagggtgggggaggcataccagggaatggagagtaagggactggagtgagactagaattttttctgtatgctttttgagttttgaattataaatgataacctgtttacaaaagtaaataaaataagaatgagccaaccagcaatctccaattcagaaatgctactttgtggaaagaaattggccaggtaaagtttcccttggatatcttttaagtgatattgaggtattaatagagctgagaattaacatttgtattgcagacacaggagtccaggaaaggtcccacagagaaccagggttccaagggatctcctgtcataagctgtcacaaagagattttaagatgaagcagcgccattttagttagaggctggctcattctgagattctgcagagacaaagaaaccaaacacagccaaagaaaacatatcaaaggcaattgcacaaatgtcacttcctgcctggtttacaaaattatcatttaatttctgaacctcagtgggtctgtgaagacactgaccttctagctttttgtcaagccctctggacaaatgtgcctctcaggctgcttctgtcatggcttaaaaattagctaataagtggtttgcacttcataagagtaaacaccatgttgaaactgagccaaactgacactctaataggtcacagtgagctgagaagaaatttcattgcaaatcctcaccatggggcgtcctgggaattctacaagaatcttcatattcatgaagcttaattatagcaaaattgccaatctgtaaaatatggctgcatttgcatacgacttacaagtctgaaacatgaacaagaagactacggtccccttgggatgcccacagtatgtgtagagaaacacaagtgaaagaaaattgatggggggagtgggggtaggaagaaaaataaaaacagatcaagaggtactttatttacctagaaaaatgaaaatgccaatcacagaaaggctcttattatgtacttgtaatcaaccataatattcaaattgctgaataaagaatcaaataaaatcataaatttaagacattagtcttaaaaatattactcattttagttcctgagatgaatggaaagttgcaaaggctgtgtgcacacctcatctgttctgataatcgggcaaatgaggcttcgtcttcaagcccctgcggtaatcaacttgagctcttaagtgcttctttggaagaggggaggcatcttgggataccaggattgcagggctcagcaacatacagacggacaaccatcagtaacgctgcccccacagatgtcaccaatgtgcctccaagggtcaaaaaaaatagtcgtgtttctaactatttgataaaaatggaggcaattaaactctgggaaggctatgatttcttagcaaaataaaaccttggccccatgcattcttcccttcctcctatagaaggattgtctggtgtactcctgttcacagcaaatgcagaatcccacactttaaaacatcctctgttcacacctgtttggtgatcagatgagtatctatctatctatctatctatctatctatctatctatcatctctctcatctctctatcactctagttatctatcatctctctcatatctattctgttttctgtttattatctatctactatccatctatctactatttatctattatctatctatctatcatctgtgttctatcagttatctgtccatctatgtatatgcctatctatttatctatgtatctatctttcatctatctgcctttctaccatctaattttcttctgcatatctaccaattatctatctatctatgtatatgcctatctatcgtctatctgcctatctgtctatctattatctatctatgtatctatcgatcgatccatccatccaccccattaggctgtacctgatgggggcagcatcatgttcctcacatggtcaagcatggctgtgtgccaggggccttcaagcaacatttaaagctaaagccaacgatagaaaccataattaataatattttcagacaggttgccaaataacatacatgtaagcgaagaccagatgcatttcaaaaatgttcaagaaattgaatgtgaataaattcattgcttaaaagagaatagcaaatggtgcatgctgtgtgatatggtaacgacaacagcaatactagcagtggtcatctatcaagtgctagttatatgctaaagactgtgttaaatgttttgacatccatcaccttactgcatcttcccaaaaccacaggaggtagatatgattatctcaggaaactgaaactcctgaagttacatagaaaaatggccacacagttaatgagcagcagaaagataatttggccacagatatgcttaacttgaaaatctgagtccttaaagatcgtatactgtgccctctcttcaaatcctaaagaaatgacaagagaaagaaaggaaggaaggaaagcaggaaagaagaaatcaaaggaggagggagagaggtagggagggataggagtcaacattgaaaaacaagggataattctaacaactggccagaagttatagaaatttatattgtaacaacaacaataacacccatctacaatcccttatctgcaatcccacaatccaaaaatacctcaaaaatgaaaaagtattttcatgattcacctgctgccaaaacatggcccaaatggacgtgaggttctatttgagccttgttcattacacacagaataaaaattccacagttctgctgaagaaatcttgaagcattactgccccacattccaccgtgagggtgtagaaaacatgcagagtatggtaacatttacttttagatagctatctaaaatgtgagaaattctgaaacacatacagcccctgaggcttgcctaagctgagagcatgtctgctgacctaagaatccctctgccattatatgtccttgacagtcaagacaataagacaacaacctgtggtcaaaatcaaccgacaataacagaaatttagtgaaaaaagaaacatacatctcaataactgctgaagaaaagcagcctcctctattgcaaggagaactcatggcaatgttatcctattaagatctgacatcaccttctctcccttccaggctaatttcttaactcagtttagtttgagcccaagcaagggcctgttttggactctgattacatttgaacaccccaggctcactcacccttggcctggaggcttccggaaatagagcattttgttacatagtttccacagaaaagtagggagagtttgattgaaatgatttataggaaatctaagaaaaatcttagcatgcacgatatcatttatatgcatttgaaaaatacactgtgttagtttctatggtttacagattcacaaatacgttgcagaggtttcaagatgtgtatagaaaatgtgagtgggacctcaattctatctaacactcgtattcataaaaaaaggaatgaatgaaatgtggcaaagcataaacatctgactctatgttgggcttaagtacctggtttttgttttctttcgtgctttttgtttttgtgactctctgtccttttctgtgtatttaaaatacaattattcgacaacaaaaataaccctcacaaaatatctgctctgtaccaggcacaagaatgacagtgaggataagagagacaacatccctatttgaaaggttttataattaaaattaaaaatgtatgttaatttattgtgtcttcttgggattagaaaacaaacagaatttattagcattgtgttgatttgcttcttttagtggagtttagattgataaaatcattaacactaacagattgccctaacaaaatggacatatttccaaattctagaaagacttcaggcagggagagcaggagggaggccattaagctctcttttgtaagcaggatgtctgctttggggcgtgtccaaagggaaaaaaggcaatatgagaatagagaggtgtttaatttcagcttctaaaactgcacctgtttctttgagcaaaagttccctgtttggcaaataagtgtaaataatatagtaaattaacatttgagggaagaaaaccctaaaattgagatttttatgatttaaaatatgcctagcaagatattatttttttcaaagtacttattgaacacatagggttagagcataaagtaacatgcccagccttgtggcagcccgtgggcatcagcactgggtgtgtaattacagaggttacctgaagcctgaggaataagcacattacgttgttaaaacaaacaaacaaacaaacaaaaacacaacactgtgaaaagacagaagcactagaatttataagcattgatgattatgtaagaaatatctaaagaaagttcactgttaatattgaaaggtctaatcctggctatcttttaccttcagttctctacatttttttcctttttttaatcctctatcaaaattattatcttgacagacatgccagccttaatatgtgctcttgcttaaacagcatgagttccgtgctttatattgagactggcatatttaaattcaagtgcagacatacaggagcgtcctattttggccataagtgacgcaaagtccaaatcttaacactcttctcccaacaagcatgcattgaacagcagatatcagatgtcatcttctcaaagttttgctttatgccaaagttaccattaggattagcttagctctctttgaaggcaattaatgagaatggaagtgttaggggctggatgtttgtgtcccctaaattaatatgctggaaccctgttccccaacatgatgctatgggaggtggggcagaatggaatcagtgccctcagagagccacaagaccactcacttccttccctgctccctgccaggcaaagaaagaaggagaagtcggcttctgccaccaggaagagggccctcaccagcaccctgcgggcatcttgatctcagacttccagcctccagagccatgagaaatgaactgttgtagtttcagcgacgcagtccatcaaactttattacggcagcctgaacagggtaaggtaggaagtaaatgggaaacaaaataaaaaggggagagtgcctgaggtgtcatcagaagcccagcttgaggggctctgaggtatgcaggggcttttcatagttgtcaatgatgtgtgtgtgtgtgcacatgtgagtgtgtgtgtgtgcgcacctgtgtgtatgccagtatgtgtagtatgtatgtgtgtggtgtgtatgtgtgagtgtatgtcatgtggtgtgtgcatgtatgcatgttaagtgtatgtatgtcagtgtgtgtggtgtgtgtatgacatatgtgcatgtgagtgtatgtctgtgcatggtgtggggggaatataagcatgtgagtgtatgtcaaagtgtgtgtgtggggggggtgtatatgtgtgtgtgtgtggtgtgtgtggacatgtatgtgtgtaagagagtatgtgtgtgtcctgttagcaggagtgtccagggccaggtcactgaacacctccatatgcacaggccagtcgcacacaacgtggaattgcctgtgttgccggcactctcctcccaccgcttcaacactggaccacgtacatctatagactttgtctctgggcatccaattctccctcttagaataagagcacttgggttttcctttgaggagccatccctcatgggcatgagaccaaggtcatcacctctgtgcccctagacatggtgactcgttcacagataggcatgtgacatgacccttctcagggattttggagaaagaagactctttccccctggctactgagctactgtcactggggttgtgtgcaacgtgccatgctaggtatgccaaggagccaatctaaaccagagtactccaagagcagtaagactgacagcaagagtgagaggtgctcctgtcagagtttctggacaccttgatgcttctgggcctgaaggcagttactcctggagttttcagttctgtgagccaataagacttttttttgatttctgtttgtcacttgcaatcaagagttctgaataatgcaaattactgcacaaattcaaaactcagtttatagatgcaaaataaataaaattcaatattttagaattatgagtttataacaggcttataaatatgttttcagatatcagtctgctcaaagtctagtcgagctacaacatatgcacaaataatgtatttctattcacaaagccagtcttttcttcctaagtgtctcccctctcctgcaaatgtcctcttatccatagtccgggataaaggaaatggattattctaacggctgagaaataccttcccactggcatcgcatatatatagaaccagtggtaaagtctgtagggagatctgtattggcatggaaggagtaagtggggactccccactgggacttccattgtattttctcatcatatttgtaaagacctgactcttcatttattgttatcaaggcctgtgtgagtttgctaccttgcaatatcagaaattgaggaggaagttccctgccctgtttccccccgggatgaagttgcagatcacttggagaggaccgacaggagaggaaagaggaggcccctgctcctgatggcacagcaccccagggaaagtgatcaaaaccagcagaagcaacaaggaaagtcagctgtgccgagaattgcattgcaaattcattccacgcgtttgacctgtgagaggaagtgttccatgctttcatgttagggaaatttggccagactgggagccactgtccattgctccacagacgtggagtgcccactacttccttgtcagattgtcagacagtgtcctgaaaataagggacaacagtggatgtgacgaagaacctattttgaggacttttgttcagaggagaagcaacaaatggtacacaggtgatagggcttggatgtttgtcccctccaaatctcatgtggaaatgtgattcccagtgttggaggtggggtctggtgggaggtgaccaggtcctggaggtggacctcccatccccttggtgataagtgagttctcactcagttcgttcacaggagatctggttgtttaagagtctggaacctcctcttctctccctcttgttcctgctttccccgtgtggtgtgcgtgctcctgcttcaccttctgccatgattgcaagcttcctgagaccctcaccagaagctgagcacatgttggtgccaggcttttacagcatgcagaactgggagccaattaaacctcttttctttataaatagcaagcaaaggaataaaggaacggcagaatttcaaagaaaacacagaggcaggctgggcatggggaggtggcaaattcagagtgagtagtcaaaagcagccttctgggtgcatccttcctgaactacaacttgaatgacaagaagagaccagccaggccctgtcaatacctgtggacagaatcctctgctgggagacagtatgtgaaaaatctccaatcaggagcaaggagcaaactggactctgagcaggctgttgtggaacagggctgtccccttggccttctgtgagtgcccactgcacctgttccccttgcctggaatgtcctctccgcactttcatttttctttaaccaatctaaaggacaacttgtcactttccagggcataaattccctgacctctgacaggccaggtcccctgaaattccccgtacagcccccactcctgttgttcatttccagcaggtctcacaattgtaagcaggtcattatttacatgattacttgaggtcttccccaagaccataggcccatgagcacagacacagctggcactactgctcaccgttccaccctgggcaccccatctgtgccgggtctggtccatggcaatgcccaatccatccactttgaatgaatcagtgaatgaatgctcacagacagatacacccccatcttatccagaagacagaaattgtccgctgccatgacctcgggtgtgaagattgcagaaccatggttaggcacgctgccatagcattccctgagtatctcatgccacctgttctttgggccctaaggtgacttagagtgtggaatcagctcaggcttttccccaacttcagtttggtaaatgtctctcctggctgacacctgctagagggccagctcctcaggtgcctgtggagttggctgcatccctactctcagtggggactgccaacaatttaatggtaacctgaggagaccaaccacatctccagcatgccaggaagggagaaagaagcttctgtcctcttcactgctgatgaagataggcacatactgatgatgggtggccacagaaaagcattctaaatatgaggaggatgatgatagctacacccatgcactgtgcatgcccagccctgagatgagtgttttctatgcagtacctcatttaacccttaaaacaaccctatgagcagagtagtatcatcctcatcattttccagaggagaaaaccgcggaacagaagggctaaataacttacccaggatcacatagcaagaaagtggcagagcttgggttccaggtggtcccattgctgatactttcatccctgatagaattttgccacacaaatgatgacctgagcccactctgttcaccaacacctgttcttcctcaccttgcatgggcaatggctgcttctgcttctgcctacagtcaggctggaggctttcagagggaaggattcctttttataagtatggtaaagcccccggtggttgttttcctgggcgttttgtacttgaaatatttaggccctcagcactcacacctggccactgctttgcccctgcacctgggctacttcaggtctatgggaccagttgcggttagcgctagacaacaatgacataaaaatgaaccaaatgttccaaggatcagaagcatggactccacagactacttcaaagtgatgtgcagcaaggcacaagagttccaaaagccactgtggctggttagttccccattaagttgcttccttggttggctttattatttcatctgctccattagtgaacagcaagcgttttgcaaaaaaggcattgcacagcctcaccaagctcctagagaagcctttctagaagctgcttcatgtatccccacaaagcaacatgggcagcaggttggtgggatgccccactctcccgaagaagcagcagacttatccaggttaactccctcctctctcctttgtccccaacatgcactgatcaggaagatgaaaccaagtgaaagccacttcctgtgtgggtcttaaaattcaataaaaataatatctcagaaaaaagccagaacacactttctgttcagatggaaaaatgcatgtttccctccccaccttcacctacaagctgagttcatgttatttcaacagcacatcatggacccagatgcaaatggacagtatctgaaatgcagtcccgagcaggagaaatgtagtttcatcagcgagtcatttttaaggcttgatttctatttgtatttaaacatactatcaaaaaataaatacttgcatattttgtggaatgtctgttgaaaatatgtgcccaaagtgtctaacttgggacaaatctgacctcagtccctggaaggctaccttcgatttatgcctcttgatatggcttggctgtgtcctcaccaacatctcatcttgtagttcccataatccccacatgttgtgggaggagccaggtgggaggtaattgaatcatgggggcagttacccccatgctattctcgtgatagtgagtgagtcctcatgataactgatggttttataaggggcttttccccgcttttgcttggcacttgtctctcctgtcgccatgtgaagaaggatgtgtttgctttgttttctgccatgattctatgtttcctgaggcctccccagccatgtgaaactgtgagtcaattaaacctcttttctttataaattacccagtctcaggcatttcttcataacagtgtgagaatggactaatacacctctccactctgaatttaatttctttggtttggttttcaattatcttatctatcatagatcaaaacttatttccccagtaccttccttctaatacctttccaaatttttatctggaagtagaaggccccagtctcattctattaactctgctatcccatagccagcatgtttagagataccaaatacagttgctagagctccaggcaacagcactgggatccagtcactagccatcctctacagtgtctgaaaatgactcgttgcctcactcacttattcagcaaacacactgctgtacactagtccctgcactgggtgctgtcttatgacaatttccccagcctccagccttccttgcatttataaaaggtactgatatgcaccaactcacatcagtggattcagttacacacaatgacaggcagcatcagttgtgtttgtgcagggaagtggtcttcagtgctggtagaacataaaactcacttggaaagtttttcaaaatatgaatgctggagcccaagcccagaccaattaaagcaaatctctaagggcattggtatttgtaaaaatccacccagggggttgtaatgaacaaccagggctaagaacctgcagccttgtcactgacaataccagccttggaccagcagattcagcaacacctgggagctcattagaaatgcagaatcctaggccccacaccaagctactcaatcagaatctgctttatttaacaggattcctgggtgattcatgtgcactaaactgtttaagtactattctgggagattagaacataaaactttatctgttgaattaatagattgtattacagtgagctgcatgtcatatcattttcagaaactaacgtctgtgtaacagctttcctggaagatgagatcactccagaccacccagagatgcctaaggactccacttcctttcagtagtatagtccagtcaaaagatagtgattgggaaaaaaacaaagaaaagatacagaaattggggctaaaatgaggctctgtaatgaaaagattgtattgagttcaggaagcagttatatcacctccgtgccaaacacacacacacaccagataataaattccttgagtgcagggattgcgtatttctcttattcatagctatattcacaaagccaagctcaagaccttcacagagtcggtggtcactaaatatttcttgcatcacttagtgtcctgaacagagaacaattctgttagtcatttattttgagaccctagacgaatctctccacctctcagtggagagattttcagtgtcttatctatatgatctgtttaaattatttaccctaagatacaaaagcaacaaagagctcactgatgaataattatgtgatcaacagacacagggaaagctccttatatctaggagaactgtggactggtctccacacttccacaatccacgtgcccaaagagtaattagtacttggatactctcaacgtgtactcattaaatgaagagtcatggagttcctatgtgccagttactattctagaaattaacagaacagaccaaaatctctgctttcctgtagcttatacactagttgtctataattcagtcaccaaagtgttaaagaatataaagacagataaaattactatcattctattttcccaaatgttgttatatatatttttttttttttttgagacagagtctcgctctgtcagagtacagcagcttgatcttggctcactgcaacctccatctcccgggctcaagcaattctcctgcctcagcctcccaagtagctgggattacaggcgtgtgccaccacgcctggttaatttctgtatttttagtagagatggggtttcatcatgttggcagggctcatctcgaactcaggtaatctgcccgcctaggcctcccaaagtgctgagattacaggcatgagctactgcgcccgaccatgttattataatttttaagcctacaatatacttttcattttctaaggcttgatttttttcaacatatggctataataaaaaaaaaagtccaaattcaataccatcacacacatcctttaaaaaaataccaggacaaaataattatgattatgattttggaagttgtttataaaatacaatgtcacaatatagtactagttcaagttaattcacctaggtctttacttacaaataaaatcaattttcccatgcagctattttaagagaagaggtgcaatacgttttttaagttatttgtggtaaagtacatgtaacataaaacttactatcttacccatttttagaggacagttcagtattgttaactcggtacttattaaacaatttctcaatttctctttccttccagcccctggtaaccaccgttctaactttctgcctctgtaaatttgactgcttatcaagaccatcctggccaacatggtgaagcctcatctctactaaaacaaaaaaaaaattagctgggtgtggtggcgtgtgcctgtagtcccagctacccaggaggctgaggcaggggaatcgcttgaacccgggaggcggaggttgcagtgagccgagatcgcgccattgcactccagcctggtgacagagcgagactccgtctcaaaaaaaaaaaaaagtgactactttagatacctcatataagtggaatcatatagtatttgtctttttgtgacacgcttatttcacttagcgtaataccctcaagattgttgtggcatatgtcagagttctctttcttttcaagactgacaaatcctccagggaatgttatgtaccacatttgcattactcattcattgggtgatggatatttgggctgttcctatcttttggcgattgcaaaaaatgctgctatgaacatgggtgtacaaacatttccccaataattcatgtttttaagttagttctcagttgcttttgcataggtgacttagcattcctaatcagaacacaatcaactcaaacaaacagaagacaagccaaatgtacttttgtcatataacttgtacaagagaaaatagtctccattaaaaaatattgtaatcagattataagaaaatgcatcctgaggtaaaggcaggacctaaaaagaacttaaaaatactactttgccatatgaaagcctgagacaagcttaacgagacaccattcacatccacagtctagtcacatacgtgagtgtctaaaatttctcccaactgtagtctttgaccaggtttactttcctgaagaaatgtaaaagttcattttcctcaccacatgattttaggagaaaatccatgcacagttttaaataaagggatatttagaaagagatcaaagagagaaaaagacatgatccaaagtttgaacactgtaaaacttataaggagaacagataatttcttcaaaggaagaaaaggcgaacagactagcctgaacaaataaaaaagtctccatacactaacatgaacaaagaggcctggcacagtggctcatgcctgtaatcccagcagtttgggaggctgaggtgggtggatcacgaggccaggagttcgagaccagcctggtcaacatagtgaaactccccccccgcaccgtctctattaaaaatacaaaaattagccaggtgtggtgggtggtgtgtgcctgtagtcccagctacttgggaggctgaggcaagagaattgcatgaaactgggaggtggaggttgcagtgagccgagattgcactactgcactccagcctaggaaacagagcaagatgattccttaaacaaaaaaaaaaaaaaaaaaaggatgactatgggaaaaatggaaaaatagtttaaatttataaaaatgaactgacattagactacatggaaaccgtatggaaattgaatgaccattggaagtaagaagaatataagacagcagttctccaagaaaccacagtcagacagaagagcagaagggtgctgtattagtcatcttaggctgctgcaaaaaataccacaggcaggatggcttagacaacagaaagttatattttcacagttctggaggccagagtccgaaatcaagtttccagccactgtgtatctggtgaaggctctcttccaaacttgcagacagccaccttctgtgtcctcacatggcagagagagaaagagcaagctctctggtgtctctcccacttcttataaggacaccagtcctattgggttaggtactgccctgatgccctcatttaatcttaattacttccttaagtgcctcacttccaaatacagtcacattgggggttagggcttcaacatatatggcttttagagagggacataacatcagtccgtagaaggtgctcttggtggtctttagtttagcttaagtaaatttagcaaaattatagtgcctaataattactgtgagatgtcgaccatcaactgctatatccggagttggaagctggaaagagaggtccctgtgtctctttttgcttcaaaggccaaaactatccactttcttttattttgactaactggaaatcagccaacaaaaatgcagtgaagtcagtgataagtctgacctagcatgagtaagataaagctgaaggtgaaacagaaaaaagaaaacagcttgagcaaaggtaggaggccagagtagtatattcaaggaaggcttcagaaagatatttatagtgagcctaagtggctcacaggacatcctccgcacacacatatacaccaagaacagagtgcctaaagggctttgcctattattaatgctattcaatttctgattgataaccttaaataatagagtttccacacctattgatggtaccaacatgcactaaattccttacctgaatcatccttgatgactgtctttctctcacccccacatctaatctatcagccaacataccaaagcttccccaaacatctctcacatctgtcctttttttctctgtccccatgtctgccactcaagtcagtctccaccagcctcctactagtcatctaatggtatgtttgctctcccccgcacttttctccacacagcaacagcagtcacatcaatccccagcccagaattcaacagtttgccattatccctgcataaaaatccaaagctattgccttaaccaggaaggcccttcatatgcaggctggccctgccccatcccttccctggccacctcccatcctgactccctatccaagctcactccacttaggggtcttccaccaaccacagtcccctccacctgagcacccacacatggttggttgcctcttgttccatctttccttccacttcacagctggccatttggagttggctgtgatggtgtcttgttttacggtagtaaagataaaaatgatgccccccccaaaatacaaaaaatggaattagaatccaatgaaacccagtgtatctacatattagactttataaaagtagaaatttcagatttattcaagacctataaatgttgtttggtcctatgaaaacatctaactcatatttaaccctgaattgttgaactcaaggccttaaacaacctcaattttatgcaaatcacctctagtggccttacgttggaagtagttttttctaaattatattctatagaataacatgagtggtctggtggtatggcttggatctgtgtcactgcccagctgtcatgtagaactgtaatccctaatgttggaagtggggcctggggaggtgattagatcatgggggtggatttcccatgaatagtttagcactatccacaatatttttcagatggtaagttctcatgggacctggttgtttaaaagtatgcagctcctccctcactctctcttgcttctgtttttaccatgtgaactttctgctccagctctgacttccaccatgagtaaaagctccctgaggcctccccagaagcagctgctggcaccatgcttcctctatagcctgcagaaccgtgagccggttaaatctcttttccttataaattacccagcctcaggtatttctttacagcaatgtgagaatggactaatacatctaaaaagagaaaataaaaataaaaataaactaatttaattggttttaaaaagtggccacaatcactttgacattcgtgctgcatggaactgggttgctattgcttaatgtattatttcctaaaattttttgaaccagaatccacataatcttttccctatcttcctaatctctccatggacacagtttgagaaatgttggtcaaaaatatctcattttattagctgagaaggaatacactcaacttggagatgattcactagtcttaaaggaccattttatttgtggttctagtctttggccagaatttagagctcataaccaacagaaaaatgcttcagttgttgtagcattaatttttaaaatatgacatttataatctgcctattcctggcttggtcatgtgccaattgctcatgtttaaacatgtaatctgaagtttcaagtaaaaaatatgatttgtcttataggtgtttttcctcaacttttcattatagaatattttaaacacacatgaaggatataacgagtataataaacctccatgtaccatcccccagcttcagaaattatcaattcaggctacaacctcacccctggcaatggattgttttgaagtaaatctcaggtatcattaaaggtattttctttttctttttctttttcttttttttttttttttttgagacggagtctcgctttgtctcccaggctggagtgcagtggcgcgatctcggctcactgcaagctccgcctcccaggttcatggcattctcctgcctcagcctcccgggtagttgggactacaggcgcctgccaccacgcccggctaatcttttgtattttagtagagacggggtttcaccgtgttagccaggatggtcttgacctcctgatccacccgccttggcttcccaaagtgctgggattacaggtgtgagccaccgcgcccggcccataaaggtatttttaaaagctaactgtcagttaatatttgttactaagagtaaaaatgccataacttccacactcccacctcattatataaacacacacacacacacatgcacgcgcacacacgtacacacgatgcatgttcattaaaacgaataatcccagctgcttctgctgtggggctggcatctctgagtctatttcatggcatggcatgggaaggagtgttgacggatgcctcacatgtgttcggttactgttgataaggacactgtataaaatatttgccccagaccacggggactaatatggtagcacactttcatctgtcagattggcttgatccacacaaacctgtcaacaaaaccaggtcagcaggctggagtagagaagggaaaaatcaataaatctttgaattaatcatgcagctatcagagagaattatgggttcacacagtgaaatgtatacttgggcctatttgctcctttcttcttccagttattccttcatttccatccaatgtagagtccctcctatagaatccccacgccaataacttcgtttctgtaactaggttcaaataactgtccctaatttacagcttctgttccaccataattcttctaagaaagggttggagactaaagaaaaataagtccaatttaaatcacaagaaaagctgcattctaaattgctatgagtgttgcctctagtttttaaattcaggtcgtatatgttagtcacaaataaacaaataaatcttgccataaaactggatttttacatcctatataataacctgatgtgcacaaataattttactgaaccttcacagaggttctgatccttgtcaccttgaatatccttgctgttacacagagtttacaatgtttgtccctcgtgccgcctcctcaatttaactaacccttcaaaagagaaatatctttaatcacatatctatagtccttcctattctccttctgcataaccattttacaagaacacatatactctatagccactattagtaaaaagcagcatcgtcttagatccagaatttaagatagaagtcactatgaatatatttttcccaccaccaaaaaggtgtaaaatttataaactgatcaataactatgcaacaagtgtatattttaaatacatgaaattacttttccagtttcaccatttttcttgaaaagaaagtaatcatccatatccttactagcaagaaaagctttgtttttaaaaatctcaatacaaaactaaaaacacttaaatattttgataaaacaagagagaaacattcatcttatgtcaacaagtcaaagccagtaaaaaaagcacaagaaattcaggaaaatacacatgttcaggaccatcaactaagcatgtgcagagtcctatcaaagtcatgcatcaggcctcgcggagcccagaggttctgcatgttttgcatctgaaatggacttcaggctttcatggaaaaggtttactggagaaccctgggaggcacggccagcaataggatgttcaggttttctctacttagcgatggaattgtgtcgaattcagtaaaagaggaaatgcttgagacttcgattgccgtattgttcttttgtttgcttgtttttttgttttgttttgttttttaatttttaaaaatttttttacttagaggcaaggaatagagtagattcagcatcagaggaattgacttgatggggacacagtgtgggacacagactgacatggaaagttcgaacacagaatttactgaccttgaataaatccttgtggatcatttaaaaattacctgcaaggctgagatacacctttcttcaatatttcatcatgcatggtaagcatttggcaatacagattttttttaaagtcttgaatcctagaataacttttttaaagaacaaattacttcgcttggaaatcagaactgtggaaacgagtcacgtgcatccgggcctcgtgctccctggctctccaccgagggattcagcctggctgcgttccgttttgggaaatggccctcctcaatttcaagttcatttggctttttcaatgatagggtttcaattcaaacagataacaatgctgagaactaaaaatttcaccatctaattagccgggggggaatctcagtatggcctttctttcctagtatcatctgcagtttgaaaatgacttgatgaaggctttttataaaaaccctttacttttcctggtacaagaacaattgtagtgaaagatactggtacaatgcaatgggcataggaggataaaaaaaaatgtgtgcataaaaagaagcagaggaaaccaggacaaataagagatcagagaaaagagtgtggctgaaggtttcaaaatgcaatttaggttgaaaaaaaggaagacacgatccaacatctatatcaggcattttaatggagtatgaatccctggttaatctgggtaaggacaagtgggagccggggggtgagggaatgcagatagtcacaaggttgaaaggaagcaaaaaaggcctggactgttgcagctttcgatactggtgtgttcttctgaagatccactgccccatagcttttattacttactcaacatgtccatgatccccccaaaaagtcaagaaacattggcctaaggatatttccatctattaaaaaaatatgtatatcgactgaagatctatttccctgcctcccaaaattcatatgttgaaacctaaacctcaatgtgatgctatcgggaggtggatcctttggagggtgattaggtcgtgagggtggagccctcatgaatgaggttagggcccttctaaaaagagaccccagagacaccattcgcctcttctgccatgtgagaaaatgagaagacagctgtctatgaaccaggaagagaaccctcaccagacaccaaatctacccacctccttgatcttagaattcccagcctccagagctctgagaaataaatttctgtcgtttataagccacccaatgcatggtaacttgttaatgcagcccaaacaatctaagacaatatttatatataatacttttttttcagaaattacaggtaaacattttcagatatacaacatattatttgcattaaagtatattttaaatatttgatattgaagtaaagctcagttataagtttatttcaaaatgaatcattttgggaagtacagttttcaatgaacttctttcagaaaaataagtctttgtaattccttcagtataataagcctactgattataattaggttatatctggcgtgtttctatctcttttgtgtctttttaaaacaggtcatataatttttaaaatggcaactttaaaagcattgccttatccagaataagtgcttaaatgacagtaatggagaaattttcaactgaacacagaactagtgcagacacaaccaccacaaaatcccaggttggagtccctgcaccgccattcactgctcaggtgacttttcacatctgggtgctttcttcatctataaaataattctccgatgagaaatcggagccagtgatagagatgggaggctgatctaggtgatatttacatcctcatatgggcgcgtgtgggtgatctgattggctcagcagctgtcatttttgccatccctttcccccatgtaacctttccagggctccagtatccagctcaaaaagacaccctgaagcttctccacacagaaattctaccattcttagatccatcatcataaattggtgaagcatattgatcactatttgaaacaacatgccctcacacacaaaagctatccatggcaggttgacactctgtgctcaccaaatgtgtataaccctttagataaaaaactgaaagtaaagtctgaggctcgtggtgtggctatggattcagtgcatcaggaaatgctgtaacgcgcctctgaaggtctcggcatgtcagcctcgccttgacttgcactgtcctgctttttaacaaatgctgcagtgtaaagctgtaggtggttccaacaataaaatcatttcatgaaaataaaagaagacagcttttgttttgggaataataaatactgggaatttgaaatgtcgatttccctcagaacggcatcacgtaggagatgtcagctatgaaatcccaggctgcccctgattggccaacacaggcactctttgccttgggaggagaggctgatgtgaaatttgattttagagtagtagaaaaaaatatagaaaagcaaaagctcttattaaagcattaagaagaatttaaaaggaaataacaccaccactctcatggaaaagtttcttattcaagattcactccataaacatgtattaagcttctactatgtgtctggaatggtaatgttatcattcagtcgacaatatttgttggctcttatgcacgtacataatatgggaaactgaaagaaagtttaagaaaaggcaaaatctctatcttctagagagggagaatttcaagaaaggaccttgggtcacttactgaagctctctctgcctcagccttctcatctgtaaagtggggccgacaaaagcaattacttaatggggttgtcgagaagtttttaggtataacctgacatgtgcatgccatagaattgttagctattcaataactgacatgtgctacaagtattttaatgtaaatactaatgtttactgcaaatacatactctgatttagctgtgatggttaaggcaaaatataagatcctttcattctgccttattgtcattttatatcatacttttgctatttaagaaaaataaacgttttaataaataagtaaagagttgtttattttaaaatcctacagactattagttcaatagcattctaatgcttttatgttgaaattgaaggattttggattatttccccatgacttcttcagcataccttgcattttagcaattcttaaatagaactacttttcttttacttcctaacaagcctcacacaaacaacggcctatttgttttgaaaccacggtgtcctgaccttctggtttctgggatacaaacactttagacagaagataatgataataataataagaagaagaaggacaatgacaaacattaatgtcaagcactgtgctaagaactttacctatattaattcatttaattcttataacaatcttactataatgttatttttattcctatttccattttacagttgaggaaattgaggcatagcaaggttatatgactaactcaaggttacgtaacttggtccaggttgaatatggggtatggacctagacactggcttcaggctccacactatctacaggctctatagagaaatgcacacctagaggtccagaattacttagctatgttccaattcatggagcacctcacttggcctgaaactgcagttatggcactcttcatctttataaaaacacagtacccaggtccacagagaggtatttaactatggaaggtctcacaactgtgcagtagggacccaaagccaggctcctctgagtgcaaacccaagccctgctgtgcgctgctggcaaaatgaaagacatgcagaaacctgaaaccacctctaagagcacacaggatctgtgtatttttgcttatttactgtatctgtttatagcttcttttcaaagaacattttgactctgctctactgcagagcagtgtgtgctgtggattttctgttgctcataaagtccaattctggacagccaatattttcagcagcatcattgtattttcaggaactacacacactcaaatattctgtaaatactctcattacttctcccatacatgagccttggagagtcaatgcaactttgcaaatagaatttagttgttgaagtttcaaccacaggtgacgatttagccaataaaaattcagttagtttggaattaattttggaataactgtattttcaggaactacacacactgaaatattctgtaaatactctcattacttcccccatacatgagccttggacagtcaatacaactttgcaaatagaatctagttgttgaagtttcaaccacaggtgacagtttatccaataaaaattcagtttgtttggaattgattttgtaatcaagggtaacttttgaggcaattttttcatgcacatgttttcagactactaatcacttgggaaactgatgagtcgtttgtccattaacaaatttcccccttttccttttgaggaaggaaacacaggacttgaagatgcccaataaaccgtggcacccgaaagtgaggatctgaaatgcaggtgaagcagcttgcctgccgcccctgtgcttggtccaggactgcctggatcctgtcccctactggcccccagcccgttctgacacagaccaggctacttgcagctgggacagcggcagctggtggtgtggctgccagctggatgctggcgccgccggggacagggctgcagggacccacaggacctggcacaccagcactcctggctaccctgatggggctgtctgctttttgtttccttcccttaaaaatgctttttttttttttttaagaatctcattgagtatatatttatcagttgtctactgtgtgtccagcaggagatggaaagatataaaatgtgtgagagagggcaaataaagaattggaagaatttgtaatcatagtgggttaaatagcttcccccaaaaatgtcctttctggagcctcagaatgtgaccttatttggaaacagggttgtggtagatgtaatcatttaagttaccatgaggtcatactgaaataaggtgggcccttcatccaatatgactgttggctttattagaagaggagaagaaatgcaaagacacacacagggcaaaagtcacatgtcgctagagggagggactggatggagtgagacttctgcaagtcaaggatgccaaggagccaaggaccgcaggcaacaccaggtgctgggaggcctgacagggaccctccccagagtactgacagagaccctccccgcagccctctgagtcagcacagccctgctgacgctgtgactttggatttgcagacttcagaactgtgaggaaataaatttctattgtttgaaaccagtcagttcatggtattttttttttgtagtcctaggaaactaatacagtcatgatattgaaaaataaatgaataaatcaaagggaaattcctttgtggtcatggggaaggtttcctttgttggaggtggccagagggatgcgggggagtgaataagcaggaccaggagagaaggcaggtccgaagttggggtcacacaggtgcaagtcatggatgaagccctggaagatgatgaaatgaccaatacagaaagtggatgggattggacttttagattgacatacatttctgagaggggaagatgcaaactgaaggaaagagatagcaccgaaatattcagagagaagatcaaccaggcagtgtagttggatacaaaccaaaggagagcaactgctatgaactgccttgtgtcccctaaagttgtagatgatgaagccctaaccccaaagaaagagagaaagagagagaaagaaaaagaaaaaagaaagaaagaaagaaaaggaaggaagaaaataaaggtagaagagagaaagagagagagaaagagagaaagaaagaaagagaaagagaaagagagagaaagaaagaggaagggaagggaagggagcggagggggaggggaggggaggggaagggagcggaggggaagggagcggaggggaagggaggggaggggaggggaggggaagggagcggaggggggggggaggggagggaaggagaggggaggggaggggagggaagggaagggaagggaagggaagggaagggaagggaagggaagggaagggaagggaagggaagggaagggagacctgagcacctgtgtcacaagaaatacagtaattactaagagaagtaatttggagtatgaaagtaattaaggttaaatcgggtcataagggtggcccctaatcggatagaattagtgtccttgcaagaagaaacatgagaaagtcagtcatgtaaggacagcaggaaggcgtccatctgcacgccaggatgaggcccccatcagaacctgaccatgctggcagcctgatctcaatcttctaggctccaggactataaggaaataaattgctgttgtttaagccacccagtgtgtgatattttgttttggcgtccagagctgccaaatacaggaaccaacagaggaagtaggtcaactgtgtacatctaacagggaggtcagagagaaactggaccaggagacagccttgggatttaacatttggaagtcatgggtgatcttgaagtagtgaatttcagtagattgtaacaggcaaagcccaaaatactcactactataaactattatctcaaacagtttgccagaagaaagagaaagaatgaaaggagtgtgtgacagagagagagaaagaaaaaagaaagaaggaaggaagaaagtaaagacagagaaagaaagaagtatggaatttagcaaagggaaaggtttctttaaaactgggggacctgagcacctgtgtcacaagaaatacggtaattactaaagagaagctgtctgaagcaacagagggcacagctgatgaaaagaggtcctagaacgccggagcaggtaaggggaccaggagggcagcacggtgggaggctaagctggaaggaaagaggacagctcttcctgtgggagagaacgtggggctgagccatgaaggaggtagaaagggtcatctgaagaaagctgttctcagcccctgcagagtgaaaagttacgatcctttgaacactggagagtaggtgcagcagagttgagaatggggtgctccaggatgctgagaaaaagcttgggaaagacctcttcagctatacagacgcgggcgcaaaaacacctgagcatccagacaatcagtgaagagctggttaagaccgggccacgcacggtggctcacacctataatcccagcactttgggaggccgaggcgggcagatcacgaggtcaggagatcgagaccatcctggctaacatggtgtaaccctgtctctactaaaaaaaaaaaaatagccaggtgtggtggcaggtgcctgtagtcccagctactccggaggctgaggcaggagaatcacttgaactcggtggagaagaggttgcaatgagccgagatcgcgtcactgcactccagcctgggtgacagagtgagactccatcaaaaaaaaagaaaaaagaaaaaagaaaccggactggcataaatgctcaatgtgcccagtctgcaggaacgctccacaggctgacggtggagaagggaagcggggtggctcctagactgaggattccacaggtgacgcggttgctgaggagagaggaagtctgggctgctggatggtttactccatcctgccccatctgctcagaaggacagccacaaagggctgacagccatggtagctccgcctgagggatttctggaggccaagcaacccatctgcttaaggagaccttcctccacctgctccagcccagagcaaaggacacagcaccataagcctggtccaacccacctttatctctgctcgacaataccttgagttcacactgacttcttgagtagctagcaagttattctgagtcaaaaattatatttctcaatctcaaatcctgttttcttatactgtggcacattgtctaagcaaatcttgatttgtgacatctattttagcttgtcgataataataataatctaacagcattatggttatcactacacaatattctttcctaaatgatcctgttattctcttgaattttcctgaaatgaaaactcttagatgaacaacagaccagagaatatgcttgtgtccaaattacatctgattgacttagctggccatctgtttcccatgtctagaaagaaccaaacatcacggggagagagagaaagcagaagatccttaatggcagaatataaaatgaactccatttacacttaggtggagcaagggaagagtatgagtcaatgtgttttcagaccttaaaataatttgggatgagacctttcttaaggcttgaaatacttgggtacaaggcaataaagtacataaagcatagattttcttcatttgctttctccagcatttcatgatgagcatatgcaaagtgatcgttgaatgtatgaaaatgaagatgagccaacatcatttaaaaagttgcatggcacagagaagagttaacacagtaggtctgagactgtcagtcttatgaagggctgcttgcaggactgtcccttggctggtatctgggaactaggatattggcagcgttcccaccacccttagagtggctcactgcctgaactgcataagcaatacagttcatgatgagcacctgccttccttggggagtctggaactttggcacataccaaacataccagggtgcctacgtgacctgcccccaaaggaaaccttggccactgagtctccaggagctctcctgctcccctggtagacaacattgcacctcttatcatgactcattgctggagaaattaagtgcttcctagtgattccacagggagaagacccctgagagctggggcctgctttcctctgaatgtcacctcatgtgccttttgcctttgctgcttttgctccatagccttctcctgtattaagtcacagccatggatgcagctacatgctgagtcttcctggcagatcaccaaacctgagggtgggcttggggacctttgacatgggcatgtaacatcctgcaagattaaatctaagaaagtgaaaaaataactttgacagcagttggcttaagaagtggaatattcaatttggaattttaatatcctggcattgtattgtgggagaggactagagaaatcactgcatatccatgggaggaaactgaggcaaacaaaaacaaaaacaaaaacaaaaacagagagagatagaaacgcctttccctaggccacccagctaacctgagtcagcgctgcaatcaagtcatattccagaaacttaaaataggaaatcaagggggattttagtgtgactgagtggcccaacaaatgaggttttacacacacatacacaacacacagatacagagcacacacatcacacacaccccctgcatatatcacacacacacacatacagagcacacacaccacatagcacgtactccacacacacacacacacacacagagctcacacaccacacacagcacacactccacacacacaccccacacacatacagagctcacacaccatacacggcacacacacacaccacatatacacagagtacacaccccacatgccacacacacaccacacacactacacacacatacaaacacacatcatgcaccacacacacgtatgcacacaccacaccaaacaccacacacatatgtggacacgcacatcacacacatgtacacacacccctcctgatatcctctgggctaaatttgccccaatgctttcttttcttgttttcttttttaaagaaaaaatattaacatacctatctctatgtgtctatctacttgttttggtagttcaaaagtcaaaagcgtacttctctgtgttgggttgtactccacaatacacagtttgcagctttcagaatgggtgcaggtctcctcctggcaggctgaggccctgcagactagctgctattgtggctgctttggagccttgctggcagctgtttggagactcaggctgtgcccctcgccttacacgacccccattcttggtgtcacacaggggctctccagagctgtaaacaaccagcttttaattactttcaggtggcagcggggtaacatgcaaaacctaatttagtgagcgatagacttaaatggaaaaagtataacataattaatgatttttaaaaagaaagagaccagggccctctcttcctatttctcagttaattcactcccaaaaatatagcatggtaaaaacatgacatctctgtgcctttctaattccagtctgatgtgcacgttctgagctgagaatactttccagtgtttaaaatgaggttcttatttactaaaagcaatataaatagaagattagatgatacatacaaagacagatagctaggtagatgataacagacagaaaaatgttccttttatacttttcatttggtcccacgaatttcttttcagtgaatgttaaagaaatgcttctttaattctgcaactctctggcacttttaaaatcaaagatgaggctttcaggtgactctaggttttttttaaatttcacattattttaatgtttatctcattccttttactcataagctctttgagggcagactcaggtctccgcaagatagcagccacagcatagcagatgtctggaaaatgctcagtgaggagcaataaaatcacaatagaagtgccacagaaagggaaggttaacttctatagtcaagagtgcacaaagcagaggccccccacagcatgaccctcaggtccccccgacagctgtgctagctctccctccctccccacatgagaatacggcatccaatctgctcttagttctggtttgctgaaacgtgcttaagggcagccttgtctaatttggttggctgtacctataatctcttttcccctctctaaaatgcaaaggttttcttaaatcacaacctcctttctgaaaccttctctacttccccaggcaaaaccgtgtgtgtagctacagcctcaggccctaagcgcctactgcagcacttaacaccccaagagggacagtgcaggaatctccccaagcatctcaacagcagaaaccatctctgcaggggcctggggagggagtgcttcttaaagcccaagtcttgcgtgatctatgatgcccagacccagttgtggcagtgaagaattacagccaatgtttcatgtaaagtggttggtttatgtcctttgatatttcatgtgggcagaaaattgttcacgtttagccaaaatacagaaagaagataatcatccttcgacctgaactcaatgatcctaagaggtaaaattctccttgaatcatcactaatagaggtattcagataggaaatattacagcagaaaattgggccactgctaaagagggaggcagtttctctgggaatagtaaaatgtttgctttttccattttccaaatccggttacccctgggctgtgtctttgatgttaatgtagctaaacccctggtgagattctcacaattttatcagaagaaacagaaacggaaggctgggctctcttactgctggcctccctaatcgggaggaaattcacaacaggcttgtgaagggaaacccaaatataaagccggtgttattgtttttttccaggatggtgttttatgtatctccacatcagcagtacctccaaaagcatgtcattattcaagctactatatttttactgggctacattaatattatggcatttaaaaggatttcattgcagcttaggataagtgatgaggatgtctaaaaaaatccacatagacatcatgactcttgttcttcctggctcattttagggaggtaagaacacaataggtcaggatctgtcatattaactgaggtcatctgatggcaccttgtgtgcctgtctctgaaatgcttttcctctgcacatttacgaccccacccccatccatcataccagagggaagggtcaccctgtaaggccccagggcccagggaagagctcaggcaggcagaaaagcaacatcagatattatgaatctttcctccatttggtagaattatgggatttctacttttcagctgttggggtattctttccaaaggtcactccaaatcaatgaactcattaatgtccttgataatggtagcctcatggcctcatatgatgaagaggcataacttgattcctgcgtctaccttcaggccaaccgaagcctgtcctggaaagaaatcaatgcaggccctaatgtgcagtaagctcccaaaaggaaccatgacaatatgcacaacactcattaaaccctgacaaacactgcatttgtgcttctcaggaaaataaactactcatttgttttcttaaccaaaataaagggcaaaacctagtgagacatactaatagaaaccattttgcttctttttagggaaatacacaaacatctttaattttgcttttcattaaaaaagaatttgtagaagacaaatacccatttaccttcaccaggatttccaaaggtcccctggcctagagattcacagaaacccaaagctcatctgttagaagcaggtctttgctgctccgaccttcccaggggatctcccaacagtcaaggctgagcagctaagcatcccccaggctgacaggtcacacttcgccctgagcccagtggggcacgttgggccatggcctgtgaatcatgcttttgggccctctcttgactgccatcagctctcagctatcctaggtcaactctctggcactcccatacctgctcctaactcactcacttagtaagatacttacacaggcttatttccatggctgatttagttaatcgcttttctccatggaaagaatcaaccactgaaggaagtgatctctgcagagtacgaatgcttcctggaacaaacttcccagccagatcccagcaggctgggatgacttgataatccgggaagagggacctgggagatggccatgccaaggaataaatccaaactagctcgcaggagttacagtttatatacaaagcagagacaaattaaccttttacaggtcatctgctgtgcatatggcattcaggacagcttccctgaaggtcagggctaatttagaaaaagtccctctgttcctgggacttctgtgctatgcaaggtcgttccctgaagccaagaatcccagtgcttccctggagtggctcagccccagccagtgtggagggagggagggtcttccttttagcggcctccaccccggcacagcctgggtgatgggggagggaggctgtcctctgtccttatctgtgccttgtgctggtaaccagagagaaatataacccttctccacctaaacctcctgagcatggtttatttattaagatctccaatgttttaaaccatgcgtcacctccagtgacttcatgacctccttttctgggcattgctgatgggtggagctcagacactgggaacagggtctgactgtagcagtgagcaacagaagtcaggtaaaatgctcaatttccagactttctattagcagatcatgccactgctttggggccttgttgtcatttacaaggtcatttttagtgacaagtctattcgactcaggttgaacgacctgatatgaagtctctctctccctttctttcagtgatttacttacaaaccaaccaaagcttcttactgatgtattccttaataagataaacacctgtgttgtatttattttctagatgctgttgtgaagtacaaaccaagcacttctccaaaacttttgcatttaaaattgtatgaaaggatgaagctccagtatctgactgaggagaggacatgggctttaacagttcctatcagaggggcataaattctatattgcatgccagcatcatcccctcactagatacacatttccttttttttatttagttaggttcacatttgaaggaaaataaagtctgttcacagagattgcaaaaaggtgaaacaagaacaatgaggatgctgctaattaaagatgtctaaaaacaaaagaacacacgtattatgcataaccaaagagattcaaaaatcctcctggtagaacatgttctcacttgtaagtgggagctgaatgatgagaacacagggacacatagagaagaacaacacacactggggcctacttcggggtggagggtgggagaaggaagaggatcaggaaaaataattaatgggtattaggcttaacacctgggtgatgaaataatctgtacaacaaacccccatgacacaagtttacctgtgtaaaaaacctgcacatgtacccctgaacttaaaataaaagttaaaaaaatcctcctggtagatatttcaatttctcacccagatttccagttctcctcttccttcaggcacatgccccattgaggtcaggcatggccatgagacttgctttggccaattaaatatgaacagagataacatgtgtcacctccaagtggaagcactaagaaggcgtttgtaattctcccatgctctcttcctctgccagagcagaccatgaagctgaaaatttggatgacagggttaaaagatggtgaagtctctatcctaggtcaccgagtccggaagattgaaaaggtagctcccaattcttccactccctgaacctatactcccttgccatataaattggagggcctctcccctttgattccgagcttagccagatgactgtcatcaaatccttccatttgccattaagacaactaacatgacccctaaggagagaagatgaagatgtttcaacactgaaaattagcaaataaaaatgtataagggagtctctattctgattattacaatcgcatttgagttattaagcttagtatttttcaacaccctaagttaaattatgataattaatcaacataacagcaaggaatgtactgttcattgaagtgtgaggggttttgaattcactgtaaagacaatgttttcataaaaactaagaattccattctatcctagattcctgtaatgtgctatgatggcaatgtatttcaactttgatttggatcttttaaatgcctctggtggtggtgtacagtaaccaacctctctagctaatcaataagctgagaaacaaaaacggtgtgtcaccgtgagggtttagttccaaattctgctctctataaatggataaaatgttgcttagtcaagaagtctgttaacatgtgtgttgtgcgtgtgtgcacccgcatgtgagggcatacagacatgtctaaaaaaggcaactatttataatccacatcggaacacagactatgctcctcacaattcttttccgaaagcagccaacacattttgagatatgccaacagtcattatccaaggatgtaagaacaggagcaccatgcatcacgcggacagtcgcctttccaggtaaatagcacagagcaagaaatcaacaccattagaaatgaagaactgcagtttcttggaggctaaatttaaattttgtcttttctacacaccaaatataagccaagaaattattcatatgcaaatatacatttcattgctacatatatattcttagtagaatcttcaagaaataggtcagagatacaacataactctcaagacattggaaagcaccaaaaggtcatgaaaacagggcttccattttccagattttagtttcagaatgtcagctatatatgcaatgctgaggtctctcacagatgcaaaatactactaccttgtttttagaagcagacgtaaaaccacaattttctcaaaaaagttaacacaatggctacagttacagtgccggtaactaatctctcttcatcagtcaacccaccaaaggatgtctgaatcaagccattataagccaatacaaaacacttatttcaggtttacttacaaaatagcatcagccttaagaatactaattctgaattatgatgaacacataaacggagacccgattccatctctgaaataaccttttcagaaggtgagcgtggtgtcctgcaccctggagacgcaaagcctacctgagacaagtgaaacagtgtctttctcccatgagacgacagtgatgtacgcctccaccgaggaggggataatgcacttgaagaccgcaacattgcctctcatggttttctggtcctccacacggactgtatagggctcccgtaaaactggaaggcagaaagaggacgtcagtaaggcacacggtcaacaggctcattctgagagtatctcactgtaatatatacactgcagcacacacacatcaattgcataacatatctttctggaaaacagttaagatgcctacatttcacgtctttcatcgcctgacttaagaaaacattcattcccttaacaatacatagctgggtaaggtggctcatgcctgtaatcccaccactttgggaggccaagatgggtagatcccttgtgcccaggagttcaagaccagactgggcaacatggcaacaccccatctctactaaaaatacaaaaaaattgctgggcatggtggtgtgtgattgtagtcccagctacttgggaggctgagatgagattacctgagcctgggaggttgaggctgcagtgagctataatcatatcactgcacccagcctgggtgaagaaaaaaaaatacactacactttataccaaggggccagagtataatcgaaaatagttaatagaccccctgaaggtatcatgagataggaaatagcttcatgaaagaaaagttactggctctgcaaagttatgatgatggcaaactgctattagtcctctaagggccgaggaagatttttttttctgactgcaaaaaatgaataaaaaattcaggcaaggcaatttttctgggaagccttgagaactctgagacaattaaaataatttttcattagtaaatttttaaatgacagttgcaaagcagtttgggaaacactgatcctgcttcccattgtttagggaaggatgttgattagacagcctgcccaaacactccaatgataggagcatcccagaaagactgcagagtggacttccacgtccttgatgtctaggctcagaggcagggtggtactggtgttcaaaacctacctagcaggcccaactccctgggttcaaatccaagctcggccactccctgactgtggggcagtgagcaaatcctctcaccatctataccatggggatgatgttggtagcatctgccccctagggtgactgtggtgaatcagttaacgtaggtgaaaattcaacagtgtctgctagaagcaggttgggtaaggccacacttaccaatagccagagatggatccccagggttggggaagatctgtctccagggaagtaagacactgatgaatatagtcccaattagatgtgccagccttacttctttagagctttgttttcctcaaatttaaaatgagggcattgtggtgggaacctcttcaaggtctaaatcttataagtctatgattttctaagatacccacagagataacttattgtctaatcatctaaccacctcacttaaagaattaatcacttactggacaaatatgtgccatgaaaatggtttcaaaaggtactaacacaccaacaaagctaaaggtgaatttctcaagggaaatctcccagtaggcagaggtgagctctttagaagaggactgttaaggtcgggctaaccttgtgatatgctgagcatttttgtagtaaagcatgtctttcatgaaagccttcctctccagtttccatttttaacattagccgtttttccccaacttggagaatttcttcattattgtatctaaccagagagatttttccaagtattgaaatcttctgcgacccccatcactgtaatccccaagcggcatgaggtgaaggtccaggcagcaactccacacctcctgcaggaggtccactaggcaaaaattcagggcgcccaagagactgacctcagcaacaacatccttacaccgagaggagggaactgactttgtacagaaaggctcctgcataagtaaacctttgctgggagctgaggtctacggtaatagattagaaaaagactatgaagatataggcaaactaatcaaactcattggtgagaatctgggcatggtgagaagcagaagacagagaggagaagaggaggatggaggacagaggagaaagagggactggtcaacagagagagtctaccgtcacaggaatagtgcccctaagcaggggaatgatttcaatttaagctcctttgtctgtgtgatgcttgtttctttgcaataaaatcactctgtctccccaaaccttccgcagactttgcttcaaacattaatgactcaagtaggataatttttaatagaaatcaaggaaaggggtcaagttccatgtatcagacaggaaagtgagaagaaaagatgttcacctgtttaccgggagacacgggaaatgccttcccaccaggtgtacagcctacactagatgggatcacaggagccataaaaatatggggtgactgaccggggacattcccagtgttaccacccaatgtccagtgtcctaggaaacccctcagtcccagcacttacccacatatcatggagttttctcctctctagctacccactgccctcaccagtaccaggacaccttagtagtcacaattttaaacctgtgtgacttttgcttctccaacctccaggtcagtcccaagaagcccagatcttctcaaagcagggacagcactgtggtgatctgaaccccagctcgctcaaagggaatggggatcagaagaaaactgcacactccccatcccttctccttattcgattactcattccacaaagatagcctgtgcagtgagcctttaaaaaattatcttagaaaatacttggcacacaagaggtgttcaatacatattttgagactgaatatatagaaagacagagcttccattctgggagaacttctaatccttttacagaatatacatgtatgcacatttgaatttatagccactatctatagttttttaaaaaaatgcaaatcagggttttattaaagctcctaatctttgtaatagagcattgtttgttcctgaggcctccataacttaagacaccaacattgctgtctatggcgatatatctctcagagggccatgtgagtttcctgagcccatagtcagccccgaagacaggggtgcagccttgatcttcattctacatccaactactgctaactttgttgcagtaacagacactgggctagaaacctgagatgcaggcaaaaaaaaaaatacactttgttttaaatttgattgacatttgcattataagacagagtattatctaagtactgtgcttggtgtcataagttaggctctccccagagagcccagatcttctcaaagcagggacagcactgtggtgctctgaaccccagctcgctcagagagaacggggatcagaagaaaactgcacactccccatcccttctccttattcgaccccaaaaggaggagctgggttcaagcgactgagcaaggacacaatcccctgagaggcagggaaagtgtgagtagggcagggagggaagcagcaaagcaggtgtgtggtttcaggtgaagtcccagccacacctgacatgctcggtcatgcagaggagctgggatcccctgttgtagctgtctgtcattggcttagggctggcctcaggaggatggaactcccaggcatttcccactcttgtttctgtgaatggttccagtgcccaagcaatcctctgaaggctgcaggttcatgttcttagcaaccagcgcgcagatcttgggggatctgattcagggatgccagtagggtccactgcaatcattttagccttcattcagtaaaatctgtcatctttttagatcagaagaaaaaaaaatctctggtaatatgactttgaaacaaaatcaggcctatttatttttttaatcaaatattttcattgtgatataagagttgtacatattctggggtacatgtgatgttttcatacctgtataaaatgtataatcataaaatcagggtaattggaatatcaatcacttcaatcttttccctgtgttgggagcacagtaaatcttttttcttctagcaatttaaaaatatacaataaattattaactataatttccctactgtgccagcaaatgttagaacatattccttctatttaactgtatttttatacccctcagccaactactctttaacccctctcctcatccccttgcttcccagcctctggtatccaccattccactctccacctccataagatccacttttccagatcccatatgtgagtgaaaacatgtaatgtgtgtctgtctgagcctggcttaattcacttagcatagcaacctccagtttcatccatcattatattcttgttggatggagagtttgcaaatattaatagtctccccattctgcatgttgtctcttcaactttgctgatttttattttctttgctgtgcagagtttttctgcttgatgtaatcctatttgtctatttttgcttttgttgcctgtgcttttgaggccttaccccaaaaatctttgcccagactaattttctatagtgtttccctagtgttttctttcagtaatttcatagtttcaagacttagtttaagtattttgcccactttgagttgattttcatacacagttaaagacagggatctagtttcattcttttgcatatagatacccagttttgccaacactaatttttaaagagcttgccctttcctgaatgtgtgttcatggtacctttgtcaaaaatgatttgggtataagcgcatggacttatatttggattctctattctatcccattggtctatgtgtctgttttatgtcagtactatgctatagtatgccagtactacacctgtgttgtattctttgaaattagactgtgtgatacctacagctttgttctttttgctcaggattgctttagcatttcggagtcttttgtggtttcatacaaagttaaggatttttttttctatttctgtgaagaatgtcattggtagggatggccttgaatctgtagatcactttgagtagtatagatattttaacactattaattcttccaatcaacgagcatgaaataactttccattttgtgtgtgtgtgtcctcttcaatttctttcatacttctttatatttttagcatatctactataggtttttactttgtggttaccatgaagcttacgaaaagcatcttatagttataagaagttatttaaaactgaaatcaactttactttgattacacacacatggcttatttattgagcaagagatcacacggttggtctacattgacagcagcgaatgtgagaaaacattttaaatggtccattttcaaggcataataaatctaagcactggcagccagcctgcagatgtaacaaattgcatggctcatgcacctagaaggtcacgataagcaaacagaatgtagacgaggggtcagcccataaaagggaagaaagttttgttactgggaaatcaaaacttaagtggggaaggggattgggttataactttaaaagggggataatgaaacttaggcgatgtccaggaagattgtaactccatagtactcaatcaatgaggaactgggggagggacttgcttgctaggcaataaattacctgctctacctgccctgggtgtgcctgcctaacaggcgcctgatcttgcatcaaaagtcttgcttaggctgggtgcagtggctcacatctgtaatcccagcactttgtgaggccgaggtgggcagatcacctgaggtcaggagttcaagaccagcctggccaacatggtgaaaccccatttttactaaaaatacaaaaattagccaggcgtggtggcgcatgcctgtaatcccagctactagtgcggctgaggcaggagaatcacttgaacccgggaggcagaggttgcagtgagctgagattgcgccaatgcactccagcctgggcgacagagcgagaatccgtcttaaaaaaaaaaaaaaaaaaaaaaaaagagtcgcttctgctgttcttcgtgtctctgagtccattctttgcatctggatggctgtatgtgcgtttctcacatgaaatactcattttattgtacttcggagagattatgttttttacaagttgaagatttgtggaaaccctgcatcatgcaactctatcagcaccatttttccagcagcatgaactcactttgtgtctctgtgtcacattttggtaatgcttacaatatttcaaacttttaaaatcattatatctgttacggtgatcattgatcagtgatctttgatattactattgtaattgttttgcggagccacaaaccacatttacagaagatagcaaacttaatcaatacaggtcatatgtgctctgcccacctcactgacatgccattttccgtctttctccctctcctgaagcatccctttttttgagacacaacaatactgaaattaaatcaataaataaccctacagtggtctttaagtattcatgtgaaagaaatggtctcatatctcttactttaaatcaaaatctagaaatgattaaacttagtgatgaaggcatatcaaaagctaagacaggctgaaagctaggccttttgtgcatttagccgagttgtaaatgcataggaaaagttcttgaaggaaatgaaaagtgctacttcagcgaacaaatgataagaaagtgaaactaccttactggtggtgtggagaaaatttgagtagatagaagatctggagagatgattaaactagccacaacattgccttaagcgaaagcctaaatcaaactaagtccttagctctcttcaattccagggaggcttagaggggtgggaaagctgcagaagaaacactggaagctagcagaggttggctactgagatttaaagaaagaagcaatctttataacatacaaatgcatggtgaagcagcaagtgttgatggagaaactgcagcaggttatctagaagctccagctaatgtcaatgatgaaggtggctgccctaaacaatatattttcaatgtacagaagatatccttctattaaaagaaaatgccatccaggattttcatagctagagaggagaagtcaatgcctagcctcaatgcttcaaaaaacaagctgattcttgttaagggttaatgcagctgatgactaagatgaagtcaatgctcatttaccatttcaataattctaaaattatttcttagaattaattatgacaaatctactttgcctatgctctagaaataaaacaagaaggtctgggtcacagcacatcttcttatagcatgtcatgttgcacaggatagaacctccaggacgatgtagaatagaagtggtgagagcatacactttgatattgttcttcatttgggggtgaaaacatttcatctttgacaagtatgatgttcgctatagcaggattttcgtagttgctttttatcagattgaggaagttcctttctactgatggttttctgagagttcttttaatcattagtggatgttgggtttcatcaatgtttttctgtgtctgttgaaatgatcacatggtttacactgattaattttcaaatgtgaaactcaccttgcattatgaatataagcctttgtggtcataatgtattattccttttatatgttgttggattcaatttgttaaatttttagaatttttacatgtatagtcagaagagatacttgtctttagttttcttatgtcttgtttatgtattagggtaatgctaacttcataaaatgatttgggaaatactctctcctcaattttctggaagaatttgtttataatttttattctttctttctttctttttttttttttttgagatggagtctccctcactctgtcacacaggctggaatgcagtggcacaatcttggcttactgtaaccttcgcctcctgggttcaagcaattctcctgtctcagtctcccaagtagctgggactaaaggcatgtgtcaccacacttgactgatttttgtgtttctagtagagatggattttcaccatgttggccgggctggtcttgaactcctgacttcaagtgattctcctgccttggtctcccaaaagtgctgggattacaggcatgagccactgtgcctggccaaaattattatttctttcttaaaggattagtagaattcaatagtgaagccatttgagccaggaattttactgtagagaatttttaccaataaatttaaattctttaatagatatagggctattcagtttatctgtttttccttgagtgagtcttgatagtttgtgtttctcaaaaaatattttatttcatctacttttcttaatgttctcttagtatcattttaatacctgtagaagataaagtgacgttatctccctcattcttggtattagtcatttaccaactctctcacttttctggtgaaaaacacaccaattttaacaatttttttaaaagaacttttagtttcatagatttcctctattgtttctttctgttctataatttattgatctccattctgatcttcattgtttgctttctgcttatagttttagttttatcctctttttcagtttaaaatggatgctgagaccactatttaagacttttttaaaaatttctaatataagttttttagagcaataaaatctccctatttttttagtggcactccccaaattcatatatattgtgtgttcatttcttattcagttgaaaaaactttctaatttccttcttcaaatttttttctgaatttttttttttgacacagatcatttaaaagagtgctattcagtattcaggtacttggttatttctcagagatgttattgttagtgatttaatttcattatgatcaaacaacatattttatacaacttgaatttaaaacaaatttatctgagatttgttttgttgctctgagtatggtctatattagtaaatgtctgtgtgtctcagaagagaatttatattgtgctgttgttggatagaatgttctttatttaaaggtcaattacatcaaattgattgatagtgtcattcacgtgtttttttgttcttactgattttctgtctacttctaccaattattgaactaggagtattgaaatctccggctataatttttgatatgtctgattctcattgcagttctatccatttttactttatgtattttgaagttttgttgttgggtacataaacatttacaatagtcatatcctcttcacctcccccctttacattatgaaatgaactgctttagctctgagcacaggggatttttagggcagtgaaactgttctttatgatactgtaatggtgatacctgccattatgcatacaacttacaacatagagtgaaatttaatgtgaactatggacttcagttaataataatgtataaatacgagcttattgtcacaaatgtatcacactaatgcaagatgctctgagcaaacagtgtatttgtttggaaatacactttgcttaatattaatgtggctattctagctttctttcagtggtttactttaattaggttgatttgatttgatgaggatggtatatcatttttatccttttacttttaagctatttgtgcctttgtatttaaagaatgtttcttttaagcagtgttaaatccaatctggcaatttctgccttataattcaggttactggaacatttaaatttaatgtggatattgatacggttaggtttatcattttgctatttgatatgtattttttttttaccgtgtttcctttttcttatcattttcttctttgttttggattgaggattttttaatgattctattttttctcctttgtgggcttattagctataactctgttttgttattttagaggttgctttaggttttgtagtatacatttgtaacttatcaccatctatattcaggtgacattacacaacttcacatatagcaaaataacctccaatattacactcccatgtcttcactgtaggccttaatgctattgttgctataagttttacttctgcctatgttacaaactacctaagacattgttactatttttgtctaaatagccaattattttttaaaatattgcaattttttaaaaaatctgatttagatactcatgtagttaccattttcattgcagttctttcctttgagtagatctaagatttgatcaggtgtcatttttttcttctgattctagaacttcctttaagatttcttgtagtaggattcagctgatgataaattttctgctattttgtgtctgagaaagccttcatctcaccattattttataaatttacttccactcttgcctgtaatcctagcactttgggaggccaaggcagggcaacttcttgagcccaggagttagcgaccatcctgggcaacatagcgagattccatctctacaaaaataaaaataaaaatcagcctgatgtggcggcatgcacctctggtcccagctacttgggaggctgagatgggaggatcacttgagccagggaagctgaggctgcagtgagcgatgatcaccccactgcaccccagcctggttgacagagcaaggccctgtctcataaaacacacatatacacacatccacacacacacacacccaacagcaacaacaaaaatcctgtctactgtcattcttatctttgttcctttgtgtgtaatatgcctttcttctgtagctgcttttgatattttattattgcgctgagcaattttattatattatgatgtgcctttgtgcattttttcttcacgtgtcttgagcttggggtttgttgagctccttggatctgtgggtttatagttttcaacaaatttggaaaattttggcctgcatttttccacttctttttaaatttcaccatcccttcccttggggcttaatttgtcattaagcttcctgaagcatgttttaatttttttgaataaagcttgatttttttttagagcagttgtaggtttagagaaaagttcacagcaggttcccatattctccctcttgccacatcctttaatttctttcattattatcatcttgcattaatgtgatacatttgtgacaataaactcatatttatacattattattattaactaaagtccatagttcacactaagtttcactctatgttgtaagttctatgcataatggcaggtatcaccattacagtatcatacagaacagtttcactgccctaaaaaaatcccctgtgctccgtctgttcaaccctccctccctcctgactatcccctggaaactactgatctttctactgtctctctagtttatctcttccagaatgtcaagtaggtggaagggtatactatgttgcttttccagactggcttctttcacttagtaacaggcatttaaatttcccccatatcttttcatagcttgatagcacattttttctatcgctgactaatacttcattttatactataatttgtctaatgttaaagaaaaattgtagctgggccctgtggctcattcctgtaatcccaacactttgggaagctgaggcaggcagatggcttgagcccagaaatttgagaccggcctgggtaacatagtgagaataccctctacaaaatttttttttttaaagaattagccaggtgtggtgacttatgcctgtagccgcagctacttgggaggctgaggggaatcacctgagcccagaagttgaggctgcagtgagccacgatcccatcactgcactccgacctggacaagagagggagatgtcctctcaaaaatattaaagaacagaaaaaaatgttctaacacttattaaaaagataagattatattcatgtctgttccagtaggagtcatctatgatgactgcaacagggaagggtaattcaacttcatattcaacaaggataagtgagggtttatagccaatgaacacagtgaggggagcagtgggtggaaaattagaaagaggagacatcaagggatgaggattcttgctaaactggcctaacagattcttgctaaaatcaggccaaacatgtatacatcaaagatgggactggaagaacttgatcagatattaagagtgatcaagtatcaagagtaaggggatgatttagcaggattcttgctaaagctggggacaagagaccagatgtgaaaagctaaggttgagaactagttgagaggagggctcagaggagcctttccaaagttagtcaaggagagattctttatccccatccactcacatactaaacaacatctttgttgcttccatgttttggcaattaggaataaagttgctatacaaatttatgtgcagattttgatattctttatcccaaagcataaggcaagcataggacacatcttatttccagctccttaaggaatgctttcctctactgcctgaggtccagtcttgaaaatggttgcttcagatattttgtctgcatttttcgttgttttttttcagttggttgtattagtccattctcacactgctatgaagaaatacccaagactgggcaatttataaagaaaagaggtttaattaactcacagtttcaactgcctggggaggcctcaggaaacgtacaatcatggcataaggcacctcttcacagggtggcaggagagagaatgaatgcaagcaacggaagtgccagatgcttataaaaccatcagatctcgtgagactcactcactctcacgagaacagaatgggggaaacttaccccatgattcaatgaccttccactgggtccctcccaggacccatggggattatggggattatcattcaagatgagatttgggtgcggacatagagttaaaccctatcagcctcaggacactggtttttggttgtttcagataaaagggtaaatgtggctcccacacctccatctcggccacaagcaaaagtcctagtcaaatgttagaaagcagtttgtggccggggtcgctcatgcctgtaatcccagcactttgggaggccgaggtgggcagatcacgaggtcaggagatggagaccatcctggctaacacggtgaaaccccatctctactgaaaatacaaaaaagttagctgggtgtggtggcgggtgcctgtagtcccagctactctggaggctgggcaggaaaacggcgtgaacccgggaggtggagcttgcagtgagccgagatcgcgcgactgcactccagcctgggaaacagagcgagactccagtctcaaaaaaaaaaaaaaaagaaagaaagaaagaaagaaagcacagtctgctaaggagaaaacaatcatgagaaatcttctgacttgcccaggatcaggcggctcattgctacttgctctgtagcaaaggcagcctgggtaaggagcaatactgtctgaagtggcccacctgcattccagcccttagaacaggcaagaaaatatcttatgttaggactaggattgatgattaatgagacatgatgagtaaaccttccttcaattgctagcacccagacctaggtcaaaatttctgaaatttaagaatgagaatcccttgtgctgccaagggaaagattatgaagtcattctacctaatagcttattccaggaaaatccaaacaccaatctacagggatatttagacatttaggatgacctgatacagaagaggataccccgtgagtgagcagtcatcaccctcaaacctacccttcagctgtcaaagggtagcatttatgcccttcatctgtctttttgaacaagcttccagttctgtactcatatttacataaacaggatgaaaaaagattttcaagtatccagtgaacaacctaaaagattattataaccattatgtgttcacaataaaaagcaaaatgaaatcaggagagaaatttgatttgggtaatatgactgcccatcttatatgttcaaactgatacagtagtcatccatatgctggattcatagtccatagggtttcagatgtcaagaacgccagcacataaatagtaaaagcacaactgggtaggaagaggcaggtagcacagacgccagacaagatgatgcaatgtccatgctctaaaactttcagtgtcatgcaaaaacaatgaattctatgactaatttagaagatgatagttaaaacaggagtaagcatttcattcctttatctgacagaaaatccaaggcagacataatggattaatacgcacagatggagctgtttgaaattctaggtttccctataagtggtgttttgcagattataaatacgcttttataacacatcattaaaatgtgcagtcttcccagtaaaagtcattcactgtatctccctgtttgtcaggtttagaggtccctatacaaattgcattgtaattatttgacacatcaaattttcatatatcttgattaaagacaatcctttttttctttcttatgtgaattctcatgcaggtcttggaattcatgagcatgtcacaaagatcaaaatatagttgggaaaatgactagctagcagcatgagtcatagtctaatgtttgatggcttacatcaaagagatcatatgcaggaattcagaaacacctcatatttttctcatgttgtgatgtcttctaccagcacctactcacttactgaagaaattattgcaaagctcccccagctacctggtgtataagaaaaaaatcaaagtcacattctctttgccctgctattatattatgtcagtctacacaagtatttcagagctagacttaaaaaaattaaaatgctgtttgctaacaggagtctagctgtgagtttgttttgcagggctttgttaaatctatagaaccacacaatctgtcctgtatatatagcccttgatgtctgtgtatctcaggcagtattctttcctgggttgacttgtagcaatggtgattaaaaaaagacacaatatgttgttaaaaggaacatagcccattcaggatttatgtactgacaacatttcagcaacatgtgatacagtcaaaaatgttaaaatagcctttctatttcacaaggaaagcaaggatattagattgattctgtttccataacagtacatcttgatgctatggttttattccagctcaaccatttgtcatttttttctctctctttctcctcccctaggatggggtaggggaagggcaagtgggaaaaaaggaggggtggaagcaaacacattgggtttgagacactgaaaatttgaattagagtatcaaattagacaaaatataaggaggctgggatgttagaacttgccaacttgctaatcactgctttctttcaaggtttagttccaacaatgtaaggcactttgaaatctaaacaaggagaccttaaagaagtcatcagcaaggtcagaatgaactgatgatggggttttcattggttctctgctgtgatggcattttgctatgtgtcattgtcattatcctcccatcccaagcaggcacagaaaaaacaaagcccagagctgtactcaccagccttgatgtggacatcctgacttctaattttccctgaaggattttcagctgtgcaataataagtattatcatggattaaggtactgaagcttgaaggagggaaggggaaaatttggagagtgccgttggggtggacgtggcggatcccggggacatcgtagatctcctcgcccgtggctaggtaccatctgagagtcacaggagggatgcctgctgcggggcagggcaccagagtccccgtggtgctggcaaacactacctcttgcagagatgcattgacaaagtagaggctggagtgtaggtcttcactgaaaactgcaagaagacaacacagggatccataggtgagtaaaacatgcctttgacatttgcagttcaatgtctggcctcagaaagttatcctgaaaattaatcatgaggcgcaggctcaaataaaaccaaataattcaaattttctgaaaatgctgtgagcagacaggctgatactaaaaaataaggcaccatcctaatttcacattttgtacacaaactgttaagttatcctggatgttaatttttaatagattgtttttttgcctcatgccccaaaccctgttctctccccacactgaccaccattggactgtatatattttatattcacttattgtctatcttctgccactagagataagcctcatgaggacaaggtcttaatttactcccactattacctggagcatagagcccagctctcactggactctcagtaaagggaagctgaatgtgtgaatgcctagatcttgttgctgggatcaaattgctctctttactagcttcactgagggttattatgcaatgaaatttgccacatttttaattaaaattgcaaatcatatgtaaaacattttattttttattatactttaagttctgggatacatgtgcagaatgtgcaggtttgtcacataggtatacacgtgccgtggtggtttgctgcacccatcaacccgtcatctacattaggtatttctcctaatgctatccctcccctagttccccaaccccaacaggccccggtgtgtgatgttcccctccctgtgtccacgtgttctcattgttcaactcccacttatgagtgagaacacgcggtgtttgcttttctgttcctgtgttagtttgttgagaatgatggtttccagcttcatctacatccctgcaaaggatatgaactcatcgttttttatggctgcatagtattccatggtgtgtatgtgccacattttctttatccagtctatcattgatgggcatttgggttggttccaagtctttgctattgtgaatagtgccacaataaacatatgtgtgcatgtgtctttatagtacaataatttataatcttttgggtgtatacccagtaatgggattgctgggtcaactggtatttctggttctagatccttgaggaatctccacactgtcttccacaatggttgaactaatttacactcccaccaacagtgttaaagcgttcctatttctccacatcctctccagcatctgttgtttcctgactttttaatggtcaccattctaactggcatgagatggtatctcattgtggctttgatttgcatttctctaataccagtgatgatgagctttttttcacgtttgttggctgcataaatgtcttcttttgagaagagtctgtttatatcatttgcccactttttgatggggttttttttcttgtaaatttaagttctttgtagagtaaagcatgttaaaaaagcaccattatcagaaaatacaatgtcaaatcaacaatacacttttatttaaaataggacataacaataaagagaattttgacaaaagcatgactcaactccaccagcctacagtgtctgttttgatttttacatttcccttgtggtccacctgcctccatgccttatctatataattatatcatgttaaagtgtacatacgtaaaatgtaccatttttataactgtttaattcttttatacatcatctacattattccatggttctatacggacttcacaagtaaatatcagtgaatgcacaatttatacatattcttatgaactgtttttctgctcttttcatttaaattgtttctcttttcgcttctacaagtaaatatcatcaaatgtgttcatacacatttggctttttaattcatttaagggcctataacaagtgtttctggagtgttggttatgtgaagaaataaaacgtgacttccagaatttacaagttaaataaaagatttataaatataatgaaggcctacttgtcacacatctgagcttctccatgactttctaaagcaggtgcatacctagttacatatttgtaagagagaagagaagccccagatatttcgaatgaacttcactggtcagaagtgagaataacatttattgtatgcttcatagtatctcataccagacaaccttctaacactcgagatgaacaacagctccgctaggtaaacaaaggctccactttgcagacggtgacatggagattcacagggctgtcacttgaccaaggacacaggatacaggctgtcacttgagcaagaacgcagggctaggaggtggcagaactagattcagtctttctgatgaaggcttttgagatttttgttttctcatcttagaaccaaatgtggcataacagtcccccctcatttgtgtggggattacaggcagctctgtatagagtgggtctatggcctgtgcttccagatctagtctttctccgtggtgtggagctgaggggttacaggctcctgctatgtgctggggttgctactaagtctatgtgataaaatacatgagcccctcactttgcctgtagttaactgacatgatttggtaagaaagagatgaagaaattaacactatttacaaaggtgattggactcatcttataataataagatttaacctgctcactaaatgtgagggtagcgggtggtctccaccctgctgttaggaagcacagcatccaagcattggcacaaggctgaatagatgtggttgactctactcacagcatgttcttccctgctgccacttggtggacactgtggggctcccttcagatttcctctttagcgccaatgcaccctgccccaaagcagctggaaagatcctatgttgagtcctacactgggaaccagcccaagttacagggaactgccttgtctgaggcctgcagggaatgactggtcaaaggtggctccacaagcctggccccctcgtgttaagttgcaacaatgctgaaggtgcatcccacctgagaccgctatcatcagagctttgcagagaagcttctccctccactcattctgccttcctcacacccttgctgatgtctctcttgagaatacactcccaggaggccttctgcatgcaactcttcctctgagcatctcccttcaggtaactcaacaggagacatcaaatgaggctctgctagttaccctctacaaccatgtctttctgaaatgtttttctattttaaataaagtaatcagaaagtgccaactaacatcccatgtaagctccccaatagagcatgagcaataaataaaatacaccaagatggaagaaagtactaaatctggattatcactggattaaaacatttttacaagcaataattattacattgaataaggcaatgacacaactaagactctcaggctgttatgtttttgggaacccattgaatctggacagtgacagtgtgtagtttgttttatgaaaacatactcatgtaagaatctaacatttcaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaagaatctaacatttatctattatataaacattttgatttttagttaaacttcacatattcaatgggctcatagccctaagcctaatgcctagcaagctgtgtgtgtttcgtaaatgctagttggtgcattcactgtccccatattttttcattttcccatctcataattcatgtggtatgtcaaacttctgttgataatataatgtaaccttttgaagtatttttggaatttctattttacaaaattacaactcttttaagtagattggaattacctctcacagtttaggaactgactgtatagaagttgagacagagagagagagagagagagagagaaggtggggggtacaggcgaaagcctttagcgaggtcctgatatagagagatgcttacaaactgtggccccccttccactatgaacaggaaagcctacatactgatgtgaattctgctcccctgtgagggacacacaatgtagatgtctccaaagtagatgggcccccgataagaccctctttctccttgatcaggggaagcatcaaaagctattgtcaatctgtgcgtctcaagaagtgtcttgttcaacaatgctggaaataacatggatgatctcacacttgaagacctacacctccttggggatgttggcagatgatatctacctgacaggtccactactggggtgagatctgagggtcactctggctgttaggccatatatggcaccaatgaaaactctaacttttcactggtgtcatataggatggaaatgttaccagggccaaaggcttcaattatagaaaagtttatcagtataaacacagtggtcaatgacacacaatcctgcagggcattgagacgtgtgttgtgtcacagttacattaggaaacttgctctcgtgtgcctatatggaatgtagacttctatttagtaaaaccaagaaggttaacccctaacctcactaaggagagatgggaaggattgctgtctttccttgcacaaatataccttagagtgcacatggcaaaacttcattctttaactaaggttaggaaatatatcaataaatatgttggtgtggggatgaggaagggcaagtgtaatgagattcctggcctactatagcctagaaagaaaacttcattaggaagaactgttagaaagttatgaggatggcatatggtggtcaagatttggtatggtggaatgagctcatgcattttagcactacatcttgttaagaaactaaatggtcatgtaaccagtcatttaaacactaagcaccaactttagattgtcacaataaaggaagaagtagggagcagaatagaggcagaagagacattaatctaataactagatgagctaataactaggcctgggcactctccgtggcttgctacccaagctgtctcgggacctatccgctgcattgtgacaaagtattcctcagctgccccagccatggctcaagtggtcccaggcctggcttaacttactgctctggaaggtactaatcataaactttggtggcatccatgttgtgttaattctgcaggtgcacagaatgcaaaagctgtggggcatggctttctccacctaaacttcaaagacttcccagaaagcctgcggccctgggcagagacttgttttagaggtggagccggcacaaagagtccccattagggcggtgctgagacgaattaatgggccagagctgcagcagagactgtccactagagtaatgcctagtggagccacggaagtggggctggccctgagatcccagaactgtagagctaccagcacataacatcagcctgggagagctgcagacataagactccaacccatgagagctgctgggtaaactgagcccaagagcccaacaaagccaccaaggcagcttttcctgaggccctggggacccaatccccaccccagtgttccccaggtgagggacatggaattaaaggggtttcttatccagctttaaacttaaggttgttttctctgttgggttttagatttacttgaaacctgttacctcttcctgcctctttctcctttttggaatgggaatgtccatcctgttcctgtctcaccatcgaattttggaattagatagcttgctttgattcatagctcatggctggagggaatttgcctctagatgaatcatgcctgagtctcactcatatctgattcagatgagactttggactttcaaactgatgctggaattacttaagacttttggggtactgggattcaatgaatgcattttgtatgttagaagtttcaggaggccagggcagaataccacgatttgaatgttcctgccaaaactcacgttgaaatttaatcaccagggtaatggtactgggaggtggaaactttaaaaggtgactcgtaagaggcagatccttcatgaatggattattgtcattatcacaggagtgagctccttataaaataatacattctgcctccattttctttctatcctgaacacttgcttctgtcttccatccttccacctaggatgaccttcacctgatggccttggacttctcagcctccagagccatgagccaaataaacttctgttgtttacaatttactcagtctgtgtattctgttttagtagcagaaaatgaaccaagacaacaattcacgaaagtttcactcttcacactcatacagaataggtgaaaccttttcacatcactattttagtttcattatatgcctgcctttattccggaaagtcagatctaggggaagctgtgtccatgagatttagcatcctccaggtatcttacttgaaacatccatcgtttttctcttggtctccatcactggcagaaaccaagagtttggcctccagggccagttggggctatggctaagctgggaagcacagtgaacaccaattgccaaaaggtggcagagaaaaatacattttgtacaagcgatagctcttacccacagagaagagaggcaggggtgttcatcaagtcgtaagtgttttatagttttctctcccaaccataactaaagtctttagcaatgcttcataagtcagaatatgaaaattattgctaactaagaaatcggttcagatcagaagcatagttaatagttcaacacggcagttttcaactcaaataaaaatgctgatagtagcactgtaattttacatttgagctttccaagaaactgacattaccccaaacatattgttaggaatgaggtaactgtcactcttcaaggctaattaattccaccaggattcttttattttttttccctacattatttttctatcaacccgactgtgggtaatttgaactaagcaaaatttggtcatatttgaatttatcctcttgtatcctaaaagtagtcttgttaagaatagcaagactttaaaaatgtaaatgtatacaagaaacattgcttaattaaatgtatagtttcttattgaaaatctcattccacaagccagcttgtgaaattatttaaatgactgcaggaaaaaaatgataaataaatgtttaatcctagcagttaaagagataagcgacctatgggggattactgtcacttctccttatatttttaaagaattttacattagtctttctccttcatgccacagggtttaataatgtaacataaactcattctctaagagacacatcatatggccacaggcaaaagaaaacccaaactatattccaacagcttttgtttcttccatctaagggaccatccatctgcctaaataatagcacttctttttatagagtgcctcctgctctttaatacagtaacatttgcttcctccagtaagggcagaggcaaccttaatgtgaattatgtgtgtgtgtgtgtgtgtgaaagttcctaaaaaataactgtgggttcaaaacagaaagctaaatgaaacattcagcacaatcttgtgaaattcagggttgaaaatcctggggtaccaacactaagggagctaatgggagggaccttggagaattgtttcttcagttgcagacttctcaatattttacatccctgtaacagacggcataaccaaggctccactgacaaacataaagaagagtgttacaccaaaaagaaaataaatcaatattttagcttttcttaaaattcaaacagggcagggtgaaaaggggagatgtgggaggaattttgcagtaggcagtgacacaagcattcactgatgcaataatatttattgagcacctactaggtaccaggtcttgtgtaagggcccagtaatgcaagatataacaagtcctggtactactgccaaggaaatttcagtctgaagggtactctagttcacatagtgaggtcaattataattctatttaccgaaggttgtgacagaaacattcacaaaatgcaacagaagcataagtgatagagaaactaatctgacctatgaaaaatggaaacaactttccagaggaggaaagaaaagtacattctaggcagaagtcttaaaaaatattaggacattgagttgtcccagtcaggagagaaataaaaaggtgctgggaagcaggaaattcaatgcacagctaaaagtgttgcacgattaggagagggagctacaggtttcttagattcatttatcttggaaacactcttcagcacctaccatgtatctggcactgtgccaagaccagcagacacactaataaccaaggcgtggaagggtgctgattataaagtcaagattgtaaagagtgtcaggtgccaagctaaaaagcatgcgcttagccctgcagacaataaggacaattaggcacatacccaggagaaatgaaaacatacatccacacaaaactgtgagcaaatgtttaaagcagcattatgtataatggccaatggtggaaacagcctacatgtctatcccctgaagaacaggtaagcaaaatgcggcttagccttacaatgggatatcactcagcaataaactagagtgaagaactggcacaagctacaatggggatgaccctcaattacagccacaaaaggccacatactgtatgactccattcgtatgaaatgtccagaagagggagatctgtagagacagaaagtcgactagtggcttacttatggttaggactgggtaacgggacaggataggagggtttcttttgaagtgatgaaaacctgctaaaattgattgtggtgaaggcaccttatctgtgaatatactaaaaaccactaaactgtatgctttaagtggattctttttatggtatctaaattatatttgaataaagctattttaaaaagtaggaagtcaatgaaagttttgacaatgaacaatcaatttcccaaattgaagtttgagaaagtaaacactgagtagacagggagagaagactgcaggcagaaagcctggctagactgctctgctgggagtctaggccagctgggcattggtggtgagaagggagaaaaaaggcctaattatggatatgtctgatatgatcctaccagcatcggtgggcagggatgtgggagcaaaaagagtgaagaaaataaaaaaagtcaataggaggcaaatgtaattgcttgcatacccagttgcacagttacactattacaaagagagcctacaagacagagctggttggtaaaggaaacaacatgtcagtttcactaacgtaaagagggcactgcccctgggccacccaatagcaaattggaaataggagtccaagaccctagagacatatttggcagccagggaaatttaagtctatcactgggtgagatattccaagaaaagtgttgcattagtttgttttcacactgctaataaagacatacccaagactgggcaatttacaagagaaaggtatttaattggacttacagttccacatggctagggaagccacaaaatcctggtggaaggcaaggaggagcaagtcacgtcttacatggttggcagcaggtaaagggagtgaacttgtgcaggaaaacttctaacaaccgtcagatctcgtgagacttactatcatgagaacagcacgggaatgacctgcccccacgattcaattacctcccactgggtccctcccaaaacatgtgggaattcaagatgagatttgggtgagggcacagccaaggcatatcaagtgtaaagaacaagaagagacaaaaaccagaagtaaatcctcagggatagggagtattttataaggtaggaaaatatctgacaaaagatttgtacccaaaatacataatgaactcctacacaccaatataaaaagatagtccaacaaaaatggacaaaagtgctgggtgcagtagctgatgcctgtaatcccagcacttttggaggccgaggtgtgtggctcgcttgagcccaggaattcaagatcagcctggggaacatagcaagactctctctaccaaaaattagctgggtgtggtggcatgctcctgtagtcccagctactcaggaggcaggggtaggaggatcacttgagccccagaattggaagttgcagtgagccgagatcgcaccactgcactccagcctgagcgacacagtgagaccttgtctccaaagaagaaaaacacacacacacacacacaaggtgtgaacagtcacttcacaaaggccaatatataaatggccaataagcacattaaaaagtgcttcaatgccactggtcattaagaaaaagtaaattaaaagtacagtggggtactactacacatccaccaaaataactacaatggaaaagacagaatatattgagggtcttaagaatgtggagcaacaagaccctcaaacaatgcaggtagtaatgtaaatcagtagttattgtggaaaattattagcctctactaaagggaacacatgtgtacactgtgactcaacaatttcactcctaagtatttatacaacaaaagcacatgcatatgtccatcaaaaaatacacgctggaatatctacagcagcaacacgttgtaacagtcacaaactgaaaacttaccaaatatcgatcaataataaaattgatacatcgtgatatattggcaccttgaatcactacatactgataacaatgaacaatctgcacataaaatattataaatcacacaactataatggtgaagaaaagcaaaaagacaccaaagggatttacactgtattgttccatttatatcaaacatcaaaataggaaaaactaatctatgatgttgagagtcagaataaagtttgcccgtgggggtggggtcaggtgcagagaatggaaagggccatgaggtggcatccaaggtgcaggctatgttctttttcttgatctgggtgctgggcacactgcatgtgtacacagtgatttgcatgtatgtaacatttcaattaaaaaattaaaagagtttaaagaaattggaaaaaaatcatgaaggagataaataggaaattaggagatcagtagctcaaaccctagagagtgatgtcttagaaacaaaaagacattttgagacgttaaccaacagttttcaacactgtcaattgcttcagagaggtcagaaaacatgagaactaaaacaggctatcgaatttgcaaattgggtacattaattttgaatggaaatgccatttgggttcaagttagctttattgatttcataggaatacgtgagtgggtatgcttactaaaatgaactgcttgtgtaaaggtcttccaaaatgaaagggaatataacttagccttaggtaaacatatctagaaagcataacatttagctgattctgagactccaaaatggttttttctttggataaatgcttagaaattcagtgtcatctcgatcagacaatcacaaatcagttaaatgatgggcttataatgacttggaaagcattccaaggcttctatgaagtgattccaagtcaggttattaaaatgtgctcatatgttatagcaattttgcctttaacgttaatatatttcactcattctatctactcccaagctgtgaaatgatgttgcaactgtcatcacttagaaatatgaaattctgtctctgtccatcataaaacaacaaacaaaaacacagaaacaagaactggatttactctatgtcttcactaaagtttcagacagtacagaaaaaaaaaaaatgaaagaaggaaacaaacaaagtggaccttatgagtggcccagcttacttcctgagtttctaagataattccaaaaggaggaaatttgaataaaacttggttatattgtggggttagggggaccaagtatgacacttgaggggactaaggctgctagaatttacaaagtggaaagaaggaagttatatagagagggagctccagagagcggaaggagcttccagttgatgagtccttaactgtgtgctgatatttgcatgcgtgtaagaaaactaccaaggttggattaggaacaccagaaagaagtgggtgaaaatctgtgaagctcacacaggggagaaaatagttcatgtttcaaccagcaaaagaggtaagaacttctaataaatagaacatcagattgagtattcagaaatgtatcacacagctgcaggggacaaattaatcataacaaaatttaaaagtgatcctagaagggaacaaactgagtctaagtaattgaactgcacaacaaaaaactttgatgataattaatagaaaccaacaatcaatcaataatataaaatttacaatgtctgtcattcaataaaaaattggacacaataagggaaatatggcatattattaggagtaaactattccacagaaagacacataaatgagagatgatacaatttgcaagcatggatattaacatcactcttataaatattctgtcaatatgtacaagacagtaggaaaaaggaagagctcattgatgagagaaatggagaaaatacaaacagccaagctgcaaataaaacagtcaaatggaccttctagagattcaaaatgtaatatatgaaatgaaagttagacaaataggattaatggcagattacacccttcagaagaaactgtcaatgaaccagaaaacagagcaattaaaactacccaaattgaaaaacaaactttaaaaaggcttaaaaacagtaaacacaaaactggtgagatgtgggccaatatcgtttggcctaatatacgtataattggagttctaggatgaaaatgagatacagaaaaaaaatcgaacaattaatatacagaagtttcaaactttaatgaacactagaacctcaactatccatcaaattcaacaaacaccaaacagaagcatgtagaaaaccacaacatgacacatgattaaattgttcaaatccaacataaagaaaaaaacttaaaggcaaccagattaaaaaataaatacatgttatatttagagaaacaaagataagaatgacagcagacttctcatcagaaacaacgcaaaacagaagacaaggggagagaaatttgaagcatttttttaaaaaaaagacaggaaagaaaaactgtcaacctaaagctctatatgcagaaaaattttcataaagacaaaataactttctagacattccaaagctgagaattcattgtcagtagactagcaatacaaaaatcgttaaaatctttcaggaagaaaagaaataatatcagatgcaaatttgtgacttcataaagaaatgaagagtgacaaaaatgttaagcatgtgggtgaatataaaatcatattttctcactttaaatcatcaaaagatacattactgttaaggcaataataatgcattgtgtggtttgtaacatatagataaaatgaataacaatattaacacaaaggcaggaggaaggaggaaataaaaatttattgttgtaaggtccttctataaattaagtggtattatttgaaagtaagccatgttactttgaagatggacattgtaaactctaaaagcaaccacttacaaagcaaaataaaaacaaaacttacatgttaatcctttaatgcaggtaaaattgacaatttaaaaaatactccattaatccaaaagaaggcaagaaagagaaaaataaaggaacagaggacagatagaaaaaatagggagcaattagcaagatgataggtttaaacgaaaccaaattgaccatcacattaaatataaattgcctaaacactcttaaaagtaaaacattgtcagattgaataaaaaataaatacctaactatacgctatccaggagaaattctattataaagaaactgatagaccaaaagtaaaaaaaatagaaaaaatataagctaacactactctaaagaaagtgggagtgattatattaatatcaaagtagattttagaataagaaatattactagggacagatggttattccctaatgataaagtggtcaattcatcaaggtgacataacaatcctaaatgtctatgtacctaataaaagagcttcagaggacatgaagcaaatctgctggaattaaagtgaaaaatataaaatccaaaaggagaactgagagctgggtctctctcgctctttttttttttttttagtgctaattaccattagggtaacgtaacagtgttttttgttgagatgtaggttgcattcttgaatgttggaggttaagaaactgtgagtagaaaaaatccaatgtcatctcacagctgtcatacactagggtctggccacgctggtctcctcagtgtcctaggtccccaatccccttccaactcggggtctgtgctggtactaggctcttagctggaacacttcaccctcctttatccaattaactcctactcattcattgaatgtcagctaaacaccaattccttagaatttattcccggtcttctacctttcatactagacaccgtgtcctacctttcagcttcttgcatcacactgtcatcaatgttttcatagctattttgcatgtgcaccccactccattgcaatctagaagaggggcagcatgcttcataggagatgatgcaatcttattcttagaggcagctggtgtgctggctaatacataatagaagccctcacattttttattgaatgcataaataaatgtttaaaagaaaaatattatggttttcatactacatataactaaagagattccttttaagaagtaacaatctgtattttatatacatcatctactataatctaaattccattatatagatatcaagggaccacaaggatgagtggctgacaaaaagaatttctgaggtgctataagaacacacttcgaagattttagctactttgtgtaagaatgttctttttatccaatatttgtacttattttgcaacaagaaggaaaaagcctgatttttgccatgggttttacaaagctctggagaaaaaaagtaaaaataaattagtgttttacccagaaaatgtctgagtattgtttgcaatccatttctagagtactacttccatatgtgtatagggaattcattttagagataaaagtctctccatccctttggatggattaaagtcactctcattaacattgctaggggttaagtgtacattttcagagaggaatatagaatctgtaatgaataatatgtatgtggtttactacgttccggcatttacattttaagctcaaaggtttcaaaaggcatgaaagtggctagcgatttggaaggagcagaagacccagtgagcattatgatcacaggcagtaaagcacatgaataaaccaaaatgatgtaaatggctccttaggattcggaagcataaaaactggggaacaagaatagaacaaacgaatgaagaaagagtacagagttatgtaaagaattacaaatgaagaaaatcagcagaaataacagagaaataaagataacatcacaataatgttaacagaattgctttctgcagattaagaggcaaagagttggagagagagggaaaaaattacaaaattgaatgtccaaaaacatggcaatgtgaaatagcaacaaaaaaacagtgaagcaacaataaagtaagattatcaaagggaaggggaggaggacgttaaccaaagccaactgaatcatttctcctatgattaaagaagaaaatgaattataaccagagactgactggtacctcagcataaaaatgtaaaatccaagttcggtaattaaacctttcactccagcattaagtgaaaacactgaagtgaaatgacaaaaagacataaattcttcttagtttcattgactaatacactgttgagcattattttcttttgctagaacttcactatgttcagaagtgcttcatttttcattttgctctgacctaaggacttacagaaatctaatgttttaagtaatttctttcttcatgtaacgcacaggtttaagtttcagaaacaaaataaatgaccattctcataaatgcaaatacaccctaagtcatgagtgatgacaatttttaaaaaaactttgaaagactctttaaggattgactccagtctaatctggtccctcgaatttaccagcctttccagggtttgctctgaatgagagactggctcactggcttcctctagtatgacttcttttggctttctccacaatgttaaatccattgccattggcatctcatgactgccagcatctcatctctcttcccctttgtccttagagtgtttgtaaatccctttatttccatgttaatgaagcttctgtggcaggatgaggaagcaatgacaaagtgtagatgtccagttgccttttcttatcagcaatgcctactgtcgccaaagcagtgatggaaaaaaaaacctgcgtccgggctccaggtatgaggtactcttctatcttcccagaggacattggggaatactgcatgaatgaaactcacctgactttaccatcccttgtactcataccacctgatccagttctgtatttttgcccttgcatatcaacagactgttcgtatatgtgactttattcattgccaaaacatttgtaccttgaatgcagcaaagggggcattgtcatccttgtaaaccgtgtgctcacacagcactgagtgtatggacaatgcaatcaacacttaaatgtaaccgaaggcagacctctgtggaggtggaaaaagcatttctttgtgagaaaaggtgccatcatttctggggttctctgtagttggaacctgctctcaggttctgacctaggagtgtggagaccaagggcctgccttttctggacctcagtgtgcagccatttataaagcaaggtgtgactgacctagaattccatactcaaagtatcaaacaagtaaacgaggacaattttagatcatgcaaagtcaaaattttgacctctcatgtacccttcttcaaaaagcaattaaaaaatgaattaaaaggttgcaaactcagaaagaacatacgatatccagaaaacagacggtacaacataggtgagaaacaaaaagaatttccagaataactgtgaacgataacagaacaacaaacatacagcagaaatcagtccagattaaagcagaaagaaggctcctggagagatgtttccaggaaaaaaataaacattcaagcacgctaatgcatctgaatgtattaagaagagtgtttagtccgttggagaatttggggaatgaattagtaacacatgcagtgaaaactaagtaaacaaagaagcaagtgattattaatcctaggaaaaacacaaagctgtaatagaaaaagtgttcatcatatactatgtggctcagctgtagctaatatttacatagtcataataatgtaaatcataaatattgatctaaccccaaatggtagtatcattatatagataaaatagaaaaagataagaaaagagggcattcacagtccataaaatcaaggtaaatccatatctaaacttgaaagattaagaatttcagtgtaaaaagataacttaaaaatatgggtctgaacatagaagagtcagctttaacaggaaaaaaaaaaatactcacagaaagcaaagtctgtaagtgagtgtgtttccagagagtttgtctaattccaatcatgatcagaaggagcccaaaccaaccctatgcggaacagtgccttccaagtggacgcagcacaatttgtctgattctctgctatggtttgaatgtttgcccccactcgaactcatgttgaaatttaatccccaatgtggcagtattgaggggtagagcctttaagaggttattgggtcatgtaggctctgccctcatgaatagatcaatccatgaatggattgatggagtaatggattaattgattagtgggtgggttgtcatggaagtgggactggtgactttataagaagaggaggagagatctgagctggcatacccagccccctcttctctgagtccccatcagcaaaaagaccctcaccaaatgtggcccttcaaccttggacttcttagcctccataattggaggaaatcaatatatcatttctctataataccagtgtcaggcattctgttacaaacaacaaaaaacaaaataagacattctcacctacatcagtcagctggagactaatgacgccccacaggctctcaatgatggaaaacacacgatgctgaaatctcgcctacagaggcttatttaggagtctcaaacacgcaagactttaaaaaatctgttgattggaaccctggttaaattattgtcctaatttccttgtccacttagctatgcccctgttctgggatccagtattcttaaaacttcaagaagttttcttgccttcctcctcatgtatgtgattcttctgcacatttgttagtacttcagaaaaaaattaataagagtcacataaggtatactcaaaaatatccttaaaatatgagagttttaatcgaagaagtaaaaagcatcattcttaacagttgcccaacccaaacatgtgggtgcttgtagaggtccctgttttcctcatatcttatattcacagcatcaataagtctcttagctgtaccctcaaaatataccctgcatctgccttgtgccatctcctctgccactccctggtccaatccaccatcacctctccctggtgcccaatgggtctctctgcttctaccctggtcccctacacacacactctcatccatcagctccatcagtgagagtgatccagttaagatggctcaggccatctctggcctctgttctgagcttttgaggaccccattctccaggtaaaagcctatcttcctacaggatccatcctcactgtttcttctctgatgtcatctcctaccaccctcccctggggatcccaccgcagccacactggcctccttgtcgtctctagaccacccctgcaggctcccacctctgggtctctgtacctgctctccctccacctgggatgtttttctcccagaaactccctggctcaccttttccagccttggctgtgccgtctccccctcagggatgcttcccctgactgcctggtaaagatggcggcacttccactactgcagcgccccctccgacccacgcctgcacttactccccatggccctcagcgtctttagtgcactcgatcatttacctatttgttatacttgcttcaactgtctgcctctaaacctatcctaaaattttggtccctaaaaagtaaatattttggttgattttattccctgatgtattcccaattcctacaatagtttctagcatgtagcaaagagtctcaacaaatatttaatacttcttgaacacaagactgttaggctaaattcaattaaatatcaataagtctcagtgacatatagtgttttaaaattaaacattcactataaatgattcttttttttttttattttgagacaacttttgctcttgttgcccaggctggagggcagtggtgcaatcttgactcactgcaacctccgtctcccgggttcaagcaaatctcctgcctcagcctcctgagtagctgggattacaggcacctacaaccacgcccggctaattttttgtatttttagtagagacggggttttatcatgttggccaggctggtctcgaactcctgacctcaggtgatccacctgcctcagcctcccaaagtgctgggattacaggcatgagccaccatgcctagcccactacaaatgattctgaatgccgcctctccatttgcacagcaccttaggcccttcccaagcattttcacccatcattgtcacatttaatcctatagatgtttattcttacagactgcactaggtgagaagtcagagctctagagaagagaaggaaattagttaccctggattccgtattgtgtgtcagcaaagcaccaagatgcccaagtgtgctccttcactcagtggtaatgcatctacacgtggcaatatttcaatctccactgacatgggtcgctagccccgtgtctgccaagaaaatatcaccaagtgcattatcaaactttatattcaaagctgtaactattgcttctgttcttggcatgattaaataattagcttttatggaatacacattatgtgctaggattatgctaagtaatctaaatacaaaaccttattttaatcctcaaactacacctcacaggctgctattgctgctatttttatgtcagagatgagaaaccatataaactttgaactctgtcgtgaggaacagagctgggatttggtgctaggttgtcagttaagcagtgactgtgtttgggctcagaaccctttaagaatgagaagaaagtgctgcactctgtcatgaacaaaaaggacacacacagttctgtttccagctccttaaaggtccaaatccccacttaaaacacctttgatctaaacattgctgcagattatttaaaattctcataataagatgtgcttgggctaggtatgccgtgtagtccttggagctcatctaaagccttataaactgaatcgtgttcctttgtaatcacttaacatttagatagattgaggttcagtaatcagatctttaagtcacagccacacaaaaacaagacaactctgctaacatgtctttggttataacatttatttcctgtttctttttttgttgtgttctataaaatcttaatgacctactttcatatacttcttccagaattaaaactatgatcaaaaattgaaaaaaccaaaccagaaaacatgatttttagagtggcttcctccaaagacatcctctaggccagatccatggtgaaaatgtagcacattcaacatacactgtggtattaatgctaatttacaactgcactacaaccaaatctcagttggaattcattaattttgacagtttgcctatcacactagaatgaattcgccgagtcacagaaacgtctctgaaaagagaagaatcacattctccttgctattaagtattcataacagactggagttgaacattctcaaggcaactagacataccattaataatcccagaacctatgaaatgtggcttgggcttcaccgagcagaaacccgtagccactcaggtctctttccttctatacctaatatgcaccagctgtgtaatgggctccgaagagcctccggggcgcaggaggtcataaaatagagtccattattccacattggaaatttgacttgatttggacttgacacttcatttggagaaatgtcctggaggcataattttttctggaagtttggggttggggtgagtggctggctgttgcaaatgaatcctgtggaacatttttaaacttaaaggaatgagacttcttaaatatttccttcatgatgacttctcaaaataaaattgagttgtaaagtctgaaagttattactggaatgttttaaattaaaccgacccaggatcgcagatttccaagagagagtgtgaagaccgtgccagtcacagcattttccaccgtttgataaaaatcaaatcttatctgtaaagacataactgttctaagattttataagcagaaaataacgcccatagcatctatcaaggatgccccagggccacaagcctggcacgctgtccagcccatgatgctgtctctataagaggccacctgatgtgatgtgctggaagactgttgccaaggcaacacaaactgcaagagaggagggggtgggagcaagaccccggactcacaataccccagatttcaaatcagtagatttagagtatttgcatattttggggcacctagagtacaatgttaacaatatagcacatgcaacttgctcaatgattactaaagcccaaaacagaaattgttacaaaatattatggaatgatcctgttaccatcagaaaaatgtttagcccatagaaagtaaacctatgaccccaagtcactacctaaagacctatttttatgtttgcatatttggaccaactctatgcatttaaaaacaaaataatttacatatttattgtttctctcatacttttaaagtatgaggccagtaaactagaatgtcagaggcaacaaatatgagcttcggtaaggaaggtttggtaataaggatgtgagccataagcatgactgttctgaagaagtatttaggaatgggtcaaagtcaaccttacagattctgaagtaacacaaaattaggctagtattaactttgttgtatttaatgttttcattagtcacttaaacacaggtagtatgataggagtgatagtgagaataatgttaacaagaagacaatttcactaaataccaggacagacactgcatgatctcatggaattccccatcaacccacaaggcagttgcaatcatggtcctcatgataaggaggggaaagttgaggctatagctcatggggcggtgagtatactagtttgctagggcttctgtaacaaaataccataagccaggtggcttaaacaacagaaatattttttttcatggttctggaggttagaagttcaagtttgcagtatccacagggttggtttgttctgaggcttctctccttggtttgtagaaagtgtcttctcaatgtatgttcacattcccctttgtgtgtgtgtcctaatttcctcttcttataaggatatcagtcatatttaatgaaggcccatcttacaggccacattttaacttaattacctccttcccactgcacccccccccccgccccccgggtgagagtcttgctctttcacccaggctggagtgcaatggtgcgatctcagctcactgcaacctctgcctcccgggttcaagtgattctcctgcctcagcctcctgagcagatgggattacaggtgtgcaccacatctggctaattttttgtatttttagtagagacagggttttatcacgttggcccggctggtctcaaactcctgacctcatgatccacctgctttggcctcctaaagtgctgggattacaggcaggagccaccacaccaggcctgcttaattacctctttaaaagccccatctccacatacaatcaccttctgaggtcagtggttaaggcttcaacatagtttttgggggataccattcaacccctaacagagggaaacaaggatggtagaggaaccagggaccataatatgggacaaatgtgatagaattctgaagattctgcaatgactgctgtgggcaggaggatgaaatctattatatcaccctaggaccctcccttcctttaagaatgaagttaaagagaggcagatgccaccaccatgtaaggcagaacattctaacaattagaactgcccaacattgaacatactgaaatgttttcaaggagaatggtgtattggagatgccaagaaccttgaaggttgactcagcaatatctagtctcttactcattccaattaagagtcatgaaatcacaagaagaatgcatgtttctctgccttagaggagatacactgattcaataacttcatctccttggaggctccttgcctgactgatgtggacaaggtcctctaattaatcacacattagctctgattcctaaaatagctcatacaattattgaggcaatttcaagtgagcatgctttgcaaaataagttacttttgcccctatactagtcctaattagctacttgtatcataaaactagaaaagtctagcctgaatccaagacaaatgcatacaaatgatgaatatgaaacactttttgagaggacttaaaatgtgaagaaagcaatatatgtgactattatcaccatttaatggtactttgtgcgagtcctgggcttggagccagcaccacggatatgatgatcacttgctattttttctactatttcagagtctctgcttttctatgctgggtaagatccatgtgattggcaggtcagacgatgcataaagtgatttgaggcaattacagcgacagttaaagattaatatgggaaaatactctcatctatttttttcttcctgtatctgagaaactttctctaaaatcattaccttcctgacctatacaaaagaggccccaggtatggcaaactgtgccaggcactgggagggtgcagacatgcatgcaggtgctggaggggcaaaaggccaggtagttgctgcactcgtaaataacccactggagaggcacttacagggaggcaggctggagacaagtgccaggggaggtatgaaccaggagcttggaaagaacagaggagcctgctggatactgactgatgggactgaggaggttgctgcctgcagtttcttttgcggtttcaattccctactcccagtctactttttggtgagacctcacattggagaagcggaattactccactgggggtaattttgccctccctagggaaaattagcaatgtttggagatactgttgattgtcatgagggagggtttggggagtgctatgccatctaatgagtagaggccagggatgtggccaaacatcccactgtgtgtgggacagtccctcccattgaagaaccatccaacccaaaatgtcaataggccgctgctgagaaaccttgcctctgagcatggcacccatagactgtgggtcctgctctccctctggcccatgagtgacttatcagagaggtgagtttgggaagagaaagtgacacgcctccttttcttctcccctctagcctccttgacctcaggggccatgcccactgctctgctctgctccactctccccatgttaagttgcagcaagaccctgcttgtggttgggggaagggctccaggggcctggcttggtttggttctggggtttaggattagcaaggccattgctgccacccgtcagcaccacattgtcaagctcagactttgtcataaacagatgatatttgatctccacctgacccctctctatatctttctgttaattgattccaaatataggcagggagctggggtgtcttggcatccgtaaaccccgacatcacttactgttgaatcttaaacagatgatgggccctaacttaattatacaaatgtcagtccttaataaatgataagcagagtaagccctgtgaggattaacttagatgtgcattagatgcgatgtggggtcatctagaaatcggagtcaccccaagaaacgctaaatgttgtcaaaagatgacactgagagtctccaatccaaggaaattttcacctgaagctttccactttaacagcatctacagagatcaagctacggggctacaagaggagagcaggaggaagataagaaaaggggcacgctgcttcctcttcccaaacccatctctcagataagtcactcatgggccagagggagagaaggacccacagcacatgggtgccatgcttggatgcagggagccttgaaaaatacttttaaaaatattcaagagccaccttgagaaaggcctctttaagagacaaaggggccagagcttagagtcaagccatgcatacacaaaggacagaaaggtcttccatccaacctgtgtaaatcactgcactttcttctatcagggtgagcctcaatctgcttcttcgaatgtaaatccaattgtcggagaggtctacagataatgtttaccaagcagcctcttaggaaaaattcaactgggacctccatcccaccattccagccagagtttcaatatggctcgttcacacttgatttccacacccttcttttcagttaatacccttttttccttctaatgttgtatgaaaatgtagactctgagggttgttttcctgcttgtttaatacgtgcagtctctaccgtccctcagctttgtcagtccaccttcttgggttctgaatgttctcatgtatttatgtagacaaacgtgaatgtgcttttggaagagaagagagtagacaaagtaagaagagaatcttggattttgacttgttattgtcacaaaacagaaatgctggttggttcaatatttaaactggtcaactattcacaaatgaatttttaaaaaattgctaaagcattgagagataaattagcaaaggaattcattactctctgttctctttgcctgtacatatatgttatttgcatgtatcacactgagggtactgatccacgtgtttttctcctccagttgatttaaagttccaaatgggtaagtactgcatcctattatgcttgcatttctaacacctagtacggcactgatacaagctagatgactatttgtgtttactgaattaaattccattcaaaagatacatgagcaggcaagtagcaaggaggaaatacaactagttaaggaacgtatacaatttacagcaattaaggaactgttacaaactgccacagtgtttaaaacacacttgctttcatctgaaatgagtgtgtgcatgttttagaaagcaagttggctataggtgtcaagatcccaaaaaaaggctgcaaactcttgcccagtatttccacttttgggggcctattttgtaatacaaatatttaccatttgtgcagtacccacctacattccagacacactgtgctaagagatttgaaatgtcattgcatcctttagccctcaaagaacaaccaccagcaccttatagggtagagattagtcctattttaagaaggaggacagatattaactaatgtatgaaagatcacaaaggccacatggctagaaagtgacagagtcatgattcaaacccaaatctgttgcattctgcactattttttatttacagcatttctgataccaaatgggcagacttttttctcacaccaaccaattctctctggaagagcaaatgcatatcctacatttcagatcagttctgacactcactacccagaggtagtgcagacttccccacccccagcttaagggctccattccccgagattgccctcacttctgatgccaggtgcaagtagctcatccccaggctacccacacttcagtccaacttgaatacaaagtcaaggggaacctatgaatctcccctttcagttttcataatttgctagaactgctcacaaaactcaggaaatcactttacttagtattatcagtttcaaataaaggatgtaactcagaaatagccaaatgtgaggagagatgcatagggcaaggtatggggaaagggacacagagcccctactccctccctggacgcatcaccctctcttcactcaaggatatttacccacccaggagctctcctctgaagcccatcatttagggggctttctggtggttctattacataggcttgattgatgacatcattggccattggtaactgaactcaacttccagctcctcttctctctccaaaagtcagggggtaagctcatgggggccgtgggtatattagtttgctagggctgtaacgaaatatcacaggctgggcagctcaaacaacagaaatgtatcttgtcatggttctggaggttagaagttcaagatcacagtatccacagggttgatttcttctgaggcttccccaattgtgaccaaccctgtcactgtgacttggtctttttggtgtgcagccccccatcctgaaggtatctagggcctccaaccacctcattagaacaaaagaggcttccttcacacttgtcattcaggacatctcaagggttttaggagctcctgtgtcaagaaccagggacaaagaccaaatatctttctatgatgtcacagattgtcaagcccaagcttctttcttctataacatatactgaagttacaatcttaaatagcatagggttttttttgcaccaagttattctttttaattttacttaaaaacccttatagaattgaaaattatataactactccacaagaagaagatagtttattgtggaactttagttttatggaatattatggatcaaaaattacatttaaaaagaccgtgaaacactatagaaaatacttaagataaaatgttaagcagaaagcaaaattacagtcacacagtgatttcaatcagaaagcaagttgatgctacggaacaaatactgtaaggaagattctagaattatgggagttaggacaatagacaatattttcctttattctaatttcttatttttactaatggattgctttactagtgaatttcttgaattctgactcttggttataaaataaaaggcaggctttaatttcactgtaaggcagaaatgatacatattataggatcacaagtgtatatatataaaaaatagagacacacagctttataaggaaatacatcaacattttacccagttactggagaggtttgcttttaaaaactcagcaaccggccggacagtggctcacgcctgtaatgccagcattttaggaggccgaagcaggtggatcacctgaggtcaggagtttgataccagcctggccaacatggtgaatccccatctctactaaaaaaaatacaaaaattagctgggcatagtggcaggtgcctataatcccagctactcgggaggctgaggcaggagaatcacttgaaccaagggggcaaaggttgcagtgagccgagattgcaccacttaactccagcctaggcaaaagagcaaaactccatctcaaaaacactcagcaacctgtctgggttcatgtgtcatgactatcaggtgattatagggctgatgacactaagccacagggagaggaacacaatctccgcaggcagaaagagcatctcattctctgctggctttccagagcctggccacatccagcatccagctgacctcagaaggggctcttgagtgggttctgggctcccagtcttccagcccatatcaaggtgaggtgcagccttacctcctgtcatgcagaaaccaccttctttttctgaaggcacagtcaataaaatgatcctcccattcaagtctccctttctgaccacactttagtctgagaggtagctctcatttcaggggagtgatagccttcaagggatgctgtggctcctactagtgggaggcatatgtttcattcatgtgaaatgcatttcacgacagtcttggcaaagagaagggtctgctctgttatgtaccccctccccgtaagtagcaatagttgattgtatttgcttgatattttacatcagaagaacaattagtttcttgcttttgagaggttaccaaataaggttttaaaaattttaccaagaaactaaattaaattaaaatgcacaacaggttgcaggtagaccatgccaatgcatgaaattctaactcttgctcttttcctaaagcaaacagtgggaaagagttgcatcagggacccagagctggttctgtaaccacttaattgtaatcgcatcttcttctgcccttcattaaggacaatcctaactgttgtaacaaataaaccccagaatttcagtggtccaagctaacaggcatttacatcttgcttaggagtcacatgaaggtcaccccagtagtgttcatgattggtgggtgcccttcctctacacaacaattcaggaaccttggttcttgccttttggagacctctcatgtcctctatcccagtgtttttcaaagtggaggtcaattagaatcacctagagtgattgttcaaagacagattgcggggccccaccccagagaatctgattcagtaggtcaggaatgggccccaggttttgcgcatctcacaaatcatcgagtgacgttgatgctgccagtcaggggaccacacttggagaagcaaagtcctagaaccagatagcagagaatgcagagaaacacacttcctgcttcactaccaaggcttggaaggtgcatcacttcaactcgccatccctcagcaggggcgagtcacacggacaatccccaacaaggagagggatggaaaccacagcctgtgtctgggcagctgcttcccagctccaaccctgcaggaagaagggggagcatgagttctggtggggagtgcaccatttctgctagcgtccagtgatgcttttacagagctggctgtccttcccatggatcatcatgttccttttctccagattttaatgtggtattatttgtactgagactaaaggagaggattatagtcttatcttgtcaccattcttaatttcagccataggcaaagaggaaagaacaaggacaaccaaacctagacaggcgacaagaggacaatggcaggagcactgtctgcagcaatgctggggggaggtgggggccatgcccttgaggagtcggacagagaaatccacctgctcagggaaggggcagccccagagaggctggtccagcaaaaggatgtattctttgacaacaactttcttgttgctggggctgccataacaaagcactacagatgagtggcttaaacaactgaaatttagttctcacagtcctagatgctagaagtccaggaccaagttgtctgcaggattggctcttcctggggcctctctctttcctgtgtcttcacagggctatccctctgtgtgagtctttgtcctaatctcctcttcttataaggatgccagtcagactgcattagagccaaacttaatgacattattttaacttcatcacctcgttaaagactctatctccaaatccagtcacatcccgaggtactgggggttaggaattcaacatataatttttttaaaagtacagtttggcccataaccctggggataaactgtagttttaacttcccgaaatcagttaaaacttagagaattagtttttttttttttttcccccagaaaagaaattatctcctgattctggcaggcagttcagtgtcagtggcttctttcactttacagtttccagaaatgattttcaatattcagtccatcatcacaagtggaaatgtccattgggaaaggccacctctagatgatgcaggtgtaattttttttttttttttttttttttttttttttgccaacatttaaaccaagagctacagcaaacccttgctaactcctcacctgggaacatgtgacaacacctgtatgtgggcagaggaaatgcctggagctgacaaccctttaaagcaactgctagaaagcgcctaagacagtgctctgtaaattttgacacaaataaaatgtacaactcctttgaggataaaaaactctaaatttaatacagaagtcttcttcgagatttgaaatgtgaagtttcaaatacagttagctttgagccgtgccaatccaagcatggcaggttttactgcagccactttgcaaagctaaggggagatgaggagatagtttggccagaatattaaagccatatattcagtccctgccagacaaactaacggcagcccaggtaaagagggcagagaattgtccacagcatttgctgaccccatgtgcctcctcccccaatatgtttcccacacattagagccattgggaataaaaagctcttctttaaaattcaaaacttccatggagcatcaagccttatttacatttgagtgcaaattactttaatcatataattttcagcatttgttgagtgctgctgtgtatttcaagaatgtacaatttcattttggataaagtgaatggaagggaagtttaggatccatctggaaggagtcaaggtctttgacccaagtaaggcaggctaacaaccataggctttgaggtggtagacacactggggctgagaggaggactcagaaggacagggaggatggcaagtgtgaagtgactactttgaaatgcctggaggcactgagataagtggcacagttctgaaatatatctgctgtgatttacaaaggttttagtggaagtaacagaagttgataatgatgctaagctcagaagatctcagattggtattatcctccaactctaggttaggcagcttatagtctctcaaactgattgacaatatcttagctaggtaactactgtgtggcatgcagaaggacaaaggctgttacacttactcagaatttagtgggggcataggaataagatgagaacaccaaggccctcttatggaagattaacctgaagtcagtgcagaaaaagtgactggaaatggagaaagaggatgaacacaaaatagtgagagtggtctctggttttctaaagcatgagactctgacatgctgaaaagatcaagtctagcttgggcaatgatttacttccttggttttctagtttttcagctaaaaaactgacacttaaaaatgtctacagtgaaatgctgttggacagaagggatacaattatatatttaaaatggacaaatgggtgcttaatatctttcatattcacatgttaataaaacatgtgaatgcacatgcatgcactcttccagaatcactctaccaactgttttccacctatgcacactaaaggaacttatcttctctgctgtcttcctgaatagcagttctcaaaccatggttccccataccaacaacatcagccttacctgagtgattactagaaatgcaatatctcagcccccaaactcagagtgacagagtaagaaaagtcacctgtgtgtttaacaagtccactgggtaaatttaatgcatgaagtctgagaaccactcttccagactagcaggttctagctacctggctgcacggtagattcacctggatacttcttagaaaagcagtaatactgcagccccatccagatgaaataaatcagaatgtctgtcaataggatctgggctgagatttttattttttaaaatttccaccaggtgattcgaatgagcagctcagtatactgacctgagtaactccagatgaggtgttacttagtgttcttgtattgactattcctatatgttcattccttcatttccttaaatgagaatttctactgtatgccaagaactgcagtaggtgctgagaatacaagatagatagagatcacacatttctagagtttttagtctggtgggcatcagaaaaagcccaccacgtacagccacacaagttgtgcactggccaacttcaatgggcacccttcgtatctttatgtacaacctagacagtcacatgcgacatctgaggttgaagtccaaggtaaccttggcattttaagatggagaatatataattccaagcagctttagcctttgtcactggtactgccaaatcctgaacaggaggtcccagcagaactaaggacagtgaattgatttctgattacttcactatgcagctcatttcccaatttctttttctggtagctcattattggtgtagctcatagacatgcaactaatttttgtatgttgatttttgtatcctgcaactttaatgaatttgtttaaagatggagaaaggggtcaggagccaaggaatatgaggagcaccactgtagggctggagaagccaagggaatgggttctcttctacagactctgaaaggacatggtcctactgacacactgattttcatccagtgaaagtgattttgtacttctgtccttcagagttgcaagagaataaatgtatgttgttttaagccactacgtttgtgataatttgtgacagcagcaatataaaactgatacatatacacaaataaagaaaatccagaaaacagagtagaggtttgagaaagcagttaagggcagctgaaatttaatgatctccctttagtgggccagggtctgtgctggttactttgaatggattacgtcctatccttacaacagttgtttgagattgtcatcatcatcaccagattcattgttactgttattgccatcttcactgtcatgatcatcattgccattattgtcaatatcatcatcatccttttaattaacattttcatcattatttttattttaaagatgaggaaatacaattatcaaaaaagttaagcagtatcccctaaattacccacctggcaagcggtagtcagagtttgaatgcctctgtctcaaaagtacaatttccaaaaggtacttttcactaaacaaatttatacttacacttactttactgaagaagacttctgcattgagatataacattccactctaattggagctcagaagactttcatttcatgatctttatggcctgaatacagagtggctgaatcaaccactttgaagagctacagaacagattttattgacggcaactagcaaaaagcagtacatcccacaaatgaatgcagcagtgctcccacagacatggttcatatagaaattcacatggtaaaataccactaatagactccccattcaataccatcttgcccaaaataaattgtttctgcatcatcaactcctggcaacaactttgctatatctgagttgtcatttctcacaataatggccttttattccacttggggcctgtcacctggaacaaataaggtctttacaaggtcccagaaaatgagaaaatgttctccataaattatatttttctgagcttattccccactctgacataatacaagaggttaacctgctagagatgtcgaatttcacaccccaaaacatgcagtgaggatctgcttatactagaagaaaaaaacaatcaaatgtatattttaaaaaattaaaatttgagataaagaagtacatttaaaaaaaaattttgtgatacaagagagttattctgataccatgtttctgtctggtcaacagttctcaggatctttcacaagtccttgatctgaggaattctccctatcatttctcaaaatttttctttgttctcatgatgtaaataggtcaaaatttcttataatcaaatctgctgaccaatagatctaaatacaattctataaaaagtaacagtaattatgaaggagaaacatgagcaagattgcagaatagaagacaccctgacattatttcctccacaaacatacaactggaaactattaaaagacaagaataccaccatgaattcaccagaacttggggagaagtggagaaacccactaggccataataactaagaaaaatggtcatttcagactgtgccactctcttctccaggcttgtataatgccactcacagagaattgacacagactcatggtttctaaggtgggaagatggaattggaggtggatgtttgatccccctaccagtatgggaatcttcatgggaagcccactcaggtctcactgcacaggaacccctgggagagctaggagggctgaactacctggggtgaactggggacaaaaagtgggggtgctgatcacttggtgctggaatcttggagctccaatcagcagggatgcagatgtcatactgaggagaccggccagcactatagtgctgcaggaagcatgatcggcaggaaggtctgaatctctggccagacttcccacaaagctcaggtgctcatgtggagtcttcccctgacctggaaacaactgagtttggaaattaagttcctttggaaattaagttccagtacgtatttaagtctttcccagaccaggaaacaatagtagagtagcaatttagttctagtccagtgtttaagttccagtgctcactataagtgttccctagactgggaaacaatggcagggcagtgattaagtcccaatatcaagtagtagaggtccaacactaataacaccagcagaagctggaagagtggctttctcttcaaatatgcaggcatcatcataaaacacgcaaaaattgtttaaaaaaaacaaaacaacaacaaaaacaatctcagggaaatatgatgccaccaaaagaaacaaacaaaactccaataatggacccagaagaattaaatatctatcaaatgtctgagaaagaattcagaataatcctctttaatttcagggagtcacaagaaaatgtggatggaaaatgcagtgaaattttgaaagaatttgagaaatttagcaagtaaatagaaacactttttaaaaatccaaatagaaatcctaagaataaagaatacaataactgaacttattgaaatttatgaaaagcttattcgaaatcttcaatagcagacttaaagaacccacaacctcaaagacagaacatataaaattacccaatcagaggagaaaaatctttaaaaaaagattgaagaaggcctatgagaattatgagatactatcaggcaaactaacctctatataatagtagttccccaggagataaaagagaaaaagttctagaaagcatgtttaaggaaataatcgctaagatattcctaaatctggagaaaaaggacagtatccaagtataaaaagctcagagatcaccaatcaaattcaacccaaagagaaattaaccaaggcacagcatcaaattatcaaaaagcaaagataaagaagaaatactcaaagcagcaagagaaagaaaacatatcacattcacctgagccccagtgcaagtttcagcagatttctcaacagatacactgcaggccagaagagattgggatgatatattcaaagtgctgaagggaaagaaccttgtagccaagaatagttcacatggaaaatgtatccttcaaacacaatggagagataaagactttcccagacaaggaaaagctgaggaaattcatcaacatcagatctgtcttacaagaaatgctgacaagagttcttcatctgaaagaaaagggtgctaatttgtaacaagaaaagatctaacggtataaaattcactggtaaaagtaagaatacagacaaatttagaatactataatattgtaattgtggaacgtaaaccacttggatcttaagtatgaagactaaagaaacaattattaaagatagtaattacaacaattagttaagagttaatataaaaagatgtaaattgaaacatcaaaaataaaaatgaacgtgtgtgggatggtgttaaatgtagtttgtttttcttgctttaatttgcagtcaaagttaagttgttaatcagtttaagataacttgttttaactataacatgattttaagcatcatggtatttacaaagcaaaaacttataatagatacactaaaaataatgagcatgaaatcaaaacatactactagaaaaaaaaaatctctcaaggaaaacaataagagatgaaacaaggtagaaaggatctataaaacaaccagaaaacaagtaacaaaatggtagtagtaaagccccacctaacaataataaccttaaatgcaaatgaattaaaatctccaattaagagacatagagtgactgaatggatttttaaaaatgcccaattatatgctgtctacaagagatctttcacctataaaaacatgcacagactaaagagatggaaaaaagatattccaaacaaattgaagcaaaaaaaaaaagcaggaataacaatatttatatcagataaaatagactttaggtcaagaatggtaaaaaataaacaaaaagaccatgatataatgacaaagggatcaatacagaaagagaacattacaattgtaaatatgtatgcacccaaaactgggactctcaatatttgagaccctcaaatatgtaaggaaaacattaatagatctgaaaggtctgtagattgactataatacaataagagtagggaactttaatacccctactttcagcaatggaaaggttatccagacagaaaaccaacaaagagacgttggatttaaacagccttctagatcaaatgaatccaacagacatttacagaactttccacccaatagattcagaatacacatttttctcaacaagacatgatattttctccaggatagattatgaaagtcacaaaacaagtcttagaaattttttaaaaatcaaaatcatatgtgtcttttctgaccaccatggaataaaactaaaaatcaataacagaagaaatgttcaaaactgtaaaacttcatggaaattaagcaacacgctcctgagcaacagaggagttagtgaagaaatcaaaaataaaatttaaaaatttctcgatcaaatgaaaatatgcacacaacataccaaaacctatgggatatagtaaaagcagttctaagagggaattttactgtgataaatgcctacatccaaaatgtagagagatctcaaataaaaaatccaatgtcacaactcaagaaattagaaaagaaggacaaactgaaccccaaattagaaggggaaaaataacaaaaatcagagcagaaataaacaaaatagaggttttaaaaacaatacaaaagatcaagaaaacaaggaggtatttttgtttaaataaaaaaaaaacaacaaaccttaagctagactaaggaaaaagagaaaggactcaaataaataaaatcagggatgaaaaaggaaacattaaaactgatactacaaaaatttaaaggaccataagagcctattgtaaatttctatatgccaagaaattggaaaatctagaagaaatgagtaaattttggacagacacaacctagcaagattaaatcatgaagaaatagaaaatcttaatagaccaataatgaataaccatattgaggcagtactaaagaatctcccattcaaaaaactcccaagacttaatggtatcactgataaattctaccaaacatttaaagaagatttacaactaatctttctcacaagaattctaccaattcttccaaaaaattgacaaggagggaacacttccaaactcattctatgaggccagcattaccctgatccaaaaatcagaaaagaatacaacaacaaaaaaggaagctataggccaatattcctgatgaatacagatgcaaaaaatcctcaagaaaatagtaccaaactgaattcaataatatattaaaaagataattcaccatgatcaagtgggattcatcacagagatgcaagaatgattcaacatacacaaatcaataaacataatattaccacattaacagaatcaaggccaaatccatatgataatttcaatagatgctgaaaaaaatttgataaaattcaattccttcataaaaatcctccagaaattggttataaaaacaacacaccttaatttaataaaggccatatatgacaaatccacagagaacatcatactgagcaggaaacagttgaaaacttcatttctaagatgtagaacaagacaaaaatgcccacattcaccacttttgttcaacatagcactgaagattctgtccagagtaattaggcaagggaaagaaagaaaaggcatccaaattaagaaaagagggagtcaaattttccctgtttgcagacaatatcatcataattagatagatggttagagaaaagcctaaagactccatcaaaaaaaaaatattagaactaataaatgaatttggtaaaggtgtaggatataaaattaacatataaaaatcagtagtgtttgctatatgccaatagcaaactatttgaaattgaaattgaaaaagtaattccatgtacaatagttacaaggtataaataaaatgcctataaataaacttaaccaaggaggtgaaaaatccctacaatgaaaactataaaacgccaatgaaagaaatcgaagaggacacaaaaaattagaaagatattccatgttcatggactgaaataatgtttaaaaatatacatattatccaaagtgatctacagatttaatgcaatctctataataaaaatctcaatgacattcttcactgcaatagaaataacaatcctaaaattcatatggaaatgcaaaagatcctggagagctaaaggaatcttcagcaaaaagaacaaagcttcaggcatcactctacctgatgaaaatatactgcatagctatagtaaccaaaacaggatgacactggcgtaaaaacagatacattgatgaatgtgacaaaatacagaacctagaaataaatatatgtatgtatatccaaatgatttttaacaaaggcaccagaagtactcattggggaaaggacagtatcctcaataaacggtcctcggaaactggatatccacatgcagaagaatgtaactagatcactatctccatattcaaaaatcaactcaaataagatcagaggcttaagtgttaggaccataactatgaaactactagaagaaaacatagaggaaatgcttcatggaatggagcaaggattctttaaagacaacctcaaaagcacagacaacaagagcaaaaatagacaaatggaattatatcaaattaaaaatcttttgcacagcaaaggaaataacagattgaagagacaacttacagaatggggaaaaaaaactatttgtgcactatgcatctgacaagggattaatatccataatatataaggaactcaaacaactcaatatcaaaaaagcaaataattaaatttaaaaatggacaaaagatctgaatagatatttttcaaaggaagacatacaaatggccaacagctatatgaaaaaatgctcaacatcactaatcatcagggaaatgcaaatcaaaaccacaatgagatatcccttcaccttagaatggttatcatcaaaaacacacaaaaaatttaacaaatgctggtgaggatgtggagaaaagagagctcttccacgctgttggtgagaatgtaaataagtatagccattatggaaagaggcatgaaagatcctcaaaaatttaaaaatagaaatagcatatgagccagcagtcccattactggatatagatctaaaggaaatgaaatcagtgtgttgaagggatgtctgtactccatgtttactgcagcgctgttcacagaagctgagagatggaactgacttaaatgtgcacctacagaggaatgtataaagggcggcctgtaactgtctgaaaccttgttatttctcccacgtagcctctcccctctaatccttcattggctccactttcttcttctttttttttttccttttttgagacatgttacccaggctggagtgcagtggtgtgatctcagctcactggatcctctacctcctgggttcaagtgattctcctgcctcagcctcctgagtagctgcgattacaggtgcccgccaccacacccagctaatttttatatatttagcagagatggagtttcaccatgttggccaggctggtctcaaactcccaacctgaggtgatccacccatctcagcctcccaatgtgctgggattacaggcatgagccaccatgcctgacctcattggctccactttctccctcagcctcctagtctctcattttaagctggcttttgtcccctccactccactgaacatgctcttgcagtcaccagtggcctgtgttttgctgtagcagtgataattgacactattgatcatgcatggtttccctctgataggaattttcttgctgctttttctaagtctctgttgctggttcctacttcctgatttctacgttttgaaggatcccagaacacagtctctggactttctttctttcccagtctctttgtactcactccctttctccctttgatctcacccgttctgaaggtttttagtatcatctccaggctggcagcaacaaaatttccatgtctgatccagacctcttatctaaactccaaacttctacacccaactgcctgctcacatctgcaccaggatgttgaatttgcatcagaaaccgaacattctttttactgagcccctgatcttccttccctgccctgtttccctcactcgatgagcagtccctctgccattctaactgctcaggctacagtccttgatttctcactttttctgtcacctcaaatccaacctatcagaaaatcctacactcagcctttgtgatgcacccagcacgctgctcctttccccatgtccacaccatctctcgttagaatgactaaaatgactcccacctggagccctcgctccagtccccatgccccttcagctctatgctcaacacaatagccagataaatcttgttaaagcataagtcatataatgccaccctgttcaaaaacctccaacatcctctctgtccctatctccccttcctgtccctcccttgctaaccctgctcttgtcacacaggctgctgcaggccttggtgtttgctgtttgctctgcctgaaaagccctcttccacccccgctgacatccccaggactctatcacttcgtttaggtttcactcaagtgccccttctcagcgagaccgactctagcctatctgaaactccacgtctcccttaaaattactcttcttcactgcttcagtttctttgcactaattacaatctactagtctacatattcatttatctgatgcattgctctcccacacccactagaataaagctaccttaagatgaaggcttccgcctgttttgttcacactgtatccccagcagccagaaaccatgtgtggcactcagtatttgcctccaaaatttatttgttgaataaatgaacaaactacacacatcaccatggataaatctcaaagcaataatgtggagaacaaagctagtcccagaagaactcttcctctgtgattctaattacataaagttcaagagcatgcacatcttagcaaaatattacttaaggctacaaacatgtggtacaactacaaagaacattgaggattagttaacaaggagttcaggagaggggttcctactgtagggtggggtggggacgtgattggagaggagcacacaggggccttttcaaggacacttttctatttcttaagtggggttctattcatgtttatattttgtgtaaaaaaaattaagttacatttttaaaagacaaaaaaagacaaagttacatttaaaaaatcattgaagcaagcagagtgcatcacctccttgtaatccaatattcataatataaatgaccccatccccatctcctcggccactgatctgatgcctctgttctgcttatctgctgcattaccagctcactgtgcagcaaattcacactattcattgttagctctatagcccaactggatggcaaacatcccaatagacaaaactccaagaagagtcaaaacaagaataaagtgcaggtcatcttttcttttgcactcctgacagcactttgtacatggtaataataatctaccaattaactacataagccacatggttttattatagtgtgaagctttgtatccagaaaggagagaaggctccctaagactctgtcaagaatgggtgcttcctttctgctgtaacctcttcttttctccaaagccagctcacctcttcctcctgactgagcacagctggggccctcccctaggtcggcttaatgaggtggggccctccctctggcttggaatccacacacattcctgcagccaaatgctgcagcaagaggcagggaccacgtttaatgcttttccttgggaaactgacctgtgtctccactaatatctgacaatttggcaagaggaccaacaagatttgaggcaatatgtgataaaatatgcagttatttaaaaaaatacttttatagattgggtgcagggacttgtgtttgtaatcctagatactgagaaggctgaggcgagaggagcacctgagcccaggagtttgaggtcacagggagccatgattacatcactgtactccagcctgggcatcggagaaagaccctgtccaacagaacaacaacaacacaaatagtgttccaaaactggataagaatgcagatgttcaaaggaagccctgaaaataagctcaattttaaaaagcggggagtaaagaattacaaaaggaaggaaaggaggagagaaggggagaagagggaagcaaggaggaaaggcaagtgttttgttcactagtatatccccagaaacgtttaaataatagacactaagcatttgttgaatgaatgaagtaatagatgaaatagatgtgaagcaatgggagaaaatatggacttacatggctaacaccctgtcacgtggcctgcacctgaatctacacaacaggcccctcagcctccaccatgtaacagagttcagggagcccagcctttttcttctaacacctcaatgccagacttgctccatgttggacaccagcttatctgtgcttctggtaccccagaggtacttgatgaacatactattttatttatttaacacatttggagagagtatctgcaaggattcctccaatgtagtatatcagggggtattccttggtctgttagttcccagaaaatgacctcattctatggaaaatctggttgtccatggttagtccaatgtggtgacacaaaatggaaatccttaaaactaaagaaagaattacagtcatttaataaagacaatgaaactgaaacatcatgaatcatagtttaggaaatcaatttgtaatgaagaaacatttagtatgggagaagggagtgagtaaattacctacggaaagatgaagcaacacatttatacaaagtgtcaatagataaaatggacacacctttagatgtatattatactgattttaaaccacacacattggtaacaaatagactaatccatttccaaactaattggattgctgggtgcacattactatcagagtagccagaggtaggcttcaaactaatggtagtaattgcttttaaacaacctttagatgagtccaggcatcttaaatgtcctatttatctccctttcctattgtagaaattatgctacagatcagcctaatgggggacccacacctaatagacatacaaaggacaattagaagagtcgagaagtaaaaagcaaaaaatgaagttttatagaacgaatgaagacaaaaatctgaaccgcacctgaagtggagctgggccttgtcacgaacaaaaacttacagtgcaaggttctgcagctggctggctttatgaccttgagcttccacttaacctgtccacacttccagttttcatctacaaattgaagggggttgtgcaagcatttgacattctttcagttgctatgggcagtgaacctatgaacatgacagtgacagcaatggcaagaaacagccgtgaggtcttcttgccatcaggccagagcctcttttcttgctcagactccgctgtggggagcaaccgcacaccagaccctccgacacatcctccgtgtttctgccagctctgccactattcaagttctcctgattttatcagcacctgctcttgttctcccatgcccaggaccactataatagcctcctttctattttctgctaatcatcactcccctaaaacacacaacaggtgcaatacttttgacatattaaatgtgtctaccttcagaatcccccagaaggagactctgtgacagggattcaagcaaaagtagtttatgtgaggtagttggtttcaggaaacacaggcaggaaaggaggcaagtgaacaataaaaggaagacggtcaatgaagggcacattatagcaagtcgccactatgagaaatggcagcttcatctcttggagacactgagaaccagagcaggaccctgcctcagttactcttcctgaaagcctagctagctgaggtttacatcaccacctccggctgtcactggccgtggctgctctcaggagtcaatctcaggcactttcacctgccaaagagagtccttaggggaagtgttgctactgggcagctggaagtgctgccaggaaatggtaaggaggtgacaggctccaggcaggcaccaacagcacctgcaacaccaccgctcatttttgtttcttaattgtcctgtgtctccttcacacacggagttgatggcagccattgcttcaaagaaagatacagcctaaaataaagactcagggttttgctctgagtttctgatttgtttctcaagtctatggtaagcatttcatttgaaagtctggatttataggacaattgagagggaagagagttttctaaattcccaaagcctccttctgcattaaggcagaacaaagcttggaggtctaatgatggagttttgccacaagacatggtgtgaagacttagaatatggctcaggacagagttcccacaacatggaagaggaagggagatgatgcagtgggcaggacatggagagatttgggggataaggatgaggttaagatgttgcctagggtccagttacggtggctcatgcctgtaatcccagcactttgggaggcagaggtgggcggatcatgaggtcaggagttcaaggccagcctggccaacatggtgaaacactgtctctactaaaaatacaaaaattagctgggcgtggtggtgcatgcctataatcccagctacttagaaggctgaggcagtagaattgcttgaacccgggaggcagagtttgcagtgagctgagatcatgtcattgcatttcagcctgggtgacataaaaaggctctgtccccacctgctaaaaaataaataaaaaataaaaaagtttttaaaaagatgttgcctggattcttgagaggaatcttagatttgagggtgggtatggtttagatgatagaaactctggattggtaggagtggagaaaaggaaagggaaggtctcccctaccctgagaggccacagcagagtgaaaatgctgcaataaaaagataaggcagagagcaggactgaggtagcaccctggccccccaaggtataggcgagttgtgtaggggattccaaagtttactgatgtgaatttaagagcaaaatgagatgctcatacatcttgaaatgagatattcatatagcttctatggcagactatttgcaaaaaatggctgcaataaattctgtcatccttcatgcatgtcctttgcaatgtgactttgctgctcccctgacttctctactcctagaatctggtgttcgccatgcaactggctttagttacaggaatattggcagatctgatgcaagaagttgggaattaaattaaaacagatagcacttatttagtaattgctttatgcatgtcactgtatgatacggtttggatatgtggccctgccaaaaacttatgttgaaatgtcatttccaatgttgaaggtggggtctggtgggaggtgactgaatcatgggggtggatttctcatgaatggtttagtgccatcctcctggtactgtcacgataatgagtgagttcttgtgagatctggttatttgaaagtttgtggcacctcccccctctcttcctcccgctctggccataggagctgcctgctccctctttgccttctgccatgattctaagcttcctgcagcctccccagaagctgagcagatgccagtattatgcttcttgtacagcctacagaacagtgagccaattaaacctcttttctttataaattactcagtctctttttttttgtttgagttagagttttgctctgtcaccctagctggagtgcattggcatgatctcggttcattgcaatctctgcctcccaggttcaagtgattgtcctgcctcagcctcccaagtagctgggattacaggctcctgccacaatgcccagctaatttttgtatttttagcacagatggggtttcatcatgttggtcaggctggtcttgagtttctgacctcaagtgatccacccatctcggcctcccaaagtgctgggattacaggcatgagccaccacgcgcagcccaggcatttctttatggcaatgcaagaatagacaaatacactgtactaaacacttcatattttaacttcttttatcctacaactcacagccataggagggaggtattattattcttgttttataaatgaggaagctgaggcacagaaaggttggtcaaaggccatacagtttgcacatcttagaggtagtattgcaagccagacgatataactcccaagtctgtgcgatttatctctggaatatttacaattcagcctgtaagaaagattgcccaacaaatggtcgtgtgtgtgtgtgtgtgtgtgtgtgtatgtgtgtgtattttatttttatttttattttatttttttgagatggagtcttgctctgttgcccaggctggagtgcagtggcatgatctcggctcactgcaagctccacctccggggttcacaccattctcctgcttagcctcccaagtagctgggactacaggtgcccaccaccaagcccggctaattttttttgtatttttagtagagacggggtttcaccatgttagccaagatggtctcgatctcctgacctcgtgatccacccgtctcggcctcccaaagtgctgggattacaggcgtaagccatcgtgcccagcccatgtgtatatattgttactcttccacatatataaaaggtcatgtcactcagcttctatggtagactatttgcaaaaaatggctgcaacaaattctctcattcctcatgcatgtcctgtgcaacgtgacttggctgctcccctgacttctctactccttcaatctggagttggccatgcaacttgctttagtcacaggaatattgccagatgtgatgcaagcagttgggaagggcatgagcattgtggcttcctgggacatgggtccaccacccgagtactaggctaggctagtccaccagagggtaaagagcatgtgctgaggcccagttgtgcctgccatccgatttgaagcccagacacttaagagaatcaagagagtgcctctccttactagaagagctgcacagctgcccccacagaatcatgagaaatcataaatgtttgccactttgggccactaagttttggcatcaagtctcgattgaatcctccctatgtgtggagtactgtttcatgtgggggaatacacgtatatccatcacagtggacagaatcgtgtccccctaaaaggtaagttcaagtcctaacacccagtacccgtggatgtgaccttatttggaaataagaactttgtagatgtcatcaaattaagatgaggtcatactggattacaatgatctctaattcaatgactggttttcttataagaagaggaaaatctggacaaagacccagagaggcagacacagacccacagggagaacacggtatgatagatatgacaacagggactgagaaggcagccaccagcagccacagagagaggcgaagcagactcccaccaggagcttcagagggagaccaccgtgctcacaccttgactttagacttctggcctctagaactatggcaaaataaattcctcctgttttaggccacccaatgtgtggcactttgttacggctgtcctaggacattagtgtatattctgagagatgcagaaaaagggactgggaaaaaaataaagaggaacacagaataaagacctaaaactgtggcaggcgcctgtagtcccagctacttgggaggctgaggcaggagaatggcgtgaacccgggagacggagcttgcagtgagccgaggtggtgccactgcactccagcctgggcgacagagcaagactctgtctcaaaaaaaaaaaaaaaaagacctaaaactgagatacagaggacaggaggtgtggtgactgctggcataaagtggaaagaatttagttacatgattttcttattttggggggtctatttatggttttcctttgaacccctcaggccaactccggttttgtcatcagctgcttgcttaggcgaggatgaggggggcagcttggtttcttggggaagctgggggctaacctggctcctaaaagggcctctagcccaaaacttcacaccccaaatggtcttgtcttcctcccagtcatgacacacttggttcaagagaaatgggattctttagtgggcctgatgaagaccctcatgccctgacagatgatacatagtagcatcttaaagatgttaaggatgacttttgatttttagccctttatctgacccacaaccatttattcttgttaatagatcatcataaataaagaacgcaagtatgcttgtgacaatccttagagtacagggatccggactgcacaaggctgcctggaaggggtgtgaaatggggtagtgaggaggcacaaaaaggagagggagagaagggtagagagaagggacacatagctcctcccagcctggggcctttgctcttagtcccatcctgtctcatctcttggcattgagtctcccagtccatccaagaggattccaggttggattccacagtccccaggctctcagcctcccacgtgctccaagcctatcctgagtgcccatctcactcccaccactctccatgaccccatgcatcaggactcctccttgcccccacattctccaagcatcatggtcacctaatagccggctctgctttgaattcctcattgcccctggaatcttttcaggctggattacatctttttaagcctgaataaaaaaaccaactgaatgatctttaaagtgcacgtgactcgcttgtgcccttctgatcatggataaatacccatatccctgggggcagcctgccagctggcctgcctatctctctgtcccccagtcaaggtgcacctgcaggctaattatgcacatcaatacggcggggagtgggctgtccagactcttctgtgctgccctcagttgggttgattgctggggctggcctcggagcacttgctacgggagcatgagaaccattctggcttcagtccaggacttcaaagccagctccccatccctcctgccatcatcccatgagcctgcccctggcagcagtcattgcacagcctggggtgccagtctttgcttccctccttttccttcctcactgccgccttctatctccatcactgtcccagatgaaaatgcagccatcgccctccacacatcaaaagggggaggtgacgagaggggcattcatctttttgcctccatgaagaatcaggagctgtattggatacgtttacatttatttatttatttatttatttatttatttatttatttatttatttatttatgagacagagtcttgctctgcaaccaggctggaatgcagtggcaggatcttggctcactgcaacctccaccccccaggttcaagcaactcttcagcctcagcctcccgagtagctgggactacaggtgcatgccaccacacccagctaatttttgaaattttttttcatttttattgtttttagtagagagagacggggtttcaccacgttggccaggattgtctcaatctcttgacctcatgatctgcccaccatggcctcccaaagtgctgggattaaaggcaggagccactacgcccagccacattcacatttattgattcaattggcccttgcttcacagctgcttcaaatatttcagaattcctcctgttttttacatcatgaaactgaggctgagagggtgacgttagcttgcacaggagccacaggtcatactgagtggaatttgtgtttgattctgacctgccttaccctagagacactgtctttctatccaactgcagaggtcctgggcacaggccagtcagggagtaagaatgggccatttaacaagcattcatagccaccagcagtcactgctttgccagtttcaagcaggcaagagtcaaggaagcctcagcagctgtggcattttgccacccaggtagaggaaccttgctttcctgcaaatctctcctcctgtgatccttgactgatgcctggcttggctgtgctgtttttctgggaagttagatgttattctcatgccatatctctggctacagctcatggactgtgcctggcctccagaatcttcccctttctgcacctggcaccaagccttctaatacatccctaccttcccagctgggacagggtccccaagacacctcactgagaatcaacacgatcagtccccatagtgtgtgcatgtgacactggggagcctggagctgatgcacttacttataatcacaacattcccaaagcacaacttggagtttggctctttgccttccttcttctggaatgcaacagtcattgttgaatttctaccctcacctaaccaggcaattccttatggaaagagtcagtctggtatctgaactcagtgaatgacttcaagttaaacccaaggctgcatccatgatccttccaagtagtggactttatcatccttgagtctggctcatcacgaagatgcagttttgctaaatctaagtacagctcttatctgctccaagtctcccagctcggtacctgttatcaaatgtttttaggagagagtctgtttccttatcttttctagcttctagaatctacatgtatttcctggctcatggccccccctctattttcaaagccaacaacatagcatctctctctctctccctcccgccctccctctttttttctctcctccacccctccatctctcatcttatatttgaacacagatgtgtactacagggagaacatcatgtgatcatgaatacagacatccaccagctaaggagagaggactggaacagatctttccctcacagctctcagaaaaaaaacaaccctgttgacaccttcatcttggacttggagcctacagaactgcaagacagagcaaacttctcttgttcaagcctctcagtttgtgatgctttcttaacagccctaacaaactaatacagagagaaacgatcccaattagagagtgccctggtacgtttacttttttaaaaaagaacttatcagaagagtactttcagggatcatttctatagttcattactagagaagtttctctaaacatgtagagcatcaaaaccgcacaactacatgcaaactgaacaacctgctcctgaatgactactgggtaaataacaaaattaaggcagaaataaccaagttctttgaaacccatgagaacaaagatacagtgtaccagaatatctggaacacagctaaggcagtgtttacagggaaatgtatagcactaaatgcctacatcagaaagtgggaaagaagtaaaatcaacaccctaacatcacagttaaagaaactagagaagcaagagcaaacgaattcaaaacctagcagaagacaagaaataactaagatcagagcagaactgaaggagttagacacatgaaaacaccttcaaaaaattaatgaatccaggagctggttttttgaaaagattaacaaaatagatagaccactagatagactaataaagaagaaaagagaggagaatcaaatagacacaataaaaaaatgataaaggggatatcaccactgatcccacagaaatacaaactaccataagagaatactataaacacctctacacacataaactagaaagtctagaagaaatggacaaattcctggacacatacaccctcccaagactaaacaaggaagaagatgaatccctgaatagaccaataacaagttctgaaattgaggcagtaaatcaatagtctaccaaccaaaaaagcccaggaccagacggattcacagccaaattctaccagaggtacaaagaggagctgatactgttccttctgaaattatttcaaacaatagaaaaaaagggactcctccctaactcattttatgaggccagcatcatcctgattccaaaacctggcagagacacaacaagaaaagaaaatttcaggccgatatccctgatgaacatcgatgcaaaaatcctcagtaaaatactggcaaaccgaatccagcagcacatcaaaaagcttatccaccatgatcaagtcagcttcatccctgggatgcaaggcagattcaacatacacaaatcaataaacagaaccaatgacaaaaaatacatgattatctcaacagatgcagaaaaggactgataaaattcaaaacaccttcatgctaaaaactctcaataaactaggtcttgatggaacatatctcaaaataataagagctgtttatgacaaacccatagccaatatcatactgaatgggcaaaagctggaagcgttccctttgaaaactggcacaagacaaggatgccctctctcaccactgctattcaacatagcattggaagttctggccagagcaatcaagcaagagaaataaataaagggcattcaaataggaagagaggaagtcagattgtctctgtgtgcagacgacatgattgtatatttagaaaaccccatcatctcagccctaaaactccttaagctgataaacaacttcaacaaagtctcaggatacaaaatcaatgtgtaaaaatcacaagcactcctatacaccaataatagacaagcagagaactaaatcatgagtgaactcccattcacaattgctacaaagagaataaaatacctggaattacaacttacaagggatgcgataagacctcttcaaggagaactacaaaccactgctcaaagaaaaaagaggggacacaaacaaatggaaaaacattccatgctcatggataggaagaatcaatattatgaaaatggcaatactgcccaaaataatttatagattaaatgctattctcatcaagctaacattgactttcttcacagaactagagaaaactactttaaatttcatacggaatcaaaaaagagcctgtgtagccaagacaactctaaacaaaaagaacaaagctggaggcatcatgctacctgccttcaaaatatactacaagtctaccataaccaaaacagcatggttctggtatcaaaacagatatatagaccaatggaacagaacagaggcctcagaaataacagcacacatctacaaccatctgatctttggaaaacgtgacaagaacaagcaatggggaaaggattccctatttaataaatggtgctgggaaaactggctagccatatgcagaaaactgaaactggactccttccttaaaccttatataaaaattaactcaagatggattaaagacttacatgtaaaacctaaaaccataaaaaccctaaaagaaaacctaggcaatatcattcaggacattggcatgggcaaagacttcatgagtaaaacaccaaaagcaatggcaacaaaagccaaaattgacaaatggaatctaattaactaaagagcttcagctcagcaaaagaaactattatcagagtgaacaggcaacctacagaatgggagaaattttttgcaatctacccatccgacaaagggctaatatccaggatctacagggaacttaaacaaatttacaagaaaaaaacaaacaactccatcaaaaagtgggtcaagtatattagcagacacttctcaaaagaagatatttatgccgccaaaaaaaaaaaaaaatgaaaaaaagctcatcatcactggtcattagagaaatgcaaatcaaaatcacaatgagataccatctcaagccagttagaatggtgatcattaagaagtctggaaacaacagacgctggtgaggatgcagagaaataggaacactttcacactgttggtgggagtgtaaattagttcaaccattatggaagacagtgtggcgattcctcaaggatctagaaccagaaacaccatttgacccagcaatcccattactgggtatatacccaaaggattagaaatcattctactataaagacacatgcacatgtatgtttattgctgcattatttacaatagcaaagacttggaaccaacccaaatacccatcaatgatagactggataaagaaaatatggcacatatacaccatggaatactatgcagccataaaaatgaatgagttcatgtcctttgcaaggtcatggatgaagctggaaaccatcatcctcagcaaactaacacaggaacagaaaaccaaacaccacatgttctcactcacaagtgggagttgaacaatgagaacacaggggcacagagaggggaacatcacacaccggggcctgtcagggggtggagggcaaggagagggagagcattaggaaaaatgcccaatgcatgcagggcttaaaaccgagatgggttgataggtgcagcaaaccaccatggcacatgtgtacctatgtaacaaacctgcacattctgcacatgtatcacagaaaaaaaaaaaaagaacttgtcagaaagttctgtggaaccaaaagtacttactataattgttggtttggagaggcagaggaagtaggagagggtgctgagggcatactttcctaaccaatgtcattgccatgaagatttctgaggtctctggctccttcttccatgcccaattccttgcgcagagcaacttggaggcaaatcatgaaggcactgcctggcccagcccctggccctggaggaggcacttcctcctcctcctctgcttccgtggggccttttggtctccatcatgtcagacttagcacttcctccagctcagcatctaacgtgggtgatttgcacctttattatgaattgtttattctctggggtatctatgaccacagtgtgcaagtgatatttccattcaaggaccaaagaaaaaaaatttttttaaactttgtttcctgagagacacattccaggcatcatagaagcaatgggggagggatggggacacagagagtcattgcaggtaggctatgaccccgggaagaacatccttcacacctggtaacatttgtgagaaggtgtttcctccagaaaaaattagttcagggacattttgctagtaagaggccaattatctgtttgaggccaccaacagaatggttgtttaatttctataaccaaagctgacgtctcattgcatgatcagcgatcagtgcctgttatcaacagccgcaaagggtcttactctagggctccgatgcccgctccagatcccctgaattctcatctcacatgtggctggtcagctgcaggagaacgaggagctgacctccgccctgtgctgctgatgggaatggcatttccccaccctgtgcagctctggcagcctccctcttacccctgctatcacagccgcggaggcaggcagggagctcgtgacagctggcaagccagcctctgggaataaaacattttagcacttcataaatttctaacaaggtttcaaattgcggccgtttccctcctctcagctccgtcaactagcaaaaggggttgggggtgggggaagaaagactaattaaatctacggtgggaaagcactgctggtaagattgctacttattaaaaatcatgaactgttaggacccgattacaaagtaagttgaaattctccccattttccccatacataaaaatataaaacagagcctttcaattttatatgtatttggtatgtgtgtatatatatatatattttcaaaggattaaatacatatccttaacaggatagctgatatatgacattcttaaacctaagggaagatgacacataactaactaaaatgctgagagacattcaatatcaatactgaacattaacattgaggcttggtatcatttacaaagtagttatttcacattcttttcccctgggagttttactgaaagaaaatgcttgctagaagagcatcagatggagaaaacacagcctggaaagcctcacccaactgacagcttccaagttccaagttttggtcaccatcactaatgtttttaaaaagacaaaacaacaattccaaaaaaaaaaaaaaaaaaacaactttttttttttttttgaggcagggtctctttctgttgttcagtctggagtgcagtggtgcaatctcagctcactgcaacctccgcctcccaggttcaagtgattctcctgcctcagcttcccaagtagctggaattacaggtgcatgccaccatgcctaatttttatatttttagtaaagacggggtttcaccatgttggccaggctgatctcgaactcctgacctcaggtgatccacccgccttggcctcccaaagtggtgggattacaggcatgagccaccgtgtccagccaaaaaacctttcttaatttcatggttctttgttttaaaagaagggtacttgctttacaggaaatacgtaagccttatgggtaggggaaatgtggaacagggaacaaaaaaactaattcacaaagacgtttaattgtcaactaaaacatgttaggagcactgtgggaggggtgtgtttggaaaaataaggggtaagattttaaatagtttcactctgagaaaaccagcattccttttcctactagagtaagtaagcagggttgccttcttcaggtagtgggtctcacatgaaaaaatttcaatctgaaataagggtcgtagaattggtgacgtgagaattgggcaaaactagggcacagacagatcctggcagtaacttcgggcccacatcactttgggcaaaacacacagacaagcacgaagcaggtacaggacaaccaccagctgctgcactgagcattctctgcgctccctgcaccttcgcctgatgcccattttcttttttagcgtgagaaagttgacctttaggatgacatacaaaataagcttctccagctaggatgggaggcaaaatgcaaagaccatgtgtgctatttatgtttgagaatgaaccttcctgcaaagtatcagcctgtcgtatatttagaacagagaccccagggtgggagcatctcatggcagctcccaattgaatgccagatgcaaatgatcacttgctattaatcccagccttgctaacatttggtcctgagcatcacagctaattgacgggatgaattaccatttctacggatggtgccacctgtgacattcaggatctttgagaggtagaacccgcagtagtttaacattgccagtttagtcagttatgatcattgatacatggctcaccattttctctctttctctctctccctgtgtgtgtgtgcgtgtgtgcatgttacatggtttcactatgagatatacagcattttattttgtctacatatgcaaatgttcagtgacagggacaaaaagaaaaaaaatcaagaataatgaatgtgattaagtggaaaactacttataaaacactctaaagttgactaatataggcaaacactgttaaagtcgattttagggaatcatccaggtatttcacatagcataggctataacttcattaaagaaaacatggtcacccctgcctgaactgcacccagattgcaccccagtggctctgagccaggacaggtggccagtcaccccctgcctgaattgcacccagatggcaccccagtggctctgagccaagacaggtggccttcccacctgcctcattaccttacggtgacacccctccccccacccccaccctgaggggctgcagtgtgataattctgggaagagcttcagaacctatctgtcctgcatgctaatccaagtttccaagtgattttatgtgcattttctcatccagtgctcccaacaattacagcttgtctttcactaaccgaaagcattcttctctatccctcccagtaattcctgcagggcataacctgtgaggaaaagattagagatggctaatattttgggtataatgaacgaagccagcttcagtttattttcattaaacacaattcccatttccaggtgtttgttagttttggtgaacatcacaggatggcctttccccggtaagtgcagcaatccatctgttgtaaggagcacctctgcactcagacctcctgatgtggaagtgcttcaaggtaaaagcaggcttcccaaagcttgcgttgattgtaattgtagtgaaagttagaaacaaaagccagtagttactgagaacagaagttgagcaccagacctcggatatagcataggggtatggaagatcttatagaacaagaggaaaaaacaaggcattttctttgaaaaggaaggtggaggcccaattgagacaggctgaaattcacccaagaggggagattatcaaagagatgcatattgaagacgtcctttgatgtcagggtgaagtagtatggtgactaaaatattagaactatctctagagggcagctggggatgtctgctcctattaatccactagagtctagacctgaaaggctcatgggggcccttccccaaccctctgctctcacttcccaaggctataagtggccatgatctgtgctgaatccccactgcagggaacattccagaacaaggattgacacttacatctctgtgatacactacttgttctctcatattcttgatagttggtcctgagccaagtattctagcaaagatggtgcagcacagaaaattctcaggtttcattttccatttagggaatgtgggagctctggtcagagacccacagatgaccccaacctcaaagctggccagctgtgctgcacccatggggagaaggagatgaggcctgcatgctgtggcagacacaggtgggtggagaagtagatgaggcctgcatgctgtggtggacacaggtgggtattgtcagcatcctgctgtcttcacagtgagagccctttcagagagtcccaaatccaagccagcctccttcaaccatccctggagaggtggatctcatagcatctgccaagagtcttgtgcttaactgtgtatcacgacagactctttccctgaccagactttaggcaggcccctctctaagctcttctcaactaagccctgactttggagcattttttcttgtctctgccttctccagttttagcaagaatcctgcttagtttggctatcctgggtatctgatcaccctaactatctgatcaggtttctccttcaccaacccccaggtggttgtctgatcaccctggtctgtgttcagcaagagtcatgttcaggtgatgtagccagaatgccccttacccttgatgtctcctgtaaataatattccatccactgatccccacctcactacctggctataaactcccatttgttttttgtatttggaattgtgcccaatctctctcgcccacttcaaaatgcaattgcagggtctctatggctctgaataaagtctgccttactgccttatcaaaggtcatttttttttctttaacaataacactgaactcttccccgaggttaaaccaaggaacattctcaaaattatatccaattatcttcctaaaaacaaaagggagttgctgtataactggtcttcatttcttccctagacaaaacaaaaagtagacttgaacatttcttaaaagactggtctccttaaattcttttagtttctcttcatttttatcaaaatataaaaaccaaattcagaatcagtttctcaacttttcaatattttctttctctattggcatctcagcatcaaagtattaaagtagtgccgtgagactcacacctccaatggctaggaaattggccagcttaggcaccaatactgcacccaagtctggaactgtagaatacagtgatgatcttgtattgactttgaaactcatctgtaagagttattcgagttttttccatggaaaaagaatgcaatattgtcaaaattgctgataacggccaagtcagggctcacagcccttaccgtctttcagaacagttgggggtgtagaaaaagaaactacagctaacactcagcacctgcaaatggccaggtgcagctctaaaccttatttgtgtgaaaactcacttaattgtcacaacaaccctacaggaggcgaatgttattatgggatccccatcttccagatgaaaaaaactgaggcacagaaaggttagttaggcagccctaaccatgtggctggtaagaagaacagagcttcaaagcctgagatagtcataacctagctaggaaaactttttagttgttactaaacagatgcagaggcatattgaaagtaaaagtaaaatgcaaaaacagaagaggtagaaagggtgccaaggtgagaagttggcagtcttttcttctggaaacttccaggagatttagaatgaaagaaagaaagcagccaaggggatcatggtaaacacgaggcagcctggacatggcatagcacccccaggctgccggactccagggcatgcccaagggtagctgcagagtcaaactaaaccaagaaacagagttgggcagtgtaaagagctgtaggcttcacgcagtgggagacaggccacccagcccacatgagggacagaaagccacttaagggcacgagctttcattagcatagaaccatgctgcccattttaccaggtattttcattgagcaggccatgggctgggtgtcctataaggcaggcctgggttcctcttcaggctgctgtcataacgcagttctgagctgcaatgattgaaacggatggaggagggagtattgggaataaacaagagtgaaggtcatctcaaagcaccttttacatttttcccgaaaggtggagttttgaaagcagaaccccttgaaaatgtgttcttgtgcatgctattccttcagactgtgagcaatttctcctctccgcacctacacgggggaaggcttccggaccaggtttctgcaaagagcacttgcgtggttcataaaagcaacaccggaactcactcactctgccttctccatccctctgggcatggctcatttccatcttaactgcatctctaagtaaatcaagagccagcgaaaggaagtatgaagatatagtggggaaccttgaacaattccttttttactcccaattactttaggtaaaactctgaatccaacttgttttatttgtgatgctattgttacagcctcaaaacctgttttgacttggaaaggcattccaaataggtacactgggaactcaacctaaaatagccagttaattttacacgcacattttattttcagggaacgtgcgtatgtcgcatacaatgaagaggggaaaatggagactggagtttatgatgtaatctttatgcgaattttattatttcataaaatgtgaatacgttcatgggaaagaggccatgaaacatattcacttttgctacacatgctgataacttcaaagtcaggtggacgggaattgacacagaattttcataataagggctgataaaatgtgctattgtgtcaacacatacttctagcttctgtttttaaatgttttgctagtaataggtttaaaaagtgatttgtttctgtttttttctttttgagatggagatttgctcttttcccccaggctggagtgcaatggtgtgatcttggttcattgctacctccacctcctgggtgcaagcgattttcctgcctcagcttcctgagtagctgggattacaggcacccgtcaccgtgcctggctaatttttgcacttttaatagagacggggtttcaccatgttggccaggctggtctcgaactcccgacctcaggtgatccactcatcttggcctcccaaagtgctgggattataggcataagccactgtgcccagcctgatttaatggttattgcctatctctttcctctcagttataggcatgtcagacctgtgtcctatacctcctgctgcgggtggctctgcatagagctcaggcagttttaggaactgtcttagttccctcagcaggagccctgcccatgtccaactgcctgtcttggtttggtggcctccccagccaaattccctcttcctctctgtatcatacaacctcccccttcccaaatacagataactgccggaatggtgggcatctgctgtgctgtgcaacgtggttccctttgtgggtgttactcacgcaaatcacgtcctctcgtggctgccaccattatggaccagggcccgtaacaaattccataacttcacaggatttgccttaagaaataacgattgccataatcgccgcggtggtggaccctgtcccggagagctgtcttctgtcaaataaaaagcagctcctgctggaggcattgctcactcccagcagcccacagtcagtaactggctgacctaggggtcaaagcattggccctattgccacaggtggatcatatccctgcagggcgctctgtgcgccagagccagcctgtgaggtcagacagaggccagtccccagctgaaaccacatccctgacttacgcagctccccacctaacccttgttcaaccaatccttcatcagtccctcgcacgagaacccccttctcaggttctacttctaggaaacccagctgtttacatttctgagggctgccataacaaacttccacatgtctggttgctttaaacaatagaaatttggtccaaaattgagatgtaggcagtgttaattcccatgcctctcttagcttctggtatctgccagcaatctttggcatactttggcttgtagacacacaactccaatttctacctccgtcttcacatggccttcttctccctgtgtcttcatgtctaaatttccatctcctctctcttagaaggacaccagtccttggatttagggcttatagtaagtccaggctgatctcatctccagatcctaacttaattacatctgcaaatactctatttcaaaataaggtcagattctgaggtaccaggagaacacgaatgtttgggaaacactgttcaacccactacaccaacctaacacatttcagcaaagtgcctacaagccaaggtaagtaagcaaaagaaagcacaggcccctgattttccctctgatgccatagaaaggcatttgggccaagacactgtggtgggcaggcagtgtggctgtgaattctaggggaagttcccctctgctaggctgcctgccctttaaacaaggcaagtgtgagagcaatcttgtaagtaagggaataatccagctaccggggcaccaggcaggatgaatttagatgtcagctgtttgaagcaactgtttggaaagtccagatccccagaatacggaagccttgaagacacagtagaagctgggttcagatgcatcccccctaccctgaaaaaggaagatattggtcccatgggaagctgaaattgggttgaggcttccccactgggaacaaggggaagtgctagctgagatgctgtccaacaaccagaagggagcttccagagcactttaagacaacagtgctttgcacaccacatcatacaggacaggcggcctgtgacttagttactatgagagttctgccctaagaccaatcttttttctctctctctgagattttaataaaagatgtagagtgaaagagcatagaagtgatagaggggaagaacaagcataattcatagtggaaagtgatgtgagagagacatagacagaggctggtgtgctgggaatcaaactgagtgaagttaatggtcaggtgaagctccgtgggttgtacatgaaggagcaatggaacagcatgggctccagactgcctgggagctcaaacagccttccaggctccactttcggaaaggtacacatgagtgacagttcctttccttctttgttgcctggccatgtggttgatgatcctagcatcttcgtttctaaatgtgtctcataacctgcagagacatgagtcagtcttattccagttcatctaaatgaaccaacaaaatgtctcataaaaatatgaagataaaattaatctgaatatgtgaaactatattaaaaagcctaaagttctgtacaaatggaacacattattagacataaataagtcatgttcatactggaagccacattcatcatcacttagttctatcacttacttcatcatcacttacttctatctcggtgagtctgagattcagcttaaacatcttaccatgatcatggaacagattcaacaaagatctcctgaatatcctcaaaaaatagcataagataaaccatccaaggtcctttactgctattattcatctctcattcagttatgcattcattcactacatggagactaaggaatgaaaatgagcaaaattattatgtaataattatataacatataattataatttttacaaaataattttgctcattttcaaacccaatctgaccccttgttgggtttgtatcataatcccaaaagacacaatcacaaatgccatgatcccaaaaattgaaatcctgaaagattgaaatccctaaagaccaaaaatctcaaagttcaaatccctaaagcctaaaatccctaatatctaaaatcttgaaaatcactatcagaaaatagttgcatcatgttaggcagatctagccatcttgttattaagcatggtttaaggcgaggaatatgggtgccaagttacccacgttgaccagtagtgacttaatgtggtcaccagtggacttaatgttaggtgttaacttgattaagaactgaaggaatacctagaaacctggtaaagtattattttgagtgtgtctgtgagggtatttccagaagaggttaccgtatgaatctgggtggactaagtgaggaagatttgccttccatgttgtcaggtgcaccatccaattcgctgggcaccaggaaagaacaaatacagaaggcaaattggaaaaagctgtcagcaacaaaagcttacaacggattctgaggcacagatccctctctctgagagctgggacagatgtttcttctgctgccttggacatcagaactctaggttcgccaacctttggactctaggaacttacaccagcagctcccaggatcctgaggttttcaaccttggactgagagacacatcgtcggcatccctggttctcaaagtataaacattggaacttcctcaataaatgaagagatgtcctttttgtacatttgtatctgtgaaagatgcaatttctggagatcttggttctttgggcgattgcaaatgcggtggcgaacctttgcagttttgattgactcgtcaaaagactaaggttgttcatcatggtatttcagacgactgtagttagaaagctgggtgcacacaataaccaaccatagtgatgtgaatttatacatttccctttttagcctgtttctttatgaatatgtgctgtctgttcctaactgttatgctcatgtgactatcattagtatacctgagtgtttatgcttgcaaaaatatttatgttattattgcttattttattgtgtaaagtggcctatcatgtttctcgatgatgtttttatgtttttccaataaatccccctttaaaaatataaataaatacctctaatataattttttatattatttcttccagaattataatttggggatttgatctttcagtgttgttattttcaggattttagactttgcaaattttgactttctaggatttcaacattcaagattatggtgttctaggtactgtgtctttcaggattatgatcagctgcccacttctatttgcggatgagacagatttaatcaaatagtcatagaaatgaaagaaaaatcacaactttgataagtactacaaagaagatctctgatgctctgagataatacaagagggtaaattgatctattaggaggttgcagttgtggagcaggggttgtgagggccagaggaaggagaaaggccctgcagacagagagcatatgatgtgtgcacatcccttagacaggaggagtcattgtggactagcagaagagaaaagagcacagaaagccagatggagcatgatttaaggtgaaggtggaaattctctggggagaaggctgttcagggccttggggaccaacgtaaggatcctggtctttgttctatgagcaatgggcagcaaggagcatatttcaagcaagagattaatataatgagagtgttcttcttaaaaaattacatgtggcttttaattcaagatggtagaatgagctattgatattccctttaagcttccttaaaataagagtaatgagctaagaaaagagggaaaatcattatggcaaagaaaacaggaaaagctgtcagcaaccaaaagatgtcagcagattctgaagcaccgatctctctcactatatcttagtctgctggactgctttcacaaaaataccatagactggatgacttataaacaacatgtatttctcacagttctggaggccaagaagtctaagatcaaggcactggcaggttcagtgtctggtgagggttcattgctcatagttggcgccttcatgctgtgtccctagatgatggaaggggccaatgagctcccttgggcttcttttataagggctcgaattccactgatgagagctccacacttatgacctaatcacctctcaaagactgcaccttttactaccatcacattggggattaggttacaacatataaatttggtgggagccgaaaaccttcagacaacagcacatcataaagcaacaaagactattccataacccttgcccacttatataagtttccttcctatctgctcaatctttaatataaatggaaatcaacagccatcagatattcaaggaatgcttgcatcatgaaggaggaagaccaaggcaacaaatataaaaatacaaacgttggatgaaacacaattcagaaaacgggagaaaacgaaaataatcatcatcatcatcattaagaattccaggagataatctatttgtaagacaaaaatagaattgtgatgaagaatgtgaaagagacactaagataaataaaatacagaatgagaagactaaatagataactaactggaatctcaggaatataaaagaaaatcattaaaaagatacaatttttagaactatcagaaaatatgtattaaaaatcccaaaagtacaatatactgagataaataaaatcagaatatataaaaagaaatttgtgtccaaacacactttgacaaaattacagaacatcaaaaacaaagaggagatcttaaatgaagccatagagcaaggacaaacagcctacaaaaaggaaacaatttaaatgacttcagactttccaacagcactaatgaaagctagaagataatgatattttacctccaaagtacaaagggaaaatatatagtcagtacagaattgtgtgcccagccaaatactcttttatgaaaaagataaaacaaggatgggtaaagataacaaaaactgagagggtatgccacaaagaaacctgaaataaagaaaattctaaaggatatgcttcaagaaaaaggaacacgaccttaaaaagatggtttgggatccaagtaagaatgaacaaatgaaattataaaacagtaagcaaatccaaagaaataacatctgaataagctaataataaaataatacctagtatctgggttaaaaaaaaataaatatatagaagtagagaaaacaacaggagcatgtaagttttgtttgattgtttctttgtttttgagacggagtcctgctctgtcacccagccaccgtgcctggcccagaagcatgtaggttttgaggtgagtgttcagaatcaaaatgctccaaaacctgcttttgttttttgtttgcttttcatggaagaaggtgcttaggttattgcttaattgcagacttttgctaatttaaatgtacatggtaaatttccaaggtaacatctaaataaatggaaatagaatatatacattctaagtaagtacagtaaaagtaaaaaagaaaaacttattaaacaaagaaagaaggatgtataaggatgataaagtgtgacaaatagaagtcaaaagtaaggtgtgaaaagaagttcagtatatcaaaaatcataaagaatgtgggccgggcatggtggctcatgcctgtaatcccagcactttgggaggccaaggagggtggatcatctgaggtcgggggtttgagaccaacctgaccaaaatggagaaaacccatctctactaaaaatgcaaaattatccaggcatgatggtgcatgcctgtaatcccagctactcggtaggctgaggcaggagaatcacttgaattcgggaggcagaggttgcggtgagctgacatcgtgccattgcactccagcctgggcaacaagagcgaaactccatctcaaaaacagaaaaaaaaaaaaaaaaaaaaaaaaaaagagtgtgagtagactaaacttgtgtttgaataatcctgcccatggaagggctcagaaaagatggaatagctaactattgttttctactatattagacttttgactttttaaccttgatcattttggtgtatttttaaaaatgggaatgaaaggtattttgggctgaagtatgaaagaaggagagtagagagaggcaagacgggctattaggatgttattaccatagcctgactgactgatgataaacacacttaaactttttaaaaacttcctcaatcatttcatggaatggattctgacgaagagaaattttggttcagacgtcagtattaatttttaatatgtattgccaaatttatctgaaggaagtttatacccttcaatgctgttacacatttataacattttcttgtaaaagtactcattgcatgcgtatcaaattcaggcactattccagtttacaatagggaataagagaggcgaagctgctgtcctcatggatctgccattccagtggggaaaggtgaggaagacaaatggtataaaaagcaaatcaataaataattttatatgataaaaagttaagaggaaaataaaataggtgagttgatgggaggtgacttcagaatacatagtaagtgaaggacccttagccaggacttgagtgacctggagggacagccgggcctggcaaagggatggcagtgtaaagagcctgaagtggaattacctgggtatcaccaaggaatagaaaaatgcccatgtggccactgcatagtgagcagagggctgggtggggtaaggaaggtgtgcagagaccagatggtaaggagcttgggttttctttaaaaaagacaactaagatttatatatacagctatatccatgggaaggaaaaaacagacacctgatgtacagatcaaattcagaagtgtgtcctcattcacaccatgtaggaatctcacctttacaagcagagttaggagcctagggctttctacatgcatcttctcaattataacaatcgcagatgtagatgtcatcgtctccatttgaatgtcaaggaagcagagccagacaagtcacactgcttgtaaatagcagaatctggccttaaatgcaagttgtgctgaagcacgtgttctttccaaacaaagttccagagcccatgttctttctatcagaagctaagggaccacccacctgcatactggcatgatgaggctctagaaactgacatgcaacctcttggccacctaaactttgtaaaggtgacttgggtttcagtattttacttaccatttataattttgtgcctcacctatttccaaatataaacgtgtgtgtgtgtgtgtgtgtgtgtgtatatatatatatatatatatatatctcctgttatcctatttatgaactaaaaatattataagaaacttgaaaagtcaagtgtgtggagtgttaccggctgaaatgtgtccccacaaaattcatgtgttgaatttctaatccccagttgctcagaatgtgactgtgtttggagatagggtctttaaaggggtatttaaggtaaaacgaagtcatatgggtgggtcctgttccaatctgactggtgtccttacaaaaagaagagatgaggatgcaggaacatgtagaggggtgggcctataaagacacacagagaatggcctcaggagagtccagcttcgctgacaccttggtctcagaaatccagcttccaggtttgtgagaaaataaatttctgttgttgaagccactagtctgaagtactttgttatgggaccctagcagactagtacttgaattgtttatgtacactaaatatggtataatactagaatatttctgtggccatatttcaggcgattgatgtagttaaattccacaaaatcaaaacaagatgtttaacatgtatctcttgaattattaatagtaacatttttttttttcttgagacggagtcccaccctgtcacccaggctggagtgcagtggcacaatcttggctcactgtaacctccacctccggggttcaagcaattctcccacctcagcctccagagtagctgggattacaggagcgtgccaccatgcccgggtaattttttaacatctctactaaaaatagtagagatggggtttcaccatgttggccaggctggtctcaaactcctggcctcaagtgatctgcccaccttggcctccccaagtgctgggattacaagcatgagccaccgtgcctggcccattttgtacattttaaattttatcatgtgtttactttccagcatatagaacggcagaacatcagattagtaaatagcattcattactgcaatcactcttccaatgtacatacaattgactctctgaacaatgcggatttcaagtacacaagtccacttagacacagatttgttttcaaccacacgtagcttgataatgcagtatttgagggatggaaaactgaagtatacaacctttttttatatgcaggttatatagggctgacttctgaacttgagtatgcctggattttggtatacttgggggtcccgaaaccaatcccccacacatacagagagatgaatgtactaagctcacgctgtgagctaattaacttttctttgcatttccatagaaaccaccccaacccaggccattattgcttctcaacagacctcagctatgtcctacttacattctgtagccaaactgcactaggtttcatcattaaatggtcaagctactgcatcttcttcccattttcctctactttaaataccttctcttggctgggcgcggtggctcacgcctgtaatcccagcactttgggaggccgaggtgggcggatcacgaggtcaagagatcgagaccatcctggctaacacgatgaaaccccatctctactaaaaatacaaaaaaaaaaaaaaaaaagaaaaaaaaaattagccaggcgcaatggcgggcgcctgcagtaccaactactcgggaggctgaggcaggagaatggcgtgaacccgggaggcggagcttgcagtgagccgagatcacgccactgcactccagcctgggcgacagagcgagactccatctcaaaaacaaaaaacaacaaaaaaaaaaaccttctcttctagtcctgccagaaattaagccccactctccaagcccaactccaatggtatcacgtccagcaactatttcctaaccaactgaccataagtggcctctgcctttcttaacttctattttactttgaatcggtaatgggctttcattttaattattagcctaagcatcttagttttcatcctaaattacaaacttctcacagaaaggaagtgtggcttgtgagttttaaaattacctcctggttgggcgcagtggctcaagcctgaaatcccagcatgttgggaggccgaggcgggaggatcgcttgagcccagaagtttgagactagtctgggcaatgcggtgaagtcccatctctacaaagaatgcaaaaaattagccagggcatggtggcatgcacctgtagactcagctactcgggaagctgaagtggaaggatcatttgagtacaggaggttgaggttgcagggaggcatgatcacaccactgcactccagcctggtccatagagtgagaccctgtctaaaaaataaataaatataaaataaataaaaaaaaatcactttctgctttgtacatagctgggattcagtctgtacttattaaataaataagtgtcatattaagaattgcttctccgtaatgcaagtgaccttccacttatttttgtatggtaaattttagttgagaattcaggtgggtcacactttaacatgactgccctgaggcggatcacatagggattacatcatctaccttcatgaaacataggagggaaattcagattatggagcttatgtcctgaacctgccaggggaggttgctggtggtatttattggtatttttcttcatccttgagacaaacaatgcaaccaaattctttacagaaaagagagaagggagagtgtaaaagtggacattggataacacctaattcaataacaacattccgaagaaggagtcagacattgctgagactgttacatagcagcattagcaggttacagttctcactccaggaaggtaatttaccctaaggctggcactgatttacaatagatgaggtgcgggcacagctcttcagtgttgaccagcaccggcacatgggattgcagcaataacctgtgtaacacagacagcaataccaaaccgtgcacttggaagccagggatggggagaaattgatgtggaatgtgtagctttaaacctgctactatctgcatgtgtgtgtacgtgtgtgtgcgtgtgtgtgtgtgcatgcatacatgtatgtgtgtcaaaaatagcaagaaaccactaaaaggcctcagttccacttttggagaaaagccattctttaaaaggactttaattgggaaagtaatatctgctgcgggtgacacaggaaaggcatctgtggagtcacgtgacacataaagaggaaaaggcccacacctctcaaaaatcactgcaaagaatcccgagcaatggagtggacagcaccagtgtggtggaactcttggaagacgctttcaacttgtcacatgtaaaactgcattaaaatgtctttcatatgtccatgagcactgcattgttgaaggcaaatgactgtgatgctttaaggatgcccaatttgaagaatccattgcttcctaaagaactctggggagcatagctcaaagtagcctaaaaaatcgcattcttctctttcttcacatacagacctttaaaaaattggaaaggtcaaatttgcttctgtatataatctaataggtatgcaatatttttggagaaaagaaaatattttaaaagaaaattttcttttaaaacaaatttataaaataactcatcttttattattttatttataaatatatacaaaaatatataaatatttttatatatttataactatttattattcattttattagagaatatacaaaaacatgtgatatggttctgctctgtgtccccacccaaatctcaccttgaattgtaataatccccatgtgttatgggagaaacccagtgggaggtaattgaatcatgggggcggtttcccctatactgttctcatggtggtgaataagtcttacaagatctcatggttttataaggggttacccctttcgctaggctctgattctttcttgtctgctgccgtgtaaggcgtgcctttcaccttccaccatgattgtgaggcctccccagccacatggaactatgagtctattaaacctcttttttcttataaactacccagtctcaggtatgtctttatcagcagtgtgaaaacggactaatacaacgtgctttggattaacatacagaaacaagtcaacatttattagaatctcctttgcacaaatatatttgcaatgggccgaatatctgtgcctccccaaagttcattgttgatatcctaacccccaatgtgatgttattcagagatggagcctttgggaggtgattaattcatggaagccctcaggaatgggattagtaccctgatagaattgactccagagagtgctcttgtttcctttccactgtgagaaaatacagggaggagatgaccatctacgaaccaggaagcaggccctaaccagatgccgaaccttctgctgctttaatgttagactttcagcctccagtactgtggggggagaatgttggtttttgagaagcacacaggtgtgacattctgttatagtagcccaagtgaactgagacaatattcattctaaacaaagctgaattatggcctattttattcatttgattttttatatccatttaaaatataccatttagtcttctaattcataaagtctaaatgcacagaaagataacttccaagtcaactcgatgattctgcactaaaagctttttagaagtagagaccaatacaaataaaatggaaataaatttagatgtgggcaaaacaatttgcattgagccacaaacataaactatctttggtgagatttaaagctatgaacctgcaccacactgatgagcaaatctgtgagaaatctcatttgaggacctcctcagttgattgtctattatcctccaggagctgtgataacactaataagaaaatactcccttgtagagagcttcaggagctgtaagagaaattattcaatccatccttgtacccttccttgagctcactgtggaattactctgatggaaaactgcctttgtggtcccaccatggaaaaggtgctcctgaagtttcctaaaataagggcaggaaggcctcactggccaatacacttatcaggagaatagcagtacagacttttaacaaaaaatagagagtactttcaataaataaagcataaaagtaaggctttcgtatgctgcctaaatcctaatcttgtacatatctttcagttaccacagtatggcttcccgccaacctctgggatgtggcatgtaatgggactcccaggatgaaaagactcggtgtcctgtcgttcattcattcatttattcattcattcagtcatttaatatgtatgtatctgtctatgctatgccaagaaaagccatgggcattgggatagagcagtgaggaaaccaacacatctgcctcctcagagaatttacagtccagaagggtagagacagacccacataaaatggtagactactagtttctttcctttccacatactcccatcatcattttccattgagatggtattttttccctaatgctgatatgcaattatctcatctaaaagaaatcatctggccggacacagtggctcatgcctgtaatcccagcactttgggaggccgaggtgggcagatcacctgaggtcaggagttccaggccagcctgaccaacatggagaaaccctgtctctaccaaaaatacaaaattagccaggcatggtggtgggcacctgtaatcccagctacttgggaggctgaggcaggagaattgcttgaacctgggaggcggaggttgtggtgagctgagatcgtgccattgtactccagcctgggcaacaagagcgaaactcagtctcaaaacaaaacaaagaaagaaggaaggaaggaaggaaagaaagaaaaaaaggaaggaaggaaggaagaaagaaagagggagaaagaaaggaagaaaggaagaaagagaaagaaagaaatcatccacatataaacttcagacatgcaggtaccatagtcacgggctcccagtccttgctacctataatgaggtccacgaaccagcagcatcagcagcacacgggagctttttagaaacagtcttgagcccacctggacctaatcaatcagaatcttcagtttaacgagacacccaggagacttgaagggacactgaattttgagaagtagtgcacttagatgttttctcaaaaggtgctgcaggggacatggcatcttcatgctaagtgaaaaagccagacctttggtcaaatagagtgagaaactgctggttaaggcaagtcagtgacttcttcaccttgggattcgtcagagttccttatgtctattttaaatacccaagagaaagaaaccaatactaatcataataatggtcgtaatcactaatatttatagtttagttactataggctaccactaaaattgcttaaatatgatatggatatggaatcctgtttaatcatcagtcagtccccaaaatttggtgttattattcttatttttcatattacgaatctgaaactcagagaggctaagttactttcccaggatgacacagtttgcaaacttgccaactgggaacccagccctgcctgattccaaagcccaagggctcgatttgaaacgtatggcaattttctaaatacattgaatcattgaacatggacacagcttttttctattttgcaaagaccacctaggactagtccatgaaatacaggctgggaaagtatttcacagaaacacatttgccaccatgtggcaggtccctactcaggggcagaaacaccctcaaaagtgatgtcaatcttaaatgtgcgggcttgcatactagccactcagaagagcacaaaacaatttaaggttttttcccagacctgagatatcaattacatcttgccgaatgatgtgtcctaactggcatgccactatcagatttaagataaaaatcacatgtggcctagtctagacacactggacttctgtaatctcttctcattgtcactaaacagctggtacaaatgaatctaccacttcctcatatcaggcccctgacttaatgtctcaccccatttctcaagaaaagatgcacgtccctcataatgtcaaaacgattgggttatcttgcattgtttacaattgaacagtggttcatcttagcagtcatggtttatttatactcacttttattcatccattccactcatatatattgagttcctactttgtgctaagaagcagttcggtgtaataccaggcccttcacttttacaatcatgaagtcaattaattataagctcaacccataattaatatactcttagtaaaggcaaccattataagtacattctgatacaacattctatccatgtataaacttaagagagtataaggatcagaattcgaggtcagacccacaaaatacagggaaaaaatgacactatgacattaatcttctccactcctcccccaattgtatactgaggaaatgagttcaaataatcattaatagcaaacctgaagtagtaaaagagaccacagaaaaacagacactatgatagataaagaggattgaaggcatctgctgggtgtcaaagtttgccccaggttaaggatgtttctctgacctacaaaaagcttggactgtctgtggaacatccaagcaaatcaacaccagaataaaacatgctgtccactttcctcgccctcttccaagaattacttcattattcccaataaactaaatgcatttagttctgaaatgaatgcatgttattcaataagaaaacattatgactcaagtagacctacacttcttttctgaaactagatttctgtgctctgaataaaaatgaacaattcatcagcacacatttcttcttaatctaaaaggacaacattatgcaaattcaggccatgggggtgtgaccctgtctatccttacttgttttgtttgtaagtaaatttggttcccctttgtgttaaagtgtaacttttttttaatgagaaaaataacttttgttttataccttcactagaggaagtactgtatctcagccatcccagtcacaatgggaacataagcatggcctcctcagtagaaactcattcatctcttatccatataggtccctttcttccatctgctttttatttggaagcactcattcttatctccaacttccccggcctcaaggtagtaatgttaggtaacttgcagtgatagctacttttgaccactttctccaagttccagcatcctgtaaattcatccatttaggcccacacaatatgtctacctccctagagaatgttccatgtgaacttcttttaaaatatcatactctcttttctgtaaaagcatatggaagggattctgtgacgatttaaaactaaagccacaatgcaacttctaacttaaaccagattattgcaaggacagcaataatcaatcacaaagattaatttaacagttgacctttttatactgttttatggatttcagcaaccatatagcaccacaatttagaggtagccttaaaagaactgttttctgcttagcaatcagaatctaattttagaattcctactagaaaaaaatatgagtatttttatctcattgcctggcgcatagtcggtattcattatgcttggaaaaaagtattactaggggtctgtgaaaagcattttgctacaaacgcttcatcttatcctttgggagaatcagaatattgcatactcacctgttggaagggtgccgatagagcagagtttgataacaccaagaagacagagaatgaaaccagggaaacattaagaccttcaggacgacgaggaaagatagctgatagccggaagaagacaatcaagattaaaaaaaaaaaaaatcacactttcagagaataacttaaattttaatcttttggctccaaagaaaaagtgacggccatggaataattttctgatttggccagtaaatcaggcttaacacctgctctagaacctaagcatgctggatatgacaatgagacatttctgtagctgagcagctttgtaaataattgggacaaaattctataatcatagcagctgcttcattatgtcctgataagctgcctaggtaattaaaatgtcacacatgatgcaaggagtagattgattttttttttttttttttttgagatggagtcttgcactgttgcccaggctggagtgcagtggcaccatgttggctcactgcaagctccgcctcccgggttcacgccattctcctgcctcagcctccccagtagctgggactacaggtgcccaccaccccgcccagctaattttttgtacttttagtagagacggggtttcaccgtgttagccaggatggtctcgatctcctgacctcgtgatccgcctgcctcggcctcccaaagtgctgggattacaggcgtgagccaccgtgcccggcctctgctgtatttcttaaagttagatgttcattctcagcctcacaggacagaattctaccgttaggagtcatgaaatcagtggtgggaagcttgaccacacaaagtctatatggctctgattggtggctttgccaatttagcggaaataggtcttgtttgtatttcctaactagggctgagtcttctctttgaggctcagtacagaaacggatgatttcttatcctttctaatatcagaggttcacaagccactatctggagctcacaggagccatacaccttttggttaaatagccccctaggatgcaaacgtttttctttctttcttttttttttttttttttttagatggagtctcgctctgtctcccaggctggagtgcagtggcgcaatctcggctcactgcaacctccacctcccgggttcaagcaattctcctacctcagcccctcgagtagctgggattacaggtgtgctccgtcacacccagctaatttttgtatttttagtagagacggggtttcgccgtgttggccaggcaaacgtttatctttctcaagcttctcgtagttagctttttcttactggccctgattagagtttactttatcttacccttaatagaacctatactagttctgacagctcgttttgccctctgcaatgaaattgctttgagaattcaccatccttcatgggcttgaaatttaaagaacactctatgggatgaagttgtataaatgattggttgattgacttgtggagggagtaattgtgtgttatgagggtgtgtgtgcacatgtgtatgtgagtgtgcatgcaagcctgagaatgttgtctctagtgtaacacagcatcacagatgtttgggatgctatagcatacagcacaaaaaataaataagaatttgtaacatgttctaggaagcacataacaagtaaatagtaagtattccactcagatttgttattccacccagaatgcacagttgatgcttcataaaacagggaaaaggtcttcatagaaaaatacattcaatcggccaggtgcagtggctcatgcctgtaatcccagcactttgggaagctgaggtgggtggttcacctgaggtcaggagtttaagaccaccctggccaacatggtaaaaccccatctctactaaaaataaaaataaaaaaaattagccgggcaaggtggcacctgcctgtaatctcagctactcaggaggctaaggcaggagaatcgcttgaacccaggaggcagaggtactccagactgggcaacaaagcgagacttcatctcaaaaaaaaaaaaagaaaagaaaaagaaatatgcttagtactgactggctgctgaagcaaaagcctctccaagccatcacgtggacacggctggatggcaggttgtgtttatgtctatcttccaagaagctctaataaagcgtgcaacactgacaatatccgcttacgttggcttagtattgctatttatattgtaaatagaataatgaaattttaaggccaggcgcagtggttcacgcctgtaatcccagcactttgggaggctgaggcgggcggatcacgaggtcaggagatcgagaccatcctggctaacacggtgaaaccccgtctgtactaaaaatacaaaaaaattagccgggcgtgctggcgggcgcctgtagtcccagctactcgggaggctgaggcgggaatggcgtgaacccaggaggtggagcttgcagtgagccgagattgcgccactgcactccagcctgggcgacagagagagacaccgtctcaaaaaaacaaaaagaataatgaaattttaaaagatgtcattatagttcttggagtcgagacacagtaaaatgctttcttgccctattcctaagaggcttcataattgttggagctataaatcaaagtgactctcctcacattgtcttcatcccaaccttagggactcaggccgtgaagctcagcactgcagtccatttccccacagctcactgaatgtagattgacttggggagtgctgcttcctcacgatttcaggactagagatggtgtcttagttggtctgggctgccatagtgaaagaccacagactctggatcttagcaacagaaatttgcttctcacagttctggaggctagaagttagagatcatggtgtttggaggtaggttttttcctgaggtttatatatggtcgtcttcctccgcacgtcttcacatggccatccctctttgtgtcccggtgtcctaatctcttcttcttcttctttttttttttttttttttttgagacagagtctcactgttgcccgggctggagtgcagtggcgccatcttggctcactgcaacctcaacttcctgggttcaagcaattctcctgcctcagcctcctgagtacgtgggactataggcatgcgccaccacgcctggctaattttttgtatttttagtagagatggggtttcaccatgttggccaggctgatcttgaactcctaacctcaggtgatccacctgcctcggaattacaggcatgagccaccgtgcccggccatctcctcttcttaaataccagtcttacatggaattaggggccaccccaatatccccattttaacttagacacctctttaaagatcctatctccaaatacagtgacattaggagtttacagcttcagcatatgaattctggaggaacatgattcagtccataaaagagagataaacggatatgtgactgagaatgaggaaagacagaattctgccatcaggaatcacaaagtcaggggtcttcagatgtcactgggataaagagaatggggcagtatggaagcctatgatacctggagaggaggggacccacatagggccagaataaagaaataaaactccttctggccaagcaagacatctgtgggctgagaccatccgttttctacccctgctgtagagtttctgacagctctgaatgttaattgaaagctgcctggactggcatttgtggcccagctggtgttttcttattttgtgtttgctttttgatggatgatgagtgttcagtttgttatgagattctggggaggaggggagctgattctcaggccatatttagttcttagatgtatatttaggtccaaaaggtaaaatacataggccacataatttcctgagacatttgctttttttctatacataatagaaagaactcatttctgcagactgaactaaaacataaggtgatagatgtttgcacgtagttaagaaatcaggcaaattgttcatgtgccagataaaatgttattgaactcttagtccttcagctgctgggacagatgggcagtaggtttcataccacgtgccaagaagtggctggctggaggcctgtgatgggagggattctgaggtttagactggacatacaaaagatcatgatctcattaattggccatatctgccaagaatgcggagagagggtttgcagcattagaacatgatggcacaggaatcaaagcaactttccaggatactcttgtcttgggtaaggtccattgtgacttcagatacataaatcccttgctttttaggtacaaaaaatatgaaattgttctggtgttttattttattattattattttttgagacggggtctcactctgtccccaggctagagtgcagtggtgtgatctcggctcactgaagcctctgcctcttgggttccaatgattcttctgcctcagcctcccgggtagctgggactacagacgcacgccaccatggctggctaattttcgtatttttagtagagacggggttccaccatgttgaccccgctggtctcaatctcctgacctcaggtgattcacctgcctcggcctcccaaagtgctgggattacaggcatgagccacgatgcctggactgttctaccattttttataggcccaacaaactcaaagagagaatgaagcattttgtctggcttagacaaaaaatcatgtgaaatataagaagcacaaaaacctactctacggttttaatatgaaatccagagagacaaatgcttattagttttgttgtttgtggggttggtggttagtattttgcgtttctgattttttaaaaaattttctctataataagcttactgatttttcctcttaaaaagcaatgttctgtgggaaaaggccaaccttccttggcactgccttctttttctagagattattaatttctttttaatagagctcatactgcaaaatcaaatttttatatcgcaaagggatttacatttatcttgagctgcacactcttcgtctatcaaattgagtttaagtttctaattgaaacaatttttcaagtgttaagcaataaagaagcaataagtgatatatttaaattatttattcatcttatttataattaattcatttttttccttgctgcacagtgaggctaacctgatgcatttgatttttcaaatcttttctatcatttggcaacaatagaagtggctgctttttccatcccacttgtgtttcattggtctttggggactcaggcaacatcagtttaaatcacagttaaacttaacacagcaactttgttttgcgatatactgcaccaaaaacaagtgtgttatgagtaaagcacgcctgttcttagtcaaattggaaaaaaaaaaaaaaaagtacctcttagtaaagtgaaccattgcatcaacaaggatctcaaccttcagcatttaatgactacttatcccttggtctatactccttctacacaataagattgataggcctttaacatgcactgtgtcatggatcatcaactagttgacctggatagctggtctgcaaattatttgaacccctttttccaatatctctgtcttgttatactattcacaacacaatctctcggctccagttgaatgcattacctcctccatcacataaacttattgcctgtccaaaattgcctggactgataatcttcaggcctgttcttagtcaaattgaaaaaaaaaaagtacctcttagtaaagtgaacaattgcatcaacaaggatctcaaccttcagcatttaatgactacgtatcccttggtctatactccttctacacaataagattgataggcctttaacatgcactgtgtcatggatcatcagctagttgacctggatagctggtctgcaaattatttgaacccctttttccaacatctgtgtcttgttatactattcacaacgcaaactctcggccccagttgaatgcactacctcctccatcacataaacttattgcctgtccacaattgcctggactgataatcttcagagctatgcagccactggatattttcctctcacacaaacacatctatcccattcactacaccatgctctggctcacagccctataatctcactccaccaagtgcccaatggcagaggctccaacaacttacatatactacccacaattttttttttttcgaaatccaaggtcatattcctggactgttcacaagctatagtgattccccttggctaactaaatatgctcaagctccccagactcctatttatttaggctggatttcacctttgcaccctcatccagcactgcctggcaattagataacagtgaatgagggcgtctatgaagagtgtactcacaaactttcattaaatagtaaccacactttatatgaatctttgctcctcacacaacagctgactttcactggatgctcagtacacatctgtagaacaaacgacccaagaacaggccataaaacaaattcagagaataatcaggggaaatctagtgatctgaaactcaagtcaaaaactcagaaaatatgatggccaggaagaagtcaatcgttgtctaaaattatttggaaataactgattgtgtagtaatccagttttctttaactgcagatgcctcagatgatctgattgtttggtatttagtgggcctcagtatgtttcatgtatcatgaaaggcagggagagggacttttctcaacctcaagggtacagcaactgtgcagtgaggactagggtgaagtatgagaacaaaaacaaaagcaattataattacaggcatttattgagcttctcctaagtgtcatgtaggtacaatgtactatccattttagcttattcaatcctcaaaacaatcctgtgaaaataacaagagtacatagctactaagtcacaatggaaaagtgtgttcttgtcccaactcttcactccctttcctgcaggaggccatatgtctatacacgctgtgtgcagaaggagtctacttccctgcttcattgacatcaggcttggccatgttcctgactcaggccaatagcatgtgagtggacatgacatcggcaaatccgagcagaagttttagtcattgtaggttcccaaaagatgagggtaaaatggcatgtcccagagaaggctgtctttaaagtggttcccagaatttgcacacttgtggccaacagtcagtccaacacgtaatgtgagcacaaaataaatctttgttgtcattgatcacagagactataggggtgactggcactacacaaagcttagcaaaagtagtggtagaattcacacccagagcctgcacttttatccatgttactatgctgcctcactaagcatacatgcactattatgagacaaggttctaaatctatgtaggcaggttctgctgtctctgtcttgcaagttggaatcagtcagctactcaaagtatggtccatggaccagaaacagtatgagtaatacttgacagctggttagaaatgcagaatctcagctcccacccaagaatctgcattttaataaaattcccaggaatgaatgtcacaataaaatatgataagtgctgatttaacacatggtcatggacgcatatgcttcatgaataatcaagatcaaagagctatgaattagaaatgaaaaaaagcatccacttccaattctattttccagattggaaagacaagagtatccacttattttccttgtctcttggagatcagaggggtagaaacaatgtgttgtaactacaatggtttactgtaaaacattctaggacttgctctagtcactaaatatcaccctttgatagagcagcttacacctcattgctagtcacgctgacctcttgttcacaatccaatagcatgttcattgaacaaataaacattagggcctatttgtcttcattaaggactgtatgcttgtaggggaaaaaatgacacattgtgcttatcttgacttccctgttccaagatcccattattgtcttatcacccttttgatgagtgacattgaccattaaccatatcagtaaacatcacagcttcctaaacacaagttctcatcataattaagggaggaatataacacttatggatgctgcttagccggtaattcaatgtcatggtctcttctccacactgttgcgaaacccagtagcagtgaaccagaacatccaagaagtaatggaaatgaataatgatatttcaagatggtggatgatgtaggtggaacaaccacttgtgcatttgagacacattctccccagtgaacactaaggtttttgacaggctggtttatgaataaattcatgacatgagacatttccaaaatgtctgttaagaactgcttcaaaatgaagtcatcaaaattactgcaaaatgtacattttaaatgcaaacagccaggggaaagagtgtacttgttatgtagaattcattatctttatttcggagtgcagccctataaacatttgtttgggattgcttttatgcaattgtttggaacataagcagagaaagagctgaatggagacattccagaaacccagagcttattcagcttcttttttctctaccttgatagaaagaaatcatttttttcttcaaatttaatacagttgtaaggatctggtgttttctaatttatcagtttatgttgttaatagtggggacattaccaaaatatgaaaaatggaaaccatgtactaagaattttatcttgtcatctgggacaaaaaaaaaaagatccttcattagatgcacattactttttttaggtatttaactcacaatgtaagtatgtgcatatttacagaagatagtaatactatccttatgtttgtaattgaattcagcctggagccgctttaagatgaatcagactatcaagttagccagcagatttagggtcaaaaatatactaagtgggaaaaaatgttcttaatacagaataagctaagtggttagttaaggactaaaaacaccactgctccaccacgaagaaggaaatatgcatttgatctaaaagaagaaaagagttaaaatccagtataccatcaagacaaaagaaaacctatctgtaaaaaaaaagagaatacaaatcatcacagacacaccctaaatgaaaatgccaagtagtttcgattgcatgaaatttattaatgcttatatatcaataaagctcaccataaacaaaattaaaaggcaaataatgacctttgaagattatacataccttttaaaaattaataagcctagcatttataaaagcttgcaaacctatttttcaaataacacaccaaaaaagaaatgagcaaagcacatgaattggcaataataatatttcaggaatgacctgaatctacagtagaggatcagctaatagtagcagatacatacgataaactaggatgttgtcattataagtgtaatatggaagaacgtctactgatgtgaagaaaatgttcatgaagcagtaaaaaaagaataaaacaatcacctaattgtaaatgtttaataaaagacataccagactgttagcagtatctctctacattgtagaactacaagagttgcttttttgtgtgtttcaagtgttttacaaacttcacccattcagtatatattgctcttcaattaaaaataaaataaaggtcatacaaaattaaagagattaaaattagaacaatttagataaacaaatttaccataaaaacaggaaaattccattcccaatgctataaaactatagcctaagccattaaaatgttttacttctaaaattaagctactgacttttggaaaaatgttattaccctataaagacatttttagatatccacagttaagtttgtaggcaaaggatggtattgaggtgtgtaaagagaaagcttggaccaaaaagaaaattttatttttttaattgagagcctgtgtttgtaagtaacatcagtgattcccttaccaaaatacctgttttactctgggagtgaaatgagttaaaagaactagattgctggggctttggggtaggtgatgcttcctctctaatttgaatctatattgccaataggtaaattgagagctaacacattaactcaaatttattgctgacattaccttccctatgcaggaaaatcaataatgaatatacattggaatagctgattggtgaaactcagagaaaaaaaactcaaagtaaattattctacagtattagattcttattgccactataacaaattaccccaagtttggtggctttaaacaatgcagatttattctcttacaattctggaggacagaagtccaagttcaatttcacagaactaaactcaagatataaactgggctgcactccctttgaaggaacatggggaatatctgatttccctttttcagcttgtaaagcttttccacctcataaagtctttttcagcttgtaaagacctcttgaattccttggcttatgagagacacatcattccaacctcttattccatcatcacatcttttactatccttctgatctcctgcctttctcttttaaagattcttgtgattacattaggcttaatagttaatccaaaataatcttctaatctcaagagcctaaatttaaatacatctgcaaaattcctttagccatataaggtagcatttacaggttttggagacagtacactgctttggtttgaatgtttgtcccctctgaaactcatgttgaaacttaatccccaatgtggcaatattgaaatgtggacttttaagaggtaatccatttattgattaatagattaacgagtcagtggattaatagattatcacaggagtgacattagtggctttataagaggaaaaacggagacttgaacaataactaagcatcctcaccatatgattccctgcaccacctcaggactttacagagtccctcactagcaaaaggacctttcaacaaaatgcagccccttgaccttggacttctcaacctccataactgtaagaaataaattacttttctttataaattacccagtttcaggcattctgttataagcaatacgaactaagacagaaaattggtaccaggagtggggtgttgatgatagtgaacacctgaaaatgtggaagtggctttggaactgggtaatgggcagaggatggaagctgagggagcaggctagaaaaagcctggattctggtgagggcttagaaggcaagaaaactaagggaagtttgtaactccttaggaattggttaaatggtggtgaccagaatgctaatagagatatggccagtaaaggccattctgatgagatctcagatagaactgaaaaacaaggtattgaaattttgagtaaaggccattcttcctataaattggcaaataatttggttgaagcgtgtccctgcccaagggctttatggaaggccaaacttaagaatgatgaactaggatatctgacacaaggcatttcttctttcttctttcttactttctttttttttttttttttttaaacggagtctcactctgttgcctaggctggagtacagtggcacaatctcggctcactgcaacctctgcctcccagattcaagtgattctcctgcctcagcctcctgagtagcttggattacaggcacacaccaccacgcccaactaatttttgtatttttaatggagacggggtttcactatgttggtcaggctggtctcaaactcctctttctttctttcttctccttttttttttttagatggagtttctttcacccaggctggagtgcagtggcttgatcttggctcactgcaacctccgccttcagatttcaagtgattctcctgcctcagcctcccaagtagctgggattacaggtgcccacccctacacctggataattttttgtgtctttagtagagacagggtttcaccatgttggccaggctggtctcgaactcctgaccttgtgatccccctgccttggtctgacacaaggcatttctaaggaaaatataaaaggagctacatggttacttttggctgcttatgctgatatttgggaccaaaggaataatttaaaaacataatttataattaaaagagaaacagaacagaaagatttgaaaagctctcatcttggccaagtgaaaagttaataagtgtgttcaggagagaaaatcaagggtgtagctcagagaccatttgctaaacatattagtatgaatagaagggagccaggtgcttttcctcaagatagcagaaaaaagagatcctgaaggcattttaaagatcttgaggctgcctctctcatcacaggcccagaggcctaagatggcagaatggtttcaggagctagaccaagggcaccctccataggctcagtgcccaaggccaccagaggactctgtttcctgcactccagaacggtgctccacaactgccctagttaggctcaagagaccctaggtatggcttgtggcacagctctggaaggaatacacatgtcagtatacatgtagcgctaattctgcaggctcttggcagcatgcatgtggtgctaattctcaggtttgcagaaagcaagagttgtagaggattggcagcctccacccagatttctaaggatgtcatcaaaagcttgggggcccaggcagggacttgtcacagggggggttgccaccacaaagagtttccactagagcaatgctgtatgtaactgtagggtcagagctgctgcagagtccttaccagggtaatatctaatggagccatagaggcaggacctccaccaggatcccaaaactgtggagtcaccagtagcatgcaatgcccacgttggacagcttcagggaccagacttcagcacatagaagtagctgcatgggctacaccaagcaaagccacagggacaggactgcttgaggccttgggggcccaactcccaccccagtgtctcggaggctaaggtggagtcaaaggagattactctcaagctttacaattaatgtctgccctgctgggtttcagacttggttgggactagttaagcctttctttttgcctatttatcactttgaaaatagaaatctgtgagtctttctaggtaccttgaaagtagacaacccgttttgatttcacagactcacagatgagactgtggactttcgacttccgagttggtgtggggataagttaagactttggggttatggggatggattgcatatatttgtatgtgagaaggacatgagttttgggggccaggggcaaaagcctatgatatcaatgtttactccctctgaaactaatgttgaagcttaatccccaatgtggcagtattaagaggtggggcctttaaaggtgatttggtcatgagggcatagccctcacaatgggattaatccattcatggattcatgggttatcacagcagtggcatttgtggcttcgtaacaggagaaagagagaaatctcagcagcacactcagcccttcaccatgtgatggcctgggctgcctcaggactctgcaaagggtcctcaccagcaagaagaccttcaccagatgtggccccttgaccttggacttgttagcctccataacagtaagaaccatattccttttctttataaattacacatttctagaattctgttacaagcaacagaaagcagactaatacagacatggatatcctggggaagtgacagcattacgcagctgaccacacctcacaactagacagacaaggtaccactaacagaattcctttccttatggcagcactttggtctgtttttgctgatattttacaatgatgaaaatctgttattctctttggaagtactaaatttagggtaagtcagagaagtcagtttctaagaggaaaataatactcattcctaaatttcttgcccctaaatttctttcctcaagtctccaataagtgctgcacagctgaaatctcatatgtttttcaaaataattatggaacatctgccatatggtagatacagatgtgatcactggcttttgctttacaaatgcaaatgatgcctttgacgttctcattgcctctgtttgccaagaaggcagtgaaatgatgagaactccactctgtcacgtgagcacacatatgctaccccattacccaccacaagtctgagaaaacacccagggaaggaccactaaagccacctataggagtgactcaaattctgttaaagcaaaacacaaaatgttcatgaaagtgaaagagccatgataggtctgatcaatcgtgtgatgttttagtgctgcaacaccctctagtcactgatctcgggcccccagactcccccttctctttcgtctctcaggttaatgatttagaaaggtgacatatgtgtgattctattattgttaaaccttgtagttggttggtgagttaggaattactagaatctacagactttagtatatatagaatatactggcatttatgtatagaatctgtgggtaatgaactccaacttggatagatcagacaggaaggaaaagaggaagggaagaatggggaaaaaaaaaacacctttatacctgtgtctggaccgttgagtgttgttggggaaaatcccacagctgggaagatttgtgtcacaataaatttgccgtcaccagcctaaatggtccttcagtgtctctaaggagcatcccctctcctgctctacaaaatgaccatttctccttctctaacctactcaagcctcagactctttactctcaggacccagtcttctcttctgcttaataaagaaaggggggaaatagctaaaaatcctttaaaccacccctccatcagcaccaagtctgtaaacactccagggaccaatccactcttccctcacttaggttagaatggagacagtgacctgtgcagtacaaggccactccccaagtcctgtccacagggataggggaggcttcctggagctctgaatgtggatgtggccttgctgatggagtgtggttcagaatcaggggagcacagagtccatgcaccttcctttaaattgaagcacagaaggttgtttttccagaggatcacagaaattcaaaatgcacgctctgcaggatgctttggttgccttccgcattccaacctttccctgatgattatcctgttcctcctggacccttgttctttccattgccattgcctctccactgactctggtcatcatttaggtaggctcaagtcctcctttcccagcagggctctctctgctcctaccaccctctgcctgctagcccctatctcccctccccgttcccagcacaccttcctggagaagatgagagcccccacggtttcattttctcatttctcagccactttgcaactcaccctaacctgcctcctgccctgcccacttggttttcgactacttatctgttccttctcagtcttctttactcagtcatctgtctctgcacaatcctgaaatgttgacatttttatggattctgtcctaggccttctgtatctgttcatgctacctgtgctctttagagacctctactatatccattgctaaattcccatctataagtcaacattcccctccatctaggactatctactgagctccagacttaacttcccgctgctacattgtaccccacccaattgtattcagaggtgtttcaagctgaccatgatcacacctgcacttaagctttctccttccccacccccataattggtctaatgctaatgtttcctaaatcagtgaaaggcacgtccactcagctgtctgaacgagactcttctaatattcttgaattagctcacttccccccaactcctagggagctgtcatgacctcccaaatggccttctagaatccacccttgctcctctcaaatccaccctccagtctgctacttctcttcttataataatctgatcacacagatgactgcccagtgacttccaagtaaaccttaatcttaatatgagccaagtatctcttaaaatctggccactgccaactttcctagctctctcttgtatgtctatctctctttccccctctctgttttgtgagggttccttctgtttgttcattccccctccatcctgccttctggctcatgaggctgaccagtaatcatgacatcagtgagattccatgccctctgacttttggtgtgttcagggccacaggagtccagacaggagactggaaggcagtagaagagtaaactcagtaactcattcccttggctcactccccaatgaacctacttagcttgttccattggtcaaccaaagtttccttccccttccaggttctgggaattacgccatgaccccttgacccctccaggcctaaggatggtggcaagtccatcatcacacagccctataccatctagcctgttgtcctgacactcagcccataccatagtaaatggtccctttattaaacacaatgttttctttcttttcttttctttttttttttaatggagtcttgctctgtcacccaggctggagtgcagtggccccatctcggctcactgcaagctccacctcccgggttcatgccattctcctgcctcagcctcccgaatagctgggactagaggcacctgccaccacgcctagctaatttttttatattttagtagagacagggtttcaccatgttagccaggatggtctcgatctcctgaccttgtgatctgcccgcctcggcctcccaaagtgttgggattacagacatgagccaccgcacctggcctaaacacaatgttttctaagatgagcctgccatctgtttcctgctggggatttactgcgatacccctgcctgctacacctcagccctgctgggctcttctcagatccttcagcacatcatgatttactatccctggaagccttctcactatgaggctggcccttctttcctgcctggcccacaagctagattaagtccccactgtggccttccaaggtgcattctactttgctgttgatatgctgcagaatgctgccattattgacgtgattgctttactgtcagctccaccaagtggggagtcagatctgtggtgccccgattctcccagtgcctggcaccctgaagatgcaaaaaaaagtgtgttgaccaataagctcatttctgtgagtttacctgacagagatctgatgatattttaaagttccagtctagctcttgcaatacaaatatagagttgctacacaagcgtctttgaatgaccttgggtaaaaagtcacataatttatttccaaatcctagaggtactcaaaatccacccttcattttgacaattatgaggtctgaaaaaattgtgaatgctacaatatgtacaaatacattcaagggctgtgtttctattagtttcatcaccctaagaaattagtgtttccgtatgtttattgcggcactgttcacaatagcaaatacttggaaccaacccaaatgcccatcagtgatagactggataaagaaaatgtggcacatatacaccatggaatactatgcagccatataaaacgatgagttcatgtcctttgcagggacatggatgaagctggaaaccatcattctcagtaaactaacacaagaacagaaaaccaaacaccacatattctcactcacaggtggcagttgaacaatgagaacacatggacatggggaggggaacatcacacaccggggcctatcgggggtgaggggctaggggagggaaaacattaggagaaatacctaacgtagatgatgggttgatgggtgcagcaaaccaccatagcatgtgtatacctatgtaacaaatctgcacgttctgcacatgtatcccagaacttaaagtataatgaatcaatcaatcaatcaatcaatcaatcaatcaataagtgtttcataggagaaacgtaatataaggaaaaacataaatattttattaggggtttattattattgaactctgttgctggctgaccacgtaaccatatagtgtccaaattccatttctgtaaggaaaacatctatgtccttaaacttgggatccacacatggcttctcacacctgcatccttccaggtcagcctcttgaggctttggatggacactaaggaaccagttcctatgcctggacttttgattaccccttaactgccatcagccaaattgcaggttcatggtcctcctgccttcgcaggaggtggggcgggatgggggtggagggcgagggggaggacaggcttcctgtccactcctcttggaaagcttctatgcactccctagacctgttccctcctgatcagtgagtgcaatactcctagttcttcaccaacacactaagaaggaaaaagcctttattcatttatagcaactgacaatataaagacccaaaggtcataacaaaataaaaagaagccatctttcaagtgggacagagaagtaataaaagtgcagttagaaccagagagtggtcaagctctggcaggagacaagagaagagagaaaaagggaagagggttgggaagtggtgaaaagggccaaaagcctgaatttctatccaccttcttctcttatctgtccgaggggtatttttacatattatagcatgctattgtgaggtatattatagttcatgaaccacagtgacttttagctccatgttcactgtgtggcttttgttgtctatagtagaaactgtggtctgctgtccagattcctacttctgggcctaagtacacatctcctcatctgctgagtgtgttgtttgcaaagaattcagagctgagtccttctatgacctcaaccaaagacgcctcctccccaaagacatcactcatccaatgactggtcaatgggtgttgctggagcccaactcaatttgggacaagtctgaatgaccatccagcttcaatgttcctcaaagggtcagctattaaaattattgaagcaatgggggaattccactgtccttgtatcagtcaacatctctactcaccagaccacaagaagaccaagaggcccaaaaatgcccactgaagattgctgacaacatacagacccaaagttcacaaaaaaatgaaaagaagccatcttgcaagtagaacagagaagtgataaaagtgcagctagaaccacagagtggtcaagctctggcaggagatgaggagagagagaaaggtctttgagattctaagtaggccttgggttaatacaaccatcatttttttttttttttttgagacatagtctctctctgtgacccaggctgcagtgcagtggcatgatcacagcacactgcagcctcaatctcctgggctcaagtgttcctcttgcttcagcctccccagttgctgagactacaggtgcaccaccaccatacctacctaatttttttcactttttgtagagacaggatttcaccatgctgctcaggcaggtctcaaactctgggttcaaacaatcctcccaccttgccctcctaaagtgctgtgattacaggcatgtgccaccatgcccaggcccattctcataaagttgaagaagactttggagattacacatggacctgctattcagtgtgggctggaattaccccaaaggcaaacgccatttgcagatgagctgacactctctgctttgttaggtgacataaccctcctggaccatcagctccaggctccttaacctgcgcctagcatctaacttctaccccagagactatcctacatgctcaccactgacccattcccatggtcaatctgattgttcttgaacaatctttgatgcccctcttcattggattagacccttgtcctgactgttagggcaggacaggggtctcatccaatgagatgagaccagagcatccacctagctctggcctgttgggattgatagcagaagttccagggttccccaggtcagcacagccaccaccacgataaaggcaagagacaacagctgccaccatgtcccaggacagactggtagctcataagactggacaaggggccgtgtcttggtgtgagttctccagaagcagatcctaatttgaggaaaagccgatctataaagaaagtagacagaagctgttgactgggggtgggacttcaaagcagggatgggaagtgacttcaaataggcatgagagatattttgggggtagttctaaaagggcgattgttgtacaactctgtgaacttgttaagaatcagagaatcatacagttaaaataagtgaatcctacgttatgtaaattatcgctcaataaagatgttaaacatataagaatgcatttcagaagtaggtaagtggctaagaaactgagccttgtaaactgtcagcctagaccctgccctgccttggactgcacttgcttcacttggatctgggtcctctaggagacgtcatgcttctgtcaactggcattttcatctttgttatattcatagcaagtcccctgcctatggtgatcatttaacaattatttgctgaattgaactctagtgggcaggtgcatttcccaggacatcaaaaagatgctttaaagaaaggtttaacagaacgcttcctcccagatggcccttgcacgtgactcactcacaagcactaggaaaagggcgatgacgtggctgtgaaaatgagacaagacatttagctacagatccagcaagtcatcagtcttcaggagaaaaatattagcagtgcattgcaccattgcctcctgacttcaggcgagatggcagtgtcgctccagaaggaacagccgtccccaccacctgctgcccagtaaggccagaggcagcaggcccctctgttgaaactatgagattacagcccatgtggctgaacttgcagacaaagaagagggctggagctgcttttccttgtagtctaaatgttactgtgcatctccttgtggaacaacattgatcaaacatagccttcaccctgatccaaatctgcgattcaccctctcagaagttcctgaggagctagaacgttgcaccctcaggtctgtgcacaggaaggagtgtgtggtaatcttcagggggaagaaaattatcttagaagaatgtaaattgtttctactccagaaatttgctgaaaagggggagagaagtcatgtaaaaagagatgaatttattagaagttctccttaacccagtaggtcccgagtctgttcctggtgggtagtctggtaaaccaggaacacaagaaggttgggtagagtgtttaagcttttgagtcagagagatctgggtttggatcctggccccatcactaattagctgacccagctccaacctccctggatttcagttttctcgcttgtccagctgaggtaataatgaaaatttttgtagctggatgtggtggcacatgcctgtagtcccagctacccaagaggctaaggcaggaagattgcttgagcctgagagctcaagaccagtctgggaaacatagcaagaccctatctctacaaaataaaaattaaaaaactatccagacatggtggtgtgtgactgtactcccagctactcaggaggctgaggatggaggattgcttgagccttggagttcaaggctgcaatgaaccatgatagtgccactgtactccagcctggggaacagagcaagaccctgtctctaaaaaaaatgctatagttataaaaataattttttcacttggggtcattgtatgtttgcaatgagaggctacaccatgatggggacattgtataggagatactcagtgaagggctattgaaaccccagataggaatatttcattcagttaaattaatggaggccctggcacagactgtcattaaataatatgggaaggctcagtgtgtccctagtcagggtttctcacatcctttccagtgggcttctgccagagaagacagagagtccaatgtcatcactttcatgctacagcgtgcagagtcaaggagcaagaaacagagcctccatgtgatatttaaatacaaacagacttttcgagggtgttatatattagccagaacccccaaattagtatttgtggctctgcatttcaaacattaattcaaatgattgcttcctttttaagcttttacctgttgagattaaatcctgaattgactcagtcaagtacctgataacctaccaaatacttgatgcttgttgaattttaattgatttaattattcttacaagttcatcaacatgaattctggaaaagaaagtgtgttctaaagagttttaacgttcacccatcaatgggcgcacgtggagtcagattctttccaccagaaattgggaagggggccctggagcagcagaaccaggtggtccatgctggagaagcagataaaggcagtctgcaaagacagaacaaaggctgatgcagacagaaaggagaaatcctcatgggtaacctggaggctgagagagcagttaactcagctttgggtcactttccaggcctagcctttctttctcattttggttttttgagaaatctttatctcccacagaacctctctgtgggctgagccaggctgagtagattgcgttgaagacctatggggtcccatatgggataggcacctgggaccactggaagtcaactttggtgtctgttccggcctttctcacttcttagtgcctttaggttgtgattcactctcactatgttctccaattgaggcatccttgcttcagcaaaaagagaatatttcttcttcatctcccatcttcctggtattggagagtagaagagttagcttacaaggagataaacaatagatcaggagaaggcatagaggtttacagggaaaataccagtgagtaagtgaagagtgaagtattctttagatgtgaggaaacaggtaagggagagcaggaatataacagatataaccagagaaacagaattgaatcagaaaaatatagcaaatcaactgagagccagaaatcgttaccatctgacctcataaactgccacatctcaaatacccagtcttagcaagaatatgttctccccttccatgcagcaggtactcaggtcaatgacagcaccatcacaccagtgtctgaaggaagtcttcctagataacccagcacttatatcttcagcttgggagtccatgcattctactgtcacactgtgcccagcacgcagacagtgacccctgagccacagctctcatcaagaaatcacaccatggctcccaagacacctaaattcccttccattacctgtgctctctttttggatacatgtgaaccatgactacccacactctcacggtatggctatttgtgggccacagagggagaagatggaacttggttaggattactagctttagaagaaaccttgagagttcgaagtggatatgtccagacaattgaacatataggtctgaagctcaaagtacagtaggaaatagaaagttatgggcacacatttatcattctagaagatgatgtagaataaagatagaggagagccttggtttgaactttaaggaattcacttaaaggtcacgcacaacccagttgatacagagactagaaaaataaaagaaggagggagaaagtgggaagttggaagccaaagcaagagattgtttcagtaaagagattgtggtcaccagtgttggaaactgctgtgaggattgaaaattgcctgctaaattcaacaatacgtatgtcactggtgatcttggggtaaattgttttagtgaaaggaatggcagatggaaattcaccaggtgttgagtgagtataggcagggagataagtaaatgggtttcgacatgtcttcagagaactctggctttgaaatacgaggagaaatacaaaaagctcatgcgcataaaagtgcagcctaatatatcctaaagagtataatagagatgatgattgataacggcacaaatgaaacaccatttcattccataaaaggctagggaagagttgattggatttgaacccacatctctctgacctaaaaaccatggttgggcaagagaacctatgagaccacacatatgttgattaatctaaataactgtggtatatgaagacaggggtattatttgggtttgatttgttcttgtttctctagttccttgaggtctgacattagattgtctatttggcactttcaggctttgggatgtcagcatttaatatttaatgctgtgaacttccctcttagcactgcttttgctgtatctcagtggttttggcaagttgtgtcactattatcattcagttcaaagaatttttaaatttccgtcttgatttcattgttaacctaatgattattcaagagcagattatttgatttccatatatttgtatagttttgaggatttctttctttctttcttgttttttttttttttttggttgagatggagtctcgctctgtcacccaggctggagtgcagtggcgcaatctcagcttactgcaacctctgcctccccagttcaagcaattctctgcctcagcctcccgagtagctgggattacaggttcccgccaccacacccggctaatttttgtatttttagtagagacagggtttcaccaccttggccaggctggtcttgaactcctgacctagtgatccacccacctcggcctctcaaagtgctgggattacaggtatgagcccctgagcacagccagttttgacggtttcttttggagttaatttccagctttatgaggggtatgaggcaggctcgattccctgaatcttttggtctcttgcagttttccagtggtcatcaatgcagctggaattcactgttgcagccaagcaaccacataatacccaagaggaagcagaaagcaaaggcattaatataagcacatgtgaccaaaatgcaactggagcatactaaacaacagctttatttgtggcctccagcatgggctgggatgtgccaactgtgtaattctcctgcgcatgaagaaccgcagaaccatgcagactctctggctctgcacaggtccagttgcactttttgtaactcttttagtgacatttttcaatatttaatctcaagctaaaattcttaattgcttactattgttgttcattaaaaatgtaagaacaatctgtgtgaagtcccacaccttagcgtagtagagaaaggaccaaagtgagaagtgcaaaatctctcttgaaaagatgtgctgtgacaaaagaaatactgcttctttctaagttacatctaatagctattttaaatgctcacataaacacaaggattgatgaggaagggagctgtctgtctctaccgtggtgatgctaaaggcttagcagcaacattgacaaatacatagatcattgttgtcaaggggttttagttaatcatgaagaagagcgggaaaaggatataatggaaaacgaagatgagacgttgacctgcagatgtgattgacttggaaccacaccctgacaattgcagaggcagaaataaaaacactgggaccaaccacaagaggcaagtaggtaatccagttaacaggaggaagagcaggtaactgaaatgtcaggagctttatgtactgaccttcgattacctcacggtaaaggaaaatattgaaaaggccattgatcttgtattcttattcatgaaaaacagcaattagcgaggtgattgcagtgtttgaaaatgtgatagcaatttacaagttcaaaataaaaacaagtgaagaaaagcccttgagaagggccacacatcaaattttctaagcatgatttgatctgcttcagaaagaagatgctgaaatgctgcagcccagtgatgcaggcagtgacagctgacagggtaggggctgaatggagaggagaagtcattctcaaccttcaggtcattgccattttgttagttccagttcccaaagaaaaaaggtaaccccaatctaaagagtgtttgtacatgatgaagggcctatcacttggtcattttctcagaacaaataggaagggacagactgccacgagataaggctattttccccctaaacaaagctcatttgtttccaccagcagcctccatccctaagccctcaacctgggctgacacagataatgccttaaaggcaggctgcccctcacacagacacaagaacctagtcagcaaatataagcaaatgtaggtccctttgtctcccaggataaagctggcaccaaccctctgctggacaaattaaaagacaaaattttccaccactaatcaaatctcttccatgtaatgagcaccactgtcttctagggcaactgtgattacgtccgttttccagatgaaatgctgagaaagtgataataatggaagtgtcacacacacccagggtgtgcttccttgttttcaaagtatttttcctaagttatggccgtttgctttgttgtttacgataattttgtgaggtagacaggatgggagatatgagtttagggatttaggttatcatactgttcctgaagtcaggtgatctgcattcaaactgaacacacacctctagtgaccttcagcaatgttctcaacctttctgtgattcagtttgctcatctgtaaaggggagagaggactacagtgagactgagatgtgatgatgaaagatcctacacagtgcctggcatttagaaagtgctcagtagtttgcagccatcatgattccacctgtcaccattgtggttgtcaccacagatgaggcaatgtggctgacatccctgagatcccaaagtcagagaggcaaccacaggcagaatccacagttcctgcttccaatctattatcccttcccgtctactagagaaacaatgtcaaaacagcaaaatcagtttctaaaaagtggggataacatattcaatgtgttttttaaataaatgaaagtcaaagtgctataagtgctgtacaaacgagaagaagtgtgatttgaagcttgagcaaaggctcagaaagggtcctaatttgtccttagttctgtcctgcaccatgtgatgatgaatttgaggtgtcgggatgctagatgcccttcctacccccaaataaaaagagggggtgaccttgggaggccaaagcaggctgatcacgaggtcaggagttcgagaccagcctggccaatatggtgacaccccatctctactaaaaatacaaaaattagccaggtgtggtggcatgcacctgtagtcccacctactcgggaggctgaggcagaattgcttgaactcaggaggcagagcttccagcgagccgagattgcaccactgcactccagcctgggcaacaagagcgagactctgtctcaataaaaacaacaacaaaaaccaggggtggttgatcctctgcatcaaaagatacaataacaggaggaaagactggtgctgcgatctgcaatagagatctttcacatcctcccaggaactgaagtcctagcccaaggggatacattttttttcttattaagcaacgctgctgggttgtcttcaaaatgaatctattttctgttgagtcttgagactatatgcccatatttattttttagagacccaaataatatttctaaaggtctcaatagactaaagtttccccaaaataaagctagaatacacctatgagaaaaagaaaaaaaaaattctacacatggcttcgagctcgctcttttttgacattctctaaagctgatgatgaactttggaggtgaatttcatagcctttaaaatcacgccattcacctcttcaataggtaaggattgaattctcattcagccaaataatgggttattcttatttaaagatatgcagtaaattagattcttttttttttttggtgccaacaattaggaatacatacttcctgtttctaagcaatttcaggtttaattaggattctctaagccccatttgtcttaacaatttgacagctccggcttccccttccacacccacacttttcctttttttacactctcccccgtttgtagtattttattccacataaatgccaggagggaaagggaagcaagcttaagtgcaaatcagatcgcttgtttcttctctggaacaggccactttcaaggcacctatgataaaaggttattttcccttgactgacaattatctctaagctaattattaaagtgtcttattaaaatgtgcatgtctgggggacttccaagggaagcaggatgaaatcccctggaagaagaatatgacatcacaggagtaatgtgcaggagagcgccctgtttgtccatttaaattagtttcatcatccataacaagtgtttaaaaagcagaaaagcaagcgtgatgcataatgcattgtgccatgatgcataataattaggcctgctccccgccaccccgtctcccaagacttaaaaatctctccgagtaagcattttgttctcaaggctttgacaaaaatgccatttagggactttcaaatttacagctaggcaatttgtcatcatttatatgacagagtagaaggtaaaaggaatataacactgcgtggttcatcacttcaagaagctcccggtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaagaagctcccggtgatgaaagctccttgggcctcgatgtggtaaagggacatccgcctgtccctgcaacactgcctggatggaggcaccccgcccccatgcgatgtgttgttttctttttaaaaaaaagacaaagtcggccgggtgcagtggctcacgcctgtaatcccagcactttgggaggccgaggcgggtggatcacgaggtcaggagaatgagaccatcctggctaacatggtgaaaccccatgtgtactaaaaatacaaaaaattagctgggtgtggtggcgggcgcctgtagtcccagctacccaggaggctgaggcaggagaatggcctgaacccgggaggtggagcttgcagtgagccaagatcgcaccactgcactccagcctgggctacacagccagactccgtctcacaaaaaaaaaaaaaaaaaaaaaaaaaaaaaaaaaaaaagacaaagtcacataagatagttatcccacgcttgagcatttgctcttggaaagccaacgttaactgaaggtttagaaatcaatcttcagcttcatatatgttgcttcttctccaaccctccatggacactgaggttaagaacagaacaattaaaaatattctttactctaaaatagcattttttgaagatgtgataaaatctaagagaacgactaaatttagataatgtctaaaacacagctgaaccaaaaaaggaaagagatggtctttggaatgagacattgttactttaaaataaccacataattattttatataaaaagagctttttctggctttaaaataaaatttagatctgaagtacaaatgtagcatttcctgttgaagtatgacaggaaaccaggatttgaggtctaataagccctacacggagcccatttgcgtaacagccatccacccatttgctcaacactgactgagcacctaaggtaggctggattcttcactggggcccagggctatttgcccaagaaaatctaactgaggaaaaacacggaacacaaagctgattattttaggactggttagaaagggttaatataaatgatttaatgattgaatgattaatggagtccaaaaggcagactcaagtgaccagaaaaattctctttcagctaatttaacattttaccgtaattgaacacagattgcctcaaaccacagcactgtgctgggctgcacccaggcaggggagcttttcagccccatgtgaaccttccccagacagtgggggcagtctatgtcgtcaaaacacattattggattttcaccctataagatgttgagtctcaggaaacaacaagggccaaacacataatggttgtgtatacgttcccaattgcatacttagcattcactgagccataaatttaggaacataatgctaatgccatataattactaatcctcacaaattttgagtgtaaaaaaggcccatctcagtcaaccaacgagatcattgtgggccaagctgttgtgataaatcacgcaatctagcatggatatattgatctgcattggcttatatgcgaatttctaatttcttccaacattcttctcatgaatatgtttgccatgatggaaactgtctagagctgggagataggccagcttggtttgggttccagctccattccactcatattgtgcctcattaaagaagtcaatttacatctttgatcctcactcccctcttatctttcaaatagaagattttgacaggtaattaacaaaggtccttccatgtctaactgttgatggttctagggctctagggccttaattcccaagaacaggatatcatcatcaggaatgggataaggcaggaagttgacaatttatggagaaaaataatgtgtgtagggatatataaataaaggccccctgcttgtgactaaaaaaagctagaactataaaaagctcttaggtaaaaaattggggtcatgcccagcaatcccattacggggtatatacccagagggttataaatcattctactataaagacacatgcacacatatgtttattacagcactatatataatagcaaagacttggaaacaacccaaatgcccatcaatgataaactagataaagaaaatgtggcacagatataccatggaatactatgcagccataaaaaagaatgagatcatgtcctttgcagggacatggatgaagctggaagccatcactctcagcaaactaacccaggaacagaaaaccaaacactgcatgttctcactcgtaagtggaagttgaacaatgagaacacatggacacaaggaggggaacgtcacacaccagggcctgtcagggagtgggggcaaggtgggggagagcattaggacaaatacctaatgcatatggggcttacaacctagatgacaggttgataagtgcagcaaaccaccatggcacatgtatacctctgtaacaaacctgcacattctgcacaggtatcccagaactgaaagtaaaataaaatttttttaaattagggtcataaatatgtattacagaaaaaaattatcttatggttgaactccatagccatgtaaaaattcaaagaaaaaaacaaaaaatcaagagtgagtgaatttggataaatcacccagtgtggccctgagcctaactccattcaagatttatgcccacttaaacatcagaacctcccaggtttcaatgttaaccttaatttcctcattaagcaataacttctctagagcacaataatagattataatttattatgcttttaacttagtaaattgccttaaaatatattatcaataatttagtacagcaagttttttgtacccaaaccagatatccagacatatatatatatgtatgaactgtagttggggagggcttcgcagatatatatatatcttcacatatatatagatatatatatcttcacatatagatcttcacatatatagagagatatatatatcttcacatatatatagatatatatatcttcacatatatatatatacacactctaatttcttgaatcatcttcactgttttgagtttgtcaaattgtcttttttgacttttcacaacttaagagtcagtacatttttcattttatcttttagctctgttgcacacagctttgctctgagagtccttaaaagcttctcactgcagcctggattttgctcttcagcctccttcagatccattcagtctctagatttatgtgcatgcatgcacacacacagacacacgcgcgcacacacacacacacacacacacaccccacagcagtgctttcaatgcctagccctcttctcaaactgcaggacagcactgatccatgttccctaggattctgtggcaacagcttcacttccataaagccctcccgaagtacagttcacaaagcttcctttctcctctatgtttatatttaacatttttagctgcatccatgtccctgaaaaggatatgatcttgttcctttttatggctgcatagtattccgtggtatatatataccacatttttctttatcttgtctattattggtgggcatttaggttggttccatgtctttggagctggaggccattatccttagcaaactagtgcaggaacagaaaaccaaatacctactacgtgtcatcacttataaatgggagctaaatgatgagaacacatgggcacatagagaggaacaacacacactggggcctattgaagggtggaaagtgggaggagggagaggatcaggaaaaataactaacgtgtactaggcttaatacctggatgatgaaataatctgtacaacaaacctccatgacacaagtttatccatgtaacaaatctgcgcatgtatccccgaacttaaaataaaagttaaaaaaaaaaaaaaagaccgggcacagtggctcatgcctgtaatcccagcactttgggaggctgaggcaggcagatcacttgaggtcgggagtttgagaccagcctggccaacatggtgaaaccccgtctctactaaaagtacaaaaattagctgggcatggtagaacatgcctgtagtcccagctactcgggaggctgaggtgggagaatcacttgaacccgggaagcaggggttgcagcgagccaagattgcaccactgcactccagcctgggtgacagagtgagatcttttctcaaaaaaaaaaaaaaaaaaaaaaaaaaaagtctttttagaatgatcaggagctcattttataatctaactaaattggattattcagtttgtctccttgttttattagcttatattacctctgtttttttttaaaaaaaaagactttgttactttgtacttatctatgtcataatttcctaatgaaatggccaactaagaaaccatatttatactgtgcttatcttattccatattcccaatggacataaaataagcacagtaaatattttcaggttaatgaatgctctccttctaagaaagcccattggtgagtttacactggtttcatcttcggtcattaataacattagtaacattctgtatcatgatcaccctgcttagatagtgccagttcctcacaatctgtatcacgttgagatgggtatatacaatatgtaaaccctacttctctttattttcagtttttcaataagtacaaaactataactttttcaataagtacaaaagcaaagaatttacacataaacttcttataagaaataacacttcggcctggctcagtggctcatgcctgcaatctcagcactttgggaggccgaggcgggcggatcacttgaggtcaagagttggagaccagcttgacccacatggcgaaaccccgtctctactaaaaatacaaaaattagccgggcttggtggttcatgcttgtaattccagcggcttgggaggctgagacaggagaattgcttgaacccgggaggcagaagttgccgtgagccgaaattgtgccactgcactccagccagggtgacaaagcgagacaccagccccccagcaccgcccccccaaaaaagaaagaatgcttaatcttagcatacatacattgtgtgtgtgtgtgtgtgtgtgtgtcaataagtgtgcaagatgaggagagaaaggaagacagacaaggaggccaaaaacagataaaccataaaaaaaaaccattaagctgctcaacgaaaaagtgaggctgcagatgtgaaatatgaaatgaattgtaaattattttgaggtcaaagttacactaagttgaatcctgtaaatctcaattcaacttgtttaaggctttcaaaactcacaacgtggaacacatttttaaacttaaaatttttcaggatatgaatgagggaaaatggatatttgggtgataccaagttatactacataacaaaaaatataaatatttataggtgtgcttaacccttcattttctggttactaaaaacccaaatagctttatgctaacaggaaccaaaattgatcccaatgatttgtaaaataatagatggtgattgctacagtgaaacctcacccaaattcactgtcaatactacatttttgtatactttaatttcaagagaaatacaaaaaacagaagaaattaaacttgtcagttatgagttgattgaagctgattagcccttcaggatgtgccctctgatccatacatattgcaatgcagtcaggtttcagcatctcttgggttatgctgtgataaaattatagaataattctcatcaggtgttataaaatccctgtcaatgactccattctggcacatagtttgcagaaacgcaaatttcacagagtctcaaaagaaaaaaaaaaagtaggcaatattggcagtaattaaacacacaaggctataaaatctatccacagctttagtttaacggtaaactcacattgtgagacaccgccatggggataatctagacccaaccttatcagcagtcatgcttggatcatccccattgggctccctctgtcccccagcctcccacctaggtcagtacccagccgccatcactgtcctagtggcagatcatctcaccccggcaccgtggaattagcctttgcttggccacccttccaccaattctctctgctctccaatgtctcttatgtgcggcaaccaaaatactgcattgattgctcaaatagagatgagcattttaacacacgaatcttcaattcaattccatctaaatttgaattcaaatctttccacaatctgctccctatcccatttttattattgatttttttttttttttttggagacagaagctggcctcacttctgtcacccaggctggagtgcagtggcacaaacatggttttctgcaacctcaaccttccaggctcaagcaattctcccacctcagcctcctcagtagctgggaccacaagcgcaggccaccatccccagcttactttttaaaaaatatttttgtagagattgggtctcaccacgttttccaggctggtttcaaactcctgggctcaagcaatcttcctgccttggccccgtcaaagtgctgggattacaggcaccacctcgcccggcccctatcccatttttagatgtgtcttccaccatgactttgcacagcagcttgatagaattctgtgtctctccctccacacccggggacttccctcattttcctcttttctcctgccaatcttttcactgcccacgtttcccagtcaaaagcatacacaaccttaaaagtaaagtttttaaatccccctctctttgaagccctttttaaataggctaatcagaagttgttttctgcttccataaacactgcagagctttctctgtatgtccgacatggtggtcattattgggtacacccttttagaagctgtgagcatgtcctattgtcctggagactttgccatgacccagaaaagaggaagttgttttgtttcttgcacagtcgttaatatagtgtttttttctcatttatttattcaacaaatatggagggagcaacttacgtgtcagtccttgttctaagaactgaagatactacaatgggcaacacaaaatccctgctttcttggatgttacagtttagtgcatataggtgttcagtgaacattttctttctttccttccttccttccttccttccttccttccttccttccttccttcctttttttcttcctttctttctgagatggagtctcgctctgttgcccaggctggagtgcaatggcacgatctcagctcactgcaacctctgcctcccgggttcaagtgattctcctgcctcagcttcccgagtagctggaattacaggcacttaccaccacgcccggctaatttttgtatttttagtagagacggggtttcaccatgctggccaggctggtcttgaactccccaccttaggcaatctgcccacctcagcctcccaaaatgctgggttacaggcatgagccaccgtgcctggcctcagtaaacattttcaaaaatttttgaaccaaatatctttgtattcctcaaagtatatacaacatatcagaaattacatgggtagtcaacaaagattttttttttaagtaaggggttttattgttatatcttttatgggtgcgtgagagttgagaattctagggcataatgcttgttgatcttttaattaaaatacaagtgcagatcttccaaatgcagaaactattgtcacacagagatatactgtcattccatcagaaatataaataaataaagtagaactgaagagacagcaatgacatccagtccctaagagctatacattgctttaaacaacattcattggtttaattattcaatcagtaactacttactgggcacctgcagcctgttagtcactcttctaggtgagcacagtagacaaatgtgggcttccccagttgggagagacagatgataaacttctaagtatatgattttaagtactctgacttccacaaagaaacctgaagcatggcaaggagaaactgaacaatcaaggaggccactttgttttagatcaggtggtcagggagacctctcttaggtggtgatatttggacagagaactgaaagaagtgaagaagtggggcgggaaaaggccagggtagagcattccaggcagaacacgcggccagtgcagtgctgaggagaggaccagctcagcaagctgtagaaacatccaggtggccagcatggctctgtggagggggtggggtgggccagcccaagccaggccatggaaggggtttgaggtgtaggcaatgctgtgtttattttggggatgaagggagaggctttggaaagaggagtgatgtaatctgctttatattttgaggaaatcccttggctactgggtggaaattcagctgtgagttggcagattatcatgatagtccaggcaaaaaggagaacgcagcttgaaggaatttaaaggtagaagaaatggtcagattcttaaagtagcatcactaggacatgctggtggtttgaatacaagatgtgaaggacagagaggaatcaaggacgactctgagatttctgttctgtgcagtgagggacgagcgatgctcagtttgaatgaccaaaatgtgagatagaagtggttacagggaggaaaatccagaaggcctccttcagagagtttaaatgttgagatacctgtgagttttgtaaagggatgttgagtaggcagctggatttcaggatctggatttgagctcagagaagaaatcatggatagagatacgaatatggaagtcatcagcatagagagggcatttaatgccttgacctaaattaaattatatagagaggaattagagagaggaagggaagggaaaggaagcagagaggaaaggagaggagaagagaggggtaagaattaatccctggagtgggctgcaacatttagagtctaattagagggaagaagctcaccaaagacactgagaaggagaagccagtgaggcagagggaaacccagagagtgaggtgtgcacggtccaggtgaaggtgtttcaggaagggaagtgtgatctgttgtgtcacagctgctgagagagtgaacatgaggaaatctagaaacgtggcccatgtgtggtggctcatgcctgcaatcttagcacataaagagacccccatctctgcaaaaaaattaaaaattagctggacgtggtggtgcagcacctgtagtccagctactcaggaggctgaggtgggaggatcactcgagcccaggagtttgaggccatggtgaactgtgattgtgccactgcatgccagcctaggccacagagtcagtccatgtctcaaaaaaaaaaaaaaaaaagaaaagaaagaaagaaaataaacagaaaaagaagactagaaatgtggaagtcatcagcctcattgacaaaagcagattcaatggagtggtgaagaagacctgatcagtgtgtgttcaacagagactgaaagatgagagtgtcaggtgagttgaaacagcgctaatcgaagtgtgtacagaccagctgcttgtttcttgtctacagtgagacaagcacagaaactgagaagttgctgcaacattcaagggggtgatcagtgggctccattctcaggaagggcggtacaggcaactttgtgtatcgttcaactcatgtgataagaagcatgagcaacaagctgtgtttgaggcaagtactgtaaggacctcacatcaagctgcaacagattggaaaatgaaaaactgatctttcagcacagttagtttgagaagcactagtatactcaattctttccagtagttttactattaaaaagtatcagaggaattggatggaagaaggaagtggtgacaagatgggaggtggtggttgttagtacgttttacagtggtagggataacagagagaaaacagaatgttgatatgctgagctggaagagggggaagttgaggctgagataaaatgcaagggcaggactgatgcagtggctcacacctgtatttgcagcactttgggaggctgaggcggggggactgtttgagcccaggagttcaagaccagcccaggcaacatagtgagaccctgtttctataaaaataaataaataaaaataaatacaagggcaaagtctttaagcagatgggagatgtggaattctggacatgaatggaggtttcagctttcaacaggagcaaggccagggcttccatggtcacagtagcgaaggtcatgtgtatgggtctggtgtgggacctgagattaaggttccatattgtgttgctgtgaacgggataaattcagaagagcctcaaagggcttacctgctagttctcccccacccatgagctgtcatggataaagtcccctagccaaatggcactccgctcatagggaccaggcacagtgcctgcttacccatgagtagtgggcttcggtctcccgtcagcctgtggaatcagccaaataagccaatcacatcctccctcaggaaccaggggacaccccaccctctttttttttttttttttgagacagtctcactctgtcacccaggctggggtgcagtggcacaatctcagctcactgcaacctccgccttctgagctcaagtgattctccagcctcagcctcccaagtagctgggactacaggcacatgccaccacacctagctaatttttgtagttttttagtatagatggggtttcaccatgttggccaggctggtctcaaactcctgacctcaggtgatccacccgcctcggcctcctgaagtgctgggattacaggtgtgcacacacggccaccatcccttcttgttactacaaggtctgcttcccgcagcccctgctagttcactctgtatggcctgccctgtcctactcccctgggctgtgggaatacttgaatgcaacactgctgtcaattttatctgcccagggtcatgtgttcaaccacccctataactgaatcccccatcatcagtggggtgaaagggaggcaataaaaacaggagtggacgctgatcacatgaaaaattgagtgtgtgggtgtgtattggagagcagggaatagtccaagtattcacttgattcttcggttttctcagtaaatcatatgaggttatcgactcagagtctgggaaaggaaggggagtttgaggtttggggaggtgagaaaggtgtgaagtagtcttcccacagacacagaaatcaactagggcagtgaggtagattgagggcagagctaagagcccactcgaggtttgtggtcatgcataatgagaccagtcagagcacagtgtgtgcagcgagagctccttggtcaagtgcagctgctctgatgcaatggcagataggctggggctgtataatcaggtatatcacaaagtctatagtctctgagacatgggtgagtaggtgtgagcacctggtgaaacaggtcagaggaaaagcaagttggcgttggagtcagctgtcaagagatagatccgtgatggtatcgagatcactacagacaggtggtggtcacctagtgttgtctgctgaaatttggagggtttaatttttaatccaaataccatagaaatggatatgaaaagatgggtgacacatgctgcacgttgggaagtggggatgaccaggtgcttagttgcatgggagaggccacaagtgcttggcaatgttttcgtgactgagcctctcatctcaggaatgagctgagattccagaaatgctgggatgaaaacaaaccaaccctgagactcccaaattgttctcatattgccacattttttcccacatcttccttcagaaaagcttaagaaagccatgtttgctatctggctcctcttaactctccccataacttacatttccagttttccagataagcatggccatttgtgttaggtcattcttgcattgctataaagaaataccagagactgggtaatttataaagaaaggcggtttcattggctcacagttctgcaggctttacaggaagcctggtgctggcatctactcagcttctaagaaagcctcaagaagcttacactcatgaaggaaggtgagaggggagtaggcaggtcatagggtgaaagcaggaacaagagagacagggagtaggtgggggaggtgccacacacttttagatgaccagatcttaagagaactccctatcatgaagcacagcgccacgccatgaaggatccctcctaatggatggcgccaagccgtgatccaaacgtctcccaccaggccccacctccagcactgggaattacaactggacatgagatttgggcagggaaaaatatccaagctatatcaccactctaaatagtatgtgcactcagaaaccagctgacctatctggggctcattcatccaggaagacagcctggaagtcaagtgcaggagttctggaattagactgcccgggttcaaatcctgcttccaccccggctcaatgtatgccttctctaggaaaggcattcacctttgtaagtcttgaatttccgcaagtgtaaagtggaaataataccaacaggcacctcaaagacttgtttgtcaattaaatgggatggtagaaaaaagcacttagcacagtttctggcacacaataagagctcaatgaatattagcaattactataaacaggttcattcaccactccataaacaggtgattctgtcagtattaccatagtatgaaattcaggctgcttaggccacagacaagaagacaaatatctttaaatttctctgtagtcagactctccatgggatccctggccaaggtttgtgaggtggctgattggacaggatgaaggcaattgtcacgacaggggaccaaccagtggacccagatggtgacttcattagaacagtattccaaccagcaccacgcagtgtgtatcctgcagaggggccaaccaggcaataaaccgagttccaccaccttgcagccagcagccgagggaagctctgagctctgagagaactggtctattttcatcacatttggacaatggacacactccacagaaggcaaatgtcctttctcagaagacatatatcacatatgagtagctggcttgaaccttaactcagtgtgagagagtaataagaatatcaccatagcgtggcacaggtatgcacacacacacaggcacacacaggcatagcttattcttatttattacaagagctttcagtcaggctgaaatgtctaggcagtattttctaaactctttaagacgcatgtcccatggacacttccggtaaaatgattcagcttcaataagattcagacgcttactaacaaaactaatttgggtgttttttcagaaaagctcaaactgatacaaaactcacaatttcagcctccaattagcaatttcaaaaatattttgattctgatattttggcattgagaaaattggtagtcagttcaggacaaatgaaatagagtgtacttaaaaacagatgcatgatttaaatttgagagttggggaaagattctatcctgtaatatgaatgtaatataactgtcatctggtctccaattttactcttcccaacagaatgcaatctcatgaaatagttgcacctctgaagtgggtaagagttaattaacctgtctcttacttatctaacttaagtaagcgaaatggctgacatggaaaagtaaatgaattttccatttatacaccgatttttaaaaaccgatctttcactttcccaaaacaactctttaaagaaaatttaacataatcattttcagcttgaaaacttcaaatgaatgaatgtggcttgatttgggagaagatttaaagactgtgacaccagacaacctgggctcaaagtgctattctcaaatcacagttgccacctgaccagggcctgatagtcaacatttccaaaccctggttttgcaatctgtaaaactgaaattaaaaatacccatttgactgagaatgaacagaggcgtagtcctcagtctgtcattcaacaattgtgtgaccatgagcacattgtctaaccatgccttctttacgatggtcataataacaatattcacatctagtaataaatcataaattcaagctattgtttttatgatcattactattgtagctaataaacataacgagtgcgaatcaaatggtcactcaagtgtccacacactttagatgcccaatacatacgagtttccttttaccctcattcttttttagggaaataattacaaggaggatatctttcttcaaagcaaaccaagagattttcatttctatgaaggagattacacaatattcgaaggggtatgtgacaatctatgcagataattactctctctatgagtaattcttgtggcccaggggttcttaggatgcgggaagctggaatggtaatatatggtatcatcgtgtgacctgctcttgaacgcaagaggctatcgtttccagccagatcaaaacacaggcaaattctgatttaaaaaactgcacatattctacatgctcttatttcttgtatccagactaccccattaagctaatataaagggagaaaaagtgatagggtgcaaggaaaaattcaatcactgctaagctcatcaaactacacaatgagccatggtaatctgcagccttagagaagaagcccatcaatgacaacaccaccatcgatattttctactcacattctttcctatgcagtcccaattttcttacattaggaagcatttcatcaacattttaagttaacgaacctcacctcaaaaaatcacccagtctaaagtacacggcatgcaagagcaaacctaaactgtgttatcagaaaacaaaaccagatgatgtcgtgcctttttaaggaaatataaacctaaaataaaccgagaacacccctcccggggccatcacatacacaagaggcagagacttaggcaacactcagaagggaaaggaaggcaaacagcgaaaagtctctcagagaaaaagatttcatggactttggagccactacagctgtctctgcactctcctcttcaagcgtttctccacatctagtatcttcaaatcattagtgctttctagctacggtttcaatatttcccagaggtctctccagtccagcctttgcctgagagaacaggttacaaaaatatcccctctcccttttaccaggcaacaaagagaatttgcagtgctttgaaaacagaaatccacatccacaggaaaaacaggcctccgccagccgcagaaaagggtgcttcaggcacagggcaaccaggcgagagaaaatgcattcagagcggttagcacacaggattaatcacattataatttaatcatctgatcaaacactaattagcataattgcttgagggagaaatggctggaggaacccaggaacaccctgagcatccatgttcttaatgacaaaagagggaacacagatttggcttccctttcttcataagaaaagaaagaaaatagcaaataaagttaatcaatgacaagcatcaccagctatggttttagcagccaaaggaattgcaactgagattcatgacattttccttcctcctctctctccaggaccactctaaaatccatggaaaaaacgcagtactgatgttacggtaactagactctgagctatttaagtctgtgttctcaaccttggcacaatgaagatgttgaactggatcattctttgtcgtggggagctgtcctgtgcattacagggtgttgagcatcttatagtgagtgtcccctccagatgccagtagcaacccccaaccagatgtgtgacaaccaaaaatgtctccagacattgctcactgtcctctgtgggtgcaaaattgccctccgttaagaaccactgaagaacacagcttgtccggtgcatacttcttttaaaagtaaccaagtcataaaaataggggaggagtctttttatttccatttgccaaaaaataatgagcctaaaataatagttgcccagtttgggaggccgaggcgggcggatcacgaggtcaggagatcaagaccatcctggctaacatggtgaaaccccgtctctactaaaaatacaaaaattagccgggcatggtggcgggtgcctgtagtcccagctactcgccaggctgaggcaggagaacggcatgaacccgggaggctgagcttgcagtgagcagagatcacgccactgcactccagcctgggcgacagagtgagactctgtctccaaaataataataataataaaataataataataataataataataataataataataataatagttgcccagttccatggatttaccttatttctcatggctctatttagagctttacaataacccataatgcctatgcctgtgcacttcagaaaaaaataattaaataccagcctcctccatcaaagacctttagggagacacttccaggagcacctttgaatagggacactcacaggctcagagaactccaacccttgcttctagacttcagtgtgccctgagcaggcaagaggtcacagcaatgtcttccacctacccaggagagagcaaaccaccagtgactttgaaaatgaataaacccagagaaggcctccagaccccccaggaaaatacagctttctccctccactctcactgagcacatgtaagctctaatatttgctcccagtttctaaagagggagagagaaaggtgaacaagatggagagaggtgaaatgccgactgctcctccatttcttgcaaatgtatctccaccacaatcgactcattgcataaacttaacctgccttggccaccagtcaggctggacctaacaatattcactcttatcaagagatgctagagaccccagggaaaaatactcaacacttattgctgcaggaaagaaatattttctatgggttaaggtgatttgttctaataataatactgagtcacattatctctcatttttattttttttatgaagaaagtgtttcaccatttacaattactcatgagtctaacacaggttattaaatctgatgatggaaatatttatgccctttccgtggcagaaagatgggaaaagattgacctactctactacaaaatttaaaagagaacagtctgtgctataccatgtaggttgtgaaaactccaaatcagagaggaactgtgagctattttaaactgaaatcttcttctgcaattcccctgtcagagcttgtgacttcttaatataatgcccccacccccttttaaaggaacatgagtataggaaactattattgtaaagagacagtctaccctaattcctgtagtgatgagtaagcagaattcacatttattcagcctacaatggcttttataccatttccttctaaagctaaatttcaaaacggccactcaaaaaggtaatttctatagtgaatcacaataaaatcaccaaaggattataacatcaaacttgtttaagatgcctaggagggaaagttatttttaatattatctaaaataagatctcaggacacaaaaaggtatttttaaggttctgaatttaggcctctctccagcacacatttgagtctattttagtgccaaaatcaaggacacgatgttttgaaaaaattaatctgccaccaataactgccctctattttgtcatatatgtaacaaggtttaaaatgcacatatgcccttatatgccagcttctctcttttttctgacaacttaggataatgacatatactttgtatggtaaatacagtcaacttgtgattatttacctaaaagaaagccaagaacatccaacagagcaaatgacccaaagcccttcagatctggctctggaatgagcttgtgccctggacaaaggaatgtgcagcatcccaaggcggcatcaaagcaaaacctctagctgcaaacagatccactctcctgccctgtctcagcccgttctagctcatctcttaagcttgttcagtagagttacccaaatggtttcccactatggatctcttgcctggagcttcatggttacaggcaggtttcaaagggcttctctgctgggactccagctgctatcgaagaagggaccaatgtgagaaatacaatggaatcaagaccataagcaaagcacaagcatttataaacctgaatatcaaatacgctaacaggaagaaaaaatggtgcaaagagatagatattaatacacacagatgattcgtaagctgctagcatccacattgggagtgcctctggcaggatctacatacccctctactcagaatctttcttgttactaaaccccagcaccaattatcccgaaagatgcccaaattcttatggtggtcagtgaagacctaaccctgtatacagacattcccaataaattactacccaatacagagttctccaacagttcatcgagatgtacttggaactttactggatcaacttcctagctactgtttgggtagcttctttgcaagtgtgtgttttgcaaaggtgaattatggttcatgtggatcagaacaggcaaaggcatgcgttaataatgcaaattcacaggtcgtgcatacaccaaggctacagaatcagactctctggtatcagagctggaagacgacataacaaacatggaaaccataacttgggagaccccagtggtggtgggaaaaacaagacaaagtcacatgggattagaaacacctggggagctttccaaactacagcccattccccacaacgctggcatcagaatttccaacaggaggctaatgagaggaaatgcatttcaggaaacttccatatctcctttctctgttctccctgacccagaacaccggggtgttgagaaccagtgtcctcgatccttacctgggaaggcccacatagaaggatactaactaatgttcagcttgaagtgtcaacagactgtggtctacctcttatcctgatgtaagggtggaggggatgtgtggctatggggctggcacagcctcttcctccatattcagtgttcccatgaacatttgcctccgctgcctccaagcatctaatcccacagaagcctacagcatattctatattcttactctcccatcctcagcaatggggcggtagaggtatgggggagagtgtggggcccctcgtgcctgtgattaataaaggctgatgatgtgagatcccccaagacacaaataaaccaaccactgatgagagttccttgcccaaaacaaatacctagatcacctcgaggtccacatttttctacccagatttctatacaaatattcaatgaagcctattctaaaacagtagccaccaaggatttaatagctattgatttgggtgagtcataacagacacatctggtaattaaccatcctacccacattctgctgtcacgttaaggacccggatagaggttgctaacttgggctgccaacttaaacaacttgtgaaaggaggattctgtctgttagacagcattccacatttcttgtgcatttccttttcactagccaacgaaatagacaagtgactagcctttgcaggaactgacaagaactagatccggcaggagtgataaagtagtcatggttcccgttttgctggtagaggccattgttgtcattgttgggtgtcttcagctcattcctaaagtctcacaggtaatattccaaagcattgttatttctaccctgcaagctacatatcagttattaaaaatgctctacagccgagattaaaaaataaacatggcaattaagcagactgggacttggattttctgtatctctatggaacccaagatcaaatcacaccacagcggggctaactgtgaaaagaattgaatcttgagtttctctcgtgagaaagtatatttccttaaagtaataagtttccttattatataggaaatatagctgtcttttgtatttaaaaaaataaattaaattaaaatatacatagaattgcagcagttctaattatctttctacttgtctttctcttatgatacaatcacagaaatgttcccatcatccagcagttcatgcttatgagaagaatcaatgctttactcaatattaggaagattaatcaatggtaagagagtccactgcaatcacccacctgaagtggcatggatggctcttcagtatacggcatgggctacctcccaacagcccccctcagcccctgtgacccattcacgctggtcctaacaccagcttctacctgatcattgtggtgactccatgataatgctgaagccactttgggaccctcaggtcatcaaggtcaacactgggagtggtatcaccatactgctgttttgcagaagcatccaataatgagaaagttgggatatttagaaagaactataagctggcttttactgttttattttcagtgtgaaaaaagtgtaaattttatgtaaaaccagacttaaaactgtttcctgtttcttcattttaatactaaaagagtcaaggcttgtatgaatcaaaatcagtaattaaatagttcaaatttctttccatcaccttatcaaaatgccaatttcatagtctggagagactagcgacaaaatgatccattttatagatggttctttataagacaaaaggcaaacactttccacagcatcatcttctagggcaggtctgattttgtccagatttccaacctgtaaatcagcagtatttgcataaaaattcaacgattctactattaataaaacccaaagcccacttggaaccaggaaaaccagaatgctataagtaacaaatacaggcctagaaaggaaaactatttcatttctttttttatgctaaattgtatatacttaaggaacctgggggacattagctaagtgatatatgccagacacacacatacaaaatccatgatctcacttatatatggaatcttataaagactatttcatttataagagcatgtggcattctttttcccttgtccaataacatttgtgtcaatcacaaagcctggggtgatattgtctgcccgacacagactgacaaataaggacttcatatattgcaatttaaaaccccagagtttgagaacaggttaacatggagggacttgtgataatcacaggatcctaaatttgaactcttctctcagtaattgctttattactgagatgtatgcagatttcaccctcctactattctgccgtgaaacatctttaagaaaggcaaggcttattgcagaataaatatttgtagcagtgctgcaagttcaatgtcctcccttcacctccagtcttttgttcagacctactcaagctgtttccagataatatatatattgccttctcatccccagcttcccaagcctaacatagacttaaagactgagagcacttctagaatattctgcagagagtccaaagagatttcataatatttctgcaagggttggtatgcttttttttttgtttttttctcctacaaaatgctgtacagagctgggacgttaggggaagctagcatttagtatggaggtgatctcttgcattttcaattctttctttcactgtctttgcggctgcacttaaaaacagctttctataaataggactgcttgctcactcttaaatcttactcactgtcttctcagtaaaaaaaataactagggatacaggcaagattcattaatccctgtcattctaactctctgtgtagtagcctctttccttcttcatatcttgacatatatcttctcaatcccattcatccctctctgttaaaccataatatgtatttacataatccagggggcttcaagatcaaaaattaatccagttgcatgatttttaaaaaatcagcgttgatcacatagaacaaatagagatgtccaaaaatcaaaagctgataaatattgtaagctataagacacttaatttgatttttatatttggacaaaaatcaactttaacaatgattaagatatcctttcatgttactttgatgaagatagcaactgtcatatttgaatctgcaaaataagaaataaagataatgacaaaaaacccataaatccataggatgctgaagaaaacagtagtatgactttttaaagatgaattaaggcctgagaaagtaagctttgttttgatgtcctgggtggctctttgatgaagaaatgaattcccaagagctgggggtggcggagtgggcggggaacctaaatgtcggtttgatgtttctggctggctttcaaaatgcgacagggcaataaacactgtataggaattttaaatcatgccatttagcagcgtacacttgagaacaaggggtccagcacatggatgaaattattgtctgtgacacttgacccactgcacggcaggaagagcacctaaagcaattacatagctgttgtgcaacagtgatgaagtcccatcagatactcgaaatatgaatctctttttgaaaagagaagaaaatgccccaagccacaggcgtttctggaaaataaacatttctaccgtgattgagtcactacgacagaaaaaggtgggtagagcaaaagagtccagtggtttagtcagaatgcaagatagggaccaggagagcaagtccaggaaagcaaactaagagggggagccaatcagctagaggcagaagagagaggtggacgggagggaggaaggtggacaggagttaaggaggggagaaaggctctgcctatcactttttcctttcactccgtaaggaacatcatctatttccactactccataccatgtgctctgctctgtgctaaggacacgctcaggcttcgcacgcatttcagactatggaggctcctgtctagctagtgagagaggcagtcactagccaaatcagcatcacctaaatgcaggcgtaacgattaccacagactccatcaaggaaacagccaagatttttagaaaaaggataatatggagggaactgattttcaggagcagatttgtgaaacccaacccttctgaacgtcctggtcagaagctgtctgacctctgaaccaaaatcctgtccctgcttccctcctgccaccttgacagaccttgcgtcacctgcagaaaacatccgtgtgctccaccctttgaattcagaacgacatagtggatactccgtggggctgctggaatcttccattcccactgccttatcttaacccatagattcggcaagggaaatgcaactttgaattttctggcattttcacaacattgaagaaaagaacataaatatagttggggggaggggcgcggagagataagatgagcatttttgtgcccaggtctttggaacttgaagagttaaccccccagtccaggggaacaggtgttttccagtgggcctgggggagagggaagggggctcccggtcccggagccttgcctgcggagattgatggactgcggaggagcgggcacgtcagcatcacccctgtcaccatcagcaggagaagcggcggctcctggaatgacattggaaggtcagccaatcaggcgcggagctgctcccggagctgccacctccgaggcgcgcgccacgccggggttccctcgcggctttggaaagggggtgcaaatgcacccttctgcgggcccgctacccgctgcaacacctgtgtttcctttctgggcaccttctaggtttctagatattgctgtgaatacggtcctccgctgtacagttgaaaacaaaggctgctggacctcgcctgacctgcggttgcctttgcccggttcctgttagacgaactctacgacgccggagtttgggcgcagtgaacttgagagatcgtgggggaggcgtcttcagaagaaagcccctgaccatctgcatggagcagtcctccctcggtggcggctgggtttgctggctctgctgaaggctggctgcaagagtcttgtgaggtttgccgcccactagtgtcctatggcggggacacaatcggcctgcaggtagcaccacctccctatctcccaggctgagggtgcgggcaccaaggcccagcgtgcacttcagcgcagcagccaagaaaatgcccacacgcgcttgtttgtgtgggcacacccctgggtgcctgccctgctctggagaggtgggccacgcatggaaaccgaggaaatcgaagtgctcatttccgaaatactattgaatgcactgcctaatgcaaaatacattctttttcactacctattaattatttatgagccacattcataatcttacccgtagaattcagctaattttacgaaacctggatgccacattttgtaaatgcatccacttgataaacccatccttttattttgcaaacataaatttccaatctacagtgttcacaggtctttctttataaaatgacctctctctctccctctctcaatcaagttttaatacgcattgaattgagtctcttgtcgaaatactccgtgcaccttactccagacacatctaacataaaataccttgccagctacccggaggtccaggaattggggattagaattggcaaatattttagtcaaaattagttcccctaccagaatgctgtattgcgctggttctgccccccgtgactcactgatcccccgaggcagcaaaccgtggtcacaccaaaatgacaaaggagagagtcaaaaagtggagaacgatccactggcatttattgaaggtctgcgtggcattttgttttcctacagagggcatcttggaggggcatgcagcttaagttaaaaggcctcggaatttaggtgaaccctgagattatggatagctttttaatctgtttaataaagatgggggagaaagggaagtggaggcagccctgaaattgttcacctgataacatttcttccttacatacatttatgtgaattaaataaaaatcacctttgaagtccttaaggtgcatttgtatttacaaaggtctgcttctaattaaataaaatagcaagcgtgtgctctgtaatttcctatcaagtgaatggatgaagctcaaaggtgctgcatactcatcttctctttaatgagcaccttcttactcccagcaccccaccgtctctaatctccatgaccctcaggccccatgaaagcggatgcagtagaactgaaaatcccacagctcaggaaaagatgatgtcaggaatgcatgcatgtgtgtgtgtgtgtgtgtgtgtgtgtgtgtgtgtgtgtgtaaaaacagagatgccaggatactagcaaaactatattacatataataaatctaattcttcatcattctgtttgtctgaaggcctggctcttcttttagcaataattttaaactagaatgtgctctggggttaaaaccaggagaaatggtaatgaaacacaatgcagtaggaagctttgctgagaagacaccgagggacgtgtgtgggtgagtgtctgcacatacgtgtaccttggctccttgcactgtaacagaagctcgcgtgtatttccagaacattgcagaacaaattgactgctttaaaacacgatactgcacctcatcaggtgaggtcattcatttaagggtttaacctatgaagggcctggtcactgacttcttctttttttttttttttttttcaaaaatactgcctgcagcctgtctagcaaccatacttttattaagaaataactgtacttctgatacatcaataagaaaaatattgttgtctactgttaaaatgcagatgtattgtgggcttattttaatagccccaaatattaaactacataatcttttacaaatgaaaaaaaaaagttatcatgtcaggcattttgatgcttgaggcctagcaataatcagtttaggtattagaattcatcaatcttttatcacacacattcagaaatttttcaaagttgaggtataacaaaatatgacagttgttgacaaaaatattctcaattttttaaagtttaattcagataggtagaaaccatttactcttatatttttgaaatatggtcttacaaacaggcatagttccaaactggattcttattttatttcaacatgtctatatattttatgatcctttccccagtatgtaatgaacaccataccttagaaaactgtttaaagctgatttcccctccccccttcaaagatcctaaagctttacagcaggcttttaatgttttcatccttgatcatataaagagaggggcatttttatacaagacagttccatagccttctgctagattggatcagaatacgtaatacagcaatgtaaaatattcatttgtgtttgctgtttatgtctaatattgtggaatctacctatatttattacaataatggtgattatcagttgattttaaaagtcttgaaaataatacttgcagaactcactatatgagtacctacataatttttgcatatatttttcatattgcagaatatttgaggtttcatataattgtattaccatatataattatttctatgattgtttattttagttataaaatgctgattcagaaaaaaagtcacacacacatatagcatctctgtatcagaggctaatagtctgtatcagtatcataaattcttccataccattttgtcatacaaaatgctaaaactgtaaataaatactggctgactgacaaccagcacagcctctttcatcatcctgaaacacacacttcccaatggggtgcaaattttgtttcttcttataacccaggcctttccaaggagttcagaaaggtactccctgacaggcgaaacagggtgtcaaggctctgtgtctttggaacacatgtgtaggcatctctacatttcttaggaggtcgcattagcagaagagcagaaagggctgacttccccgacacatctccgcatgttccctaagcacatctgtccctgaagggaaattcccaggaggacacaggacaggtatggtgccctctgggaaagatgggtgtcttgtcagaacttgttgcaattctttcctgctaggaaatctcaaaatgaaagtttcaaacactttgctttaggttatactggagagcaaagtatcattttcatgttcattttgatagtaccttctttcaactctaccttttcttagtcaccgtttttttaaaaaattgacaatgctcatgcatttcttctggcctgttggtatgctgattctttaggcactgtctaggtaggcaaagaaaatgcactgccttgcagccaacacacagagcttccctgtgtgtcttccaggaaaatcttagagcctcccctttgcttctcgtattttctcacaagggccagatttcctctcttctcttcttttaccttctcttcttctcctctctctctctctctctctctctctctctgtctctgtgtctgtctcgctctctctccctcctctctttctctctctctctctcctctcttctggctaggggattctgcttaatggtttaatttcaactgtcagtaggttatacattttatgcagatgtgtgttccaaaatttgaaatgggaatttaagccgtagctactcccaggcgatgtcaaatgatgacaatttcctctggttcccacaagagaggaagccattcatacatgtaagttcatatttatgcggtgacaggcagcctaaggtgcagtcacacttactaattgggtctgactcagtcaagagcaatagctttctaaatacccaggaagaaatcatttcaaaatataatattggctgggcatgaggaaatgtatgctatttacaatattcactgatttcatttttacaactatacaggtgtttttttttttttaatttgtcaacatttcagatgatgtaatgcttatcagtgcatatttttacataaacgactgtgaggagcatgaagcagcacggggtgcatagaaggacagaacattcttaaagccctccttggtgctggagatacattgtactagcatgaaattacgtgtttgaaaaatctcaaaaagcattgaatctgaagggagatgttcctcattgacccctccacttgcgtgcacttggaatgtcacatccctttccaggttgtaatattcaaagtggcaatcttcctgtctctccttctgtcaccaaacctggtttattctgaatgaggcagctctctagtactggagttaggctctgagctgtcacttggctaggtaagcgccttccaatgattacagagcaatttctcccgggcctctccattgccacctcttctcccccaaaaaataaatatgatatttaaaaaataaataaaagcacgaaattttaaacacagatgaagcggaaaaagaaagaagactttacccatgcatccaatgccaccccccacccccccgcccccccggtcaatgataaggaaacgaaattcatcacaaaccgaaaggctcaccattcgcgaagctctggaacaaggagagagccagtatccacatgcccctgccgctccccggcctcccgcgagcgacgcgccggcctcgccccccgcgctccgcccggcccggctccgctcgccgctcggcacctgcccgggggccgccgcccgcccgccgcccgccgccgccgccgccgctgcctagccgcccgggcacgcggcgcggccgggctccggagcgagggctgcgctcgccgcgcgctgcgctcctgcacacctgctcccgggcgccgcgccccacgctgcggccggagcccaggtgcgccgtcagctcagtgggcccccggcaggtcggcaggtggagagagccgcagacgcgggcgtgagctcatcccgggcactcggcgcccagaatgcgcagccagcggcctcccgtgcgccagccctcaccctccgcatccaggcagcaggcgggcgggcaggctcatctttgccgtgctccggcctcagtca

SEQ ID NO: 1431 - DNA, 116398 bp, Homo sapiens; identical to SEQ ID NO: 972

SEQ ID NO: 1432 - DNA, 109070 bp, Homo sapiens; identical to SEQ ID NO: 973

SEQ ID NO: 1433 - DNA, 109070 bp, Homo sapiens; identical to SEQ ID NO: 973

SEQ ID NO: 1434 - DNA, 16476 bp, Homo sapiens
tcaaattccagctcaagtttatttttaaggattagttgagcaagtttggagttggaagtgagagaatcgtgtttaaaggaaagggtaggtcatccacagaacagctttcagtcattacaaaaaaaaaatacttcttgcttttatattaccatcttcccccattaggcctacctgcatactgtgcttcatcaaatctaagatcacctcacaactataccattattttaggcaccactaaaagacagtgtattgctaacaaaactatgataaaccattgataatatatccagatttcagagatgttacagtgcatcttagttgatgaaacaaaaatatacaaaacatgagacacagtaaaaatgataagtaccacctcattataccttttcacaagcaaatagtggccaaagatgtgaacggccagacacggtagccgacatatgtaatcccagatactctggaggctgaggcagaggatcacttgagctcaggagtttgagaccggcttgggcaatatagtaagaccccacagaaaaatgtaaagccaggtgtgatggcacacacctgtagttccagctactggggaggctgaggcaggagggatggcttgaacccaggaactggaggatgcagtgagctatgatcacaccactggactccagcctgggtgatggagtgggacagtgtctctttaaaaaatgtgggccaggtgcagtggctcgcacctgtcatccaagcactttgggaggctgaggtgggaggatcacttgagcctaggagttaagagaccagcctgggcaacatagactccacacaaaaaatttttttaattagctgggtgtggtggcatgcacctatagtcccagccacatgggaggctgaggtggaaggatcatttgagcccaggagattgaagcggcagtgtgtggtgattgtgcccctgcgctctagcctgggcaacagcgagaccttgtctcaacaacaacaacaacaaaaggctatctattgtgggtacactgcctatggggtagtcctgctccacaaggagcagtttttaaaaaaaaaaagtttaagaagtgttttatgtagcacttttttcatatttacatttactcaccatatggcttcaaaaatcataaacatactcaactaaaattacagatcaccattgtcctcaatgacacaatttttgtatggtgtaccttacctgtaattctatttcctatgggaggatttaagagatatcttaggaacactatttaaagggatttactgaagtgccaaccttgtgaatgattttacctcaaattgttcagtggtaagaaaggtaataaagcatttagttgtgcctttaagtaggctaattttttttgttttgttttgagatggagtctctctctgtcgccaggctggagtgcagtggtgtgatctcagctcactgcaacctttgcctcccgggttcaagcgattctctcgcctcagcttcctgagtagctgggattacaggcgcatgccaccacgtctggctaatttttcttttttttagtagagacagggtttcaccattttggtcaggctggtctcaaactcctgaccttgtgatctgcccacctcagcctcccaaagtgctgggattacaggcgtgagccactgcacccggccttaccaggctaatttttaaaaacatgcgtttttaattaccaggatttacctgataaaactactctttgtcaaggttgtaggacttctgaaaagacagaactagctttgttgcgtttcacgaaggacagatcagttcgtctgtataggctataagcaggtaagtagtgcactctattggtgaaggatttctgttgttttggaaagccaactatagctggctgcatggagggaaatccaaaatccagatgacgtggtgtgagtcaatgggatgagaaacactggtattttctttacaatttcattttacaaagagcacattaaactaaaattttatgaattatgacttaatctaatagttcaacagcagactcaagaaaagcacagatgtgattctaacagaagactactcatataaacaggtttaatgcaacatggaatgcaaaagattagaaccattaaaatatttaattcttcaactttaaaaaattaaataaaatcaaaataggataatgaccagaatagtgccattataatcacatcaaaaagcttccattaacattttatgaatttggcaatctagtacaatacattaagtattgtgtttcactcaattttgtgatactccatttttgaaaaaacttagaggcttcagatacccatgaaaagaaaaaaatcagggtagaaacacataggctgaggtttgctaattcactgtttacagaggaccttagatgtcccactataattgctcttaggtatttttaacaaatgaatagtcataattcacagaaaagacaagtggtactttttatctacatagactatactatataaactttcagtaaaacatttaaattgttttacttttaatcttgtcaagtaattttcatttcttctacttcaaaaggttgaccaggttgtttgcctgtattgggatcaacgaatgttggactatactatgtttagttataataactaatttatccaccctgacttaatatgtgggaaacaatacacccctaagtgtattgagatgtttctttgaaacaaaaatatttaattttatgcatgtgataaacagccttattcaatgtatactttttttaaatgagcaacacagatagcagacatataactccttattacccatactcttgactaccaagaaaggaagccaaacttttagaaaaatacaatgcaagaaaagattcaagttaaaaatatattcctttggttaaaaatcatcccctttataatattcatttgtaatctaaattcacagcatgtcccaccagcccaaagtaatcttctaaatgtcattatacttgtagtattacaatgttttttcagtccagtatttatggaggtcactcggctgcagcaacaaaatatttcaactctaggaagagtgtagccttgtagcattagcccctttgacaattttcttacaagatttttactttagaaacctccgacacatgtagttttcttcagatacagtatatccaaactttttatagaaaccaacattttgtggtagacattcaagggtaatcttgtaacagttcagtttcttgcttagcaaagtaagggttgataataacctgaaatttaaaaagggggtagggtgaggagatagcatttattaataaaaattgattctagtaacaatatgaattaatgttataaaacttaagtttccttagaaacaggtttagattatggcttttcccactgcattcatgtaagttgataagcatttaaatcaccaaagcatttttacttagagtcaaatatacttttatctagtaatctccagctcactaataaacaggacaaatacaaaactcaccctaagccctctttaaaaatgaaatttaaggctaggtgcagtgactcatacctgtaatcctagcactctgggaagccgaggcaggcgatcgctagagcccaggggtttgacaccagcctgggaaacacggcaaaaccccatctctacaaaatataaaaattagtagggcatgatggcacatgcctaaagtcgcagctactccagaggctgaggggggaagatcacctgagcccagagaggtcaaggctgcggtgagtagtgattgtgccactgcactccagcctgggcaacagagtgagtctctgtcttgaaaaagaaaaacgaattttaagatgcatgttaacactaaaaactcaacctttaaaaaaaaaaatgaccaaaattattttgtaaaaattctttatttaaatctatttaaacaacttcggagcagtcgacatacccacataaaatgagtacataatagctttgctctttaatcatttttaaagctactttaatatttgtgaaggtgtgtatcagattaactcaagattggtctaattaatatgaagtggaaacaaagcaagtctacatctatacaaaatttcttaatgaatccaaacccagtattaaagtgtggatctaagtgccttagaggataaaaactataaaagatatacaaacttgaagggtctgcccatgtttgaacagactaaaaaatcctatttttaaaaaaaacaaaagaccttgactgaagtatgcctggctggttgcagtggctcatgcctgtaattccagcactttaggaggccaaggatcacttgagtccagaagttcgagactagccaaagcaacatagcaaaaccctatctctataaaaaattagctgggtgcagcggcatgcacctgtagtcccagctacttgggaggctgaggcgagaggctcacttgagccccagaaattcaaggctgcagtgagctgtgatcgtaccactgtatactccagcctgggcaacagaaagagatcccatctcttaaaaaaaaaaaaaaaaaaaaaaaaaacataaattatatagactagaacacaagaaatcggtctgttttgttcactgaggtattccaaatacctagaatagcatctggtacataagcaggtatttaatatttgttaattccttaaaactcagaagagttagtgttaaaaagcaagttcttgggccaggcacagtggctcccacctgtaatcccagcactttgggaggccaaggcaggagcactgtttgagaccagcctgagcaacatgatgaggccccatctctacaaatttttaaaaattagccaggtgtggcgtgtacctgtagtcccagctaattggggggctgaagaggattgcttgagcccaggaggctgaggctgcagtgagctgagattgagccactgcacctcagcctgggtgacagagctgtcaaaaacagaccctgtctcaaaaactaaaaattataataaataagaactacaagttcttataaaatggcaataaatcaataccacttatttatatttattttaaatgatttagatatatacagtgaaggctgtttcagtatgtatttctacaacttatgagaatgagagatcacagaatattctgtaatagttgaacatttcctttgtttttaaatatgacagagaagctgaggcaaatccgattagcccaaaagtttatctcctactaggacgagagcattactataaaaagttagtaatttaaagatgttactgtctgtaaagaagtatgcttccaattttcaaactttaaggcaaaatatgtataataatactttatttcttcatgaaattcagtctaaactattagagtgagaataagttcagaattaatgaagccaaaaagaacttcaaacaagtatcttgttaagaaactaaattggaacaaaatttatccagggttaccttgtttctgcctacttacaatttgccaagctgctttcctctgcattcatcactaacaacaacatcttctactcttcctctctgaaaatatttacaatgtttaaaggagtaagcatttacttttgtttttagctaaaacgagttggtaagaatttactgataataagtagtatattttgtaaacttgaacttaacagaaatcaaatgcaaaaaatattatacagtgaaggctgtttcagtatgtatttctacaacttatgagaaggagagatcatagaatattctgtaatagctgaacatttcctttgtttttaaatatgacagagaagctggggcaaatctgattagcccaaaagtttgtttcctactagtatgagagtactactattaaaagttaataatttaaagatgtttttacttattagaggaaatagtatgagtcaagttgtgacctaaacttgttttggctatgtccccaaccttcccaccccattgtctttaaacaaatatcaggatcaacatcaccaaaatgtaaccttttcatgaatatatccatcattctactccttgcttactagcaagttattttagatatccaaataaaattaatgtctagtacagaaaccccaccgaaattcctaagtgtgacagaacacatcccaagtgttcctaccttattctcattgaattaaggttttctctccctctttttttatttactattttatgtgagttattgagggatgaaagggcactacatgcattagatgtatcataattagaacggaataatctgaaccctttaccatgtggaaacaaatttatgctaacgtggtatattcagagttgttttttttaaaagagtaacattagggattttgtgcattactgctaagttgtttggtttctctatgcctataccaaattgatccaccttacagaacaattttagcatacaattcatactgttatacattttctttcttaaagctctcagaacacactgggaaaagggatttctaagaggcactgaaaatcaatgagaaaacagatttgtctaatggaaactcaaagtcagttgtgctagaaaacagctgtccattttatttataagcagcacataccttagcacaggaatggatgaatttatgttctataatcagagttgccgtagcaacaatctgtcctagagtcacatcttctacaactgtaacataataatccccagatttcttcatatgctcaaaagattctgtggaaattggataacaaagtgttacatagtagacattcaattttatggggagccagaaaaatattaggattagctgacttaattactaaatgtttaaagctgttttaccatagtaatttaccttccatttctaaagaaaatattaccaagtagttgaaatatcagcaattagtatcaattggaatataacctacacattcaaaatatctgctagcaaaataaagactaatatagctattttagatgaacaacacttaaaatacaagtaaatggctgatgttgccacttccatgactaatgaaaacttcaatttcttcatttactttaaatagatctctttaacttttatactcaatagatattcaaatataacctttgcacattttaacaagagcatgtttacatggctcaattctagaatttttagtcttttgctttcaaaatatttttacaaaatatattttaattttccctttgtgatggaaagtgttttgtgataacatgacttgctcttgtttgctttgagagcaccttgcaaggaagtaaaaacatatctgtttccaagtaacttttccaagtcacatagcaaataggtgcaaagatacttcccctcaaatggattttcagtactattgctgaaataacatggtttctcatctaattcatgtgcatgcaaagaaaaattcaggaataaaaattgaggctaatagtctctcatattgttaatttctatggtctcattccagatagagatctaaaatgggaaaaagaaattcagtgaatgaaaataaacaatgagaatcagaatgatggtcctcattctcaggagggtcaaatagaattcaatacaaaattccctattataaggaaatgaagaattgtaattcctcagctattaaatattactaaatatttagtaatgataataatacttcatttcctttataacaggaaaaagcagtggtagagcactggacagaattaaggttttattcctcaccgtagcaataactacctgtgatcttgggcaagtctttggatctctctaaattcctattttctcctatgtctaaaagaagaggggcaggggacgggtggactaactcttaagatgcctgctaaccttaaacttcaatacaaataaaccccaaaataaatttaaagcgtatagtcttgcttttttgatttggtaatgaaatttctgtaaataaccacagtaagggaaatactacaataaaaaaacgaaaaacctctagagctaacacctaggtcctatggtacaataattatctaataaagtagtcagatagtttgcaaaaacaaagttactggtacatttggattctagaacaactcagccacattaaacatttgtataaaacagctaatttgttctttgaataatttccagctatttgaacaaaaacagaagtgggcactgaacagctctaaacaaaaatgaaatcatgtttccctttatttcaggaaaaagaggttatagtacttactcataaattgttcagggctgacaactccagtctctgttagctgacccaataccttaaaaaaacctagttttgaaaaacagatttcaaattacgagaatagcaaaaggaagacagtatgaaaataagcaatatattaagcaggtgggcttacaggcaattattttttcagaactttctataatcttttaattattagaataaagtgaaccctattcttctataatcactacatataacaaaaataacaggttttaccagtgcttctgcctgcataagatgttttaaatagtgctgaccttaatatccagtatttatagacccagaacatacattcttcaatgtattatattttacattaagttcaatgcaaagggtgccagattttcccaaatatgtgatttggttttacttaaaggtgcaacatggctaaatacaatattcgtaaattaaagtataagtaacactgttgagattacactctttaaaattgtaatttctagtgaatttcattagtgttaccggaaattgatgtgaacagtgcacctggaattttgaaaatcttaactttcctacactcaataattaggccaaaattaggcccttcaggctgtctagcaaagagataattgtgaaaaggacaaagttgacttttaattaccaaagtttaaggaagttaacttggagaatttagatgttaaaaaagaaataactgtataaaaaccctttcaatttatccaaggaaaattatttccaccttcattccccaaccagcttcttaagatccctccttatgtgtcatcatacatgataatttaatttttgtttatgagaaatctttttggcttaattaggaaggagtgatgttgtatttaagtcattttaaatatttcacagtaatatttggtcttagccatgacacacactcattggtattgagtgtccatcactttaaaaactaagtattatacaaaaaatagtccaaaagtcaaatatttaaaaaaaattatctgcatcataatgtttagagaaaaatggaaggctaactctaattttacacaggattttgtacattacctctatttaagtcagcagtacaaagaggcctcaaaaccaagccttctccaggatgtgttggggaaatggctggagaaaatgtagctgtattctgactccagtccacttctttgagtagacttgggtcaaacataggagtttcatcaggtttcatttttctagtaaggtctaaaataaaaatttgaatattaagtcactttatttaatagaaggaaaattatgattgttgagaaagttaatataaattaatgcaattagaagcattctttagcacatatgcgagatattttactgcaacccagcctgaatctaacattaaattccacaactacagataaatagaaaaatcatgcctactatcagataaaaaaatggctaagtgactaaattagtaagttttaaactataaaatcccatttattatcaagtctttttttttttttttttttcagacagtctcactctgttgcccaggctggagtgcagaggcgtgatcccggctcactgcaacctctgccttctgggttcaagtgattctcctctttcagcctcctgagtatctgggattataggcacgtgacaccacgcccggctaatttttttgtatttttaatagagacgggatttcgccgtgttagccaggctggtctcaaactcccgacctcaggtgatctgcccgcctcggcctcccaaagtgctgggattacaggcgtgagccactgcgcccggctattatcaggtcttttaaaacatgtttttcctctgggttggtgctactaaatgaatagctgacttttcatgggctcttaaattttttacattatgttcttggattttattattgagccaagaaggcatctgtttcaacaggaaattgcaaggggaaaaaaattttttttaaaaaagtaatctcttagtcttacttgccaataaagaaaactttcagctgtgcacggtggctcacacctgtaataccaacactttgggaggccgaggtgggcagatcacctgaggtcgggagttcgagaccagcctgaccaacatggagaaacccccatctctactaaaaatacaaaattagtcgggcgtggtggcgcatgcctgtaatcccagctactcgggaggctgaggcaggagaatcgcctcagaacctgggaggcagaggttgtggtgagttgagattgcgccattgcactccagcctgggcaatgtaagagtgaaattccctctcaaaaaacttactgggcatgtagcctttttttttttttgagatggagtttcgctcttattgcccaggctggagtgcaatgatgtgatcttggctcaccacaacctccgcctcccaggtttaagcaattctcctgcctcagccttctgagtagctgggattacaggcacctgccaccacgcccagctagttttttttgtatttttagtagagacggagtttcgccatgtcagccaggctggtctcaaattcctgacctcgggtgattcgcctgcctcagcctcccaaagtgctgggattacaggtgtgagccaccatgtctagccacatgtagctttttttttttttttcaatgaaccatgaatagaagaaaattgatgaacaggctcaaattaatttttttttttggcattctcagaaatactttaccttggctatgctagatatacactgcaggattttgttttcacagcagattttctaaaaatctgtggtatggaccaggcatggtggctcgtgcctttaatcccagcactttgagaggcagaggcaggtagatcaccagaggtcaggaggtcaagaccggcctgaccaacatggcgaaaccctgtctctactacaaatacaaaattagccaggtgtggtggtggccacctgtaatcccagctacttgggaggctgaggcaggagaatcacttgaacccaggaggtggaggctgcagtgagctgagatcacaccattgcgttccagcctgggcaacaagagtgaaactccgtctcaaaaaaattaaattaaaattaaactgtatagtgtttctcagttgcatctaagcagcttaaaaatagctggtgtttttcatgctattgaaaagtgatcatgatatttccccctcttttttgaacatttagaaatgagcaggttctcactagttgtaatgttttaaaactgagactaaataacagagaagtaacgataggaaggatgaaaaacaaatcatacaaagcataaaactggggccagggggcttctgtgcagcacagaattgctaaaagaaacagatgcttcccaacaattaaaagttgagtattccttatccaaaatgcttgggaccagaaatgtttcaggttttggattttttttttttttttttttttttttttttttcagatttggggatatttgcatatacataatgagatatcttggggatgggacccaagtcaaaattcatttgtgtttcatatacatcttatacagatagcacaaatattttacacaatattttaaataattttgtgcatggaaaagtttttgtacattataccagatgtggaattttccacttgtggcatcatgttggccctcaataaagtttcaaattttggagtgttttggatttttggattagagatccaaaaaaagcagtccccaacttatttctatatccagttaaagaaaccatattttaatgagagaacaatttgcccaataacctaacccccaattgttccttatttcataagtcacagtatgctttagggcaaatattcttaacttttccttaaagatggataataagtttctgcctgtataatcctatgtaactatataagcaatgctgcaatatactagttatgggaaggtagtgtgatgtgatgtaacaacagaagttaacacttgctcagcacttcttatgtgccagactgttgaaagagctttactaattcatttatttcaaccatcctacaggttaggagtggttattatctacattttaacagatgagaaaatgttaagtaacttgcccaaggtcacaaaattagcggagccaggatttaaacctaggcatagaaagagcatgagctttggattcatacctggtgttcaaatgtcaactgtgtgatatgtactacggtaattaagcttttagaatctagtttcctcatttgtaaaatggagatgaaattactgggagaattaaatgcattactgtatgcagtcatgcacttagcagtgcctggaatactgcaagtacttaataagatatatgctagttagcaataaatttaaaattaaagtttataaattcttgttcatttttttttacctttaattcatgaatcaggcactgtgctggttacaggaactacaaaaagaatgacaggctcttacgtttatgttataccaaaagttagcattcttgggtagaaaagaacgtagtttataatgtagactgctgagaggtccccccagccacacacacacaaaatgattcaaattatgctgcatacactatacccagttctaacaatattaaggaaaatatagaaattgtgatgatcaagcagtcatttcaaatttaacaagtttaatagccattcaaaataggttttttgttttgttttattgttttgagacagggttttactctgttgcccaggctggagtgcagtggtgcaatcatagctcactgcagcctcaaactcctgggctcaagtgatcctcctacctcagcttcccacatcagcctccagagtagttgtgactacaggctcataccaccacgcctggctaatttttgtatttttagtagagatggggctttgccatgttggaaaggctggtcttgaactcctgacctcaagtgatcctccagcctcagcctcccaaagttctggaattacaagtgtgaaccagcatgctcagccaaaacaagtttttaatagatgaaattgagtccacgtgttttagtgttttgtctaaattggacccttgaggtttttgtgtgtaatctcatctgaatggtaggtagcaacattgtttttcaggtatgtagataaacaggctaagtattaataaagtgaaatgtgtacagtattaaaaatgtaaattcctcgaggcagcacactatttaaacattttggtcttgctattaaacatatagttgtaaatacaaagttcaaagaaaactcaaaagagaatttaaatcaaccttaaccacatttaactagattcctttttcctataaagttgtctgtgtttacaataaaaatgtggtctagaaaacatgaaaaatagggttaataattttcatgagagggaagaagtatacaggaaaacaactaggattatgaagcccttaaataatgaattttaaccaggaaatactaatattttcttgtacttttctttgatgagacagtccttttccacgaatgatcataaaaataaataatattggctaacacttattgaaaactttctatatgttaactcttaaaaatacaatgaacgatgtatcattattatcccaattttacagataaggaagcaggcacagtaacttgctcaaggttagagtgccaataagaacagagtgaggattcaaaatgaggcaacagggccagcttcagaagcccctgacctgtgccgttacacagggccctgcacttaagtttgataccctgctgccactgttttgaagttcttaattttttaacaaggaaccctgcattttaatttggattaccacagattacgtagccagtcctgctaggtagtatgacttcagactctgctcttaaccattacactgaagatgcactagagtagataaattccctatcttactgttgtacaagggttaaaaattaagtcataagcagcacttagaacctacatttggaaaatgggaatcagactagtcaaaatacattaaacaaagcattacagattgaaataagaatctattaaccaggcaatcagaaattaacatcaaaaatttttttatgagctattctacaaaacagagccatactgaaggcccactttagctcactctgtcctcaaaccgtaaaattctgctggtgcccaactaaggtactgggcaaagtgaagcaagatatgacttgaaacctggttccaagggggtttagaacataattaaataagtaattttatataaataatcttttagcatcttcaggtgcccagatattgcaaaactaggaaatttctgcgaataaaattgcacagttgtgtgaagcggaatctcatcatatcattaggttctttaaagtttttagatgaactttaaacactaatcctccttaagtattcctcagaaccttttctgattaactgctaaattagcaggcgtttagaagacccgtttaagcctaaccctagcccaataatgcctagtgaatgaataacgaataagacttacctgtaggtcacatttcagaaaatccagaaggacaaaaaaaaaaaaaaaaaaaaaaattcccaaactgccacaatatcgcggaaagcatacaccaaattcatttttactagtcatcacatcagttgaatattttttcactcaattgaatattttttaaacaaaacttcaactatttggcgtctgagcctctgtatcaggttggaatacgaatggggagagaggctgctgctagaagcaaccaacggagagcaacaagtaatagacaccggagatgaagattttaaaagtcgatctacaaattttaaaaaatacaatctaaggccaaatctaaaccagcctatgtatttctcaagagctcctggggaaccttctaagtacaggtgaatgggggaggggcggacttcggattcctttatattcattttataacaatttcgataacaagaatccattctgaatctattccgttaaagatttttaacacacctggccatatttattaaattgtgtaactgcatgaatgttcaaaagtattttctgatagtttgacctttacaatctaggcgttattcccagtctaccgatgaggaagctggagcacctggaactcccaagacttgccccttaggtaacacagcaagtaagtgacttggggctagaatcctcgttttcgcatcttgagctcgattaccatcctcaacagaccccaatctttacatcatcataccatacagctagcgctctctcccctatttagcaaatcctgcctaaattaatttcttaagatccattctaggattcgttcatgagggattatcctaacaaaacgaatcctataatcgcccgttcaattttgtatgaaaattttaaattagtttggcttacataaacatcagctcccgcaacagaaatcacagtacagtactcggtatttctaggggtaggagcctaggaaaaagagacaaagaatgtccctctgtaccctggggaaagcgccgacctactcggtgcggaggtggtcttcggagcagctgcctcaatggctccgaccaccgtgggatgcgcccgggaatgggagaagagaaggggcctgggacgttcgtgcccattcaaaaccgatggctgcagagagcgcgaccaactgtctcatttcccacgccaaagtctggggagcgaagttccgaccccagtcccagttccagccctgccaggccaagaccagcgtatggccggaccgctggccatcatccttaacctctgctccaggcgcgcgtgcgttcaacttcctgggaaccgcgctccacaccatgtgcacccagctggcgaggattaacgcccagctcctccacacaacacccccgggggcctggccggggcaccagacacacctgttagataaacctgagggcaggcccgccccagcccccaggacacacggtcctgctctcgcgccccggccccggtccctcctcacccgtagaggccctgcggtcggcgctcctagccaggcgcgtcggactctcccccaccagtgtgcacagcaccggatccggatccggcttcagcgccagccccacctcctcctccaccgcccgcgccacagttgggaaccgcggcccagacgtggcagcgccaacgcctccacctcgcctctgccccctcacgcagggccgcgcgcaggcgagcggaggcggaggccaaggcgccacccgccc

SEQ ID NO: 1435 - DNA, 82391 bp, Homo sapiens
acaacgcgctccctgcggggcgggcggcaacctccatgcggcctcgtccacgctcagcaccggggaagccgaggcggagaagccgcgcgcgcctcagaagctcccggacgcccaggtacgtgggagcactccacagatggcgcaagtacggttgggccaggcggttgcggccccgtcgcgccgcggcctctgtgacgcacggcgaggcctcccgggctgctgcgcggcgcagcgggggcggggcgagcgcgtgagggcggggcggtggggggggggggcggagcgagaggggcggagccggcagaggccccgccccggggccggaggagcgaggacgctacggagcaggcgcgtctcgctgccgccgctgccgccgccgccgctcgctcttctgtggagccgccgccgccgccgccgccatttgcacggggaccccagtgacaggggctcggcggaggggcggaggggcggagggagggggggagggcccgcggagcccccgagggcgggagcgacgccgccggcgccggccgggctccctgcgcgaccgcgccgcccgcggcgggccccgagcagcagcagcagcagcagcggcagcagcggcagcagcagcagcagccgaggccgggcgtgcgcctgaggcggcggcggcggcggccctgcgggcggccgggaggggcgggggcagcggccgccgccgtttgatggatccgaggatcgcctggtttcagccagagcagctcggaccgtccaacagtctgtggatgcagatctgggagacgacccaggggctgaggaacctctacttcaaccaccactgtcacagcagcggcggcgcgagcggcggcggcggcagcagcagcagcagcagcacggccaccggcgggagcggcagcagcaccggcagccccggcggcgcggcctcggccccggccccggccccggccggcatgtatcgctccggggagcgcctgctgggcagccacgcgctgcccgcggagcagcgggacttcctgcccctagagacgaccaacaacaacaacaaccaccaccagcccggggcctgggcccgccgggcgggctcctcggcgtcctcgcctccctcggcgtcctcgtccccgcacccttcggccgccgtccccgccgccgatccagccgattcggcctcgggcagcagcaacaagaggaagcgcgacaacaaggccagcacgtatggactcaactacagcctgctgcagcccagcggagggcgggccgcggggggcggccgagcagacggcggcggggtcgtgtacagcgggaccccgtggaaacggaggaactacaaccagggagtcgtggggtgagtgctggctctgcggcccgatggcctggccggtgcgaatgcgcagccgggcacacgcccacagaggggggttgtgagggtctaggagcggccacccccacggcctgccttcgctgctgttgcacgggggtgctgctggccatccccaaccccccagtcgttcacacctttccccaagcctccttagccgtccacaccctccgtctcctgtcctcccttagtcgtccacaccttcctcccctccctcttaaccgtccacaccttccccaggcccccccctttatccattcactctcctcccatcccccttagttaaacacatctacccttgaccaccaccccgcctccagccctccacacctttttccccatcatcacaactcaagatgagaccgcttagcacgggcctatcattcattccctgagaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatggtccgcggctccagcttctcactgtaaagttgtcatcctggcagaggcagccaatgcttttcattctagggggtagagatttatgctaatgagtgaatattgcaccactagtgactttctgtttaaagttcagctcttagaaaatggaatcttacctgacccctagtgaattatgtacataagcagggaatgtttccaactagatctcccttcagaagagtccctgtgctggaataggtcactgaatcttatttgttttgtaaaacaaagcttttgggtctcgtgggtgtgtgtgtgtgtgtgtgtgtgtgtgtgtgtgtgtgtgtagcttgagtatggagaaccggctttcaaattgcttttcatttttcaggttgtgttttacattgagggctttagcatgcaaatgaaattaccaattagtaatcccatgtgaaccttttcctggatttattcattcagatctgccctgctttggctgagagagagagttctgtgtacctttttgaaggtctggataaaatgagttggtgggttccatctgcttccagtgggctggtgtctgctctatgctactattacaactcctaccttttgtggaaaatgcagtcaagcgttctaggactggtgctgtggtacatgtcaaacctgccctcacattccagaaagggaacccttttagggttgagtcctctgttgctaagcttcaagggtgctctccatggtcatcacgttttattaaaggcttgtggttccatcctgttagcatttccaagtctacgcgtaaacctgtggtttagtgacaagcaaattgatgttgagggtttctggtagtttcatttcacaggagtaagctccagttaggtaatcactgtcaacgaaaaccttgaagttccttaattgcattttactgaagcctctttgcatgtgtctagcaaaagatataagtccaagatgcttattttttttttgataaattagaaattgtcctctcctctacttgctatttaatgcagaagatactctaaaaggttcatatttatacttagaagcaagatgttcttgttcctgattcaaatatattgccctcaaagggattaggagaggaattttcatttcccggagggattactgtttaaaaactggttgtaaacctctttaaaaactgcttatcacttcaccagattttccattcttttgcctcctcccttagaggatgtcagcagttaattttttttttaaattaaaaaaagttcaattctgagacctcctagtttcaaaaaatacattaaacaattcccaagagtgttaagagtgtctgggtgcttagaaattcttgctttgattcatgtattctgattttttttttttttttgagacggagtttcgctcttgttgcccaggctggagtgcagtggctcgatctcagctcaccgcaacctctgcctcccaggttcaagcgattctgctgcctcagcctcccgagtagctgggattacaggcgcttgccaccacgcctggctaattttttatttttagtagagacggggtttcttcatgttggtcaggctggtctcgaactcctgacctcaggtgatctgcccgtcttggcctcccaaaggactgggattacaggcatgagccaccgtgcccggcctcattatcctgatttcttttttttcttttgagactgggtctcactctgctgcctaggctggagtggagtgacgtgatcatagctcactgtatcctctaactcttgggctcaagtgatcctcctgccttagcttcctggagtagctgggactacaggcacatgtcaccacacctgcctaatttttttatttttactttttgtagagatggggcctccatttgttgcctaggctggtcttcaaccggcctcaagcagtcctcccaccttggcctcacagagtgctgggattataggcatgagccaccattctcgccagtatccttatttcttaactttagaaagtttttctatttttaatataggtatttaaaaaaatctgaattcagagtgcacctcgatgttatgctgttctgagattaaatatactaaaactgttaccattgttttctgaattcttaagatgtgactgatagttagctaataggttaacacattgtggtggttcttggcctctgaactgatagtccagatggggagaggagaccagaaagcatgtgaaaatggactagaaccatgggacagctatatagtctctcgcagctgtcttttgtgttctctgcttccaccaaattggttgatttatttagaatgctgacctcttgcattgcctaagtccttgatgtttttggtttctcctctgaactctcaaaggtactcacttcatgctcttggtatagcccacttatgtttaactttccttttattatgtgttccctcttacacatgacatggacatttctttaatatgtagagtaagatattggatttcatcctaaagtcttcaaaataaaactcttgagctcatcatctcagacttcttcatgtacccacagaccagggattttgtttgctttttaaaacatttttttattttgtgttttattatttttaaattttaatttaattttatggagacagggtctcgctctgttgcccaggctggagtgcagtggtgtgatctcggctcactgcagcctttgcctgggctcaagccatccacatgccttggcctcccagtgtgctgggattacaggtgtgagccactgtgcctggcctaaatttatttttttaattttttttgagacagggtcttgctctgtcgctcaggctggagtgcagtgtcataatcatgggtcacagcagccttggcctcccaggctgaagtgaacttcccacctcagcctcctgagtagttgggactacaggcgagtgccaccatgcctggctcattttggttttttttgtaaagatggggtcttgtcatgttgcccatgaaggtctccaactcctggtccaagtgatcctcccgcctccgcctagcaaaatgttgggattacaggtgtgagccaccatgcctggccttatttatttatttaattatgaatgaatgaatgaattaatgagagggagtcttgctctcttgcccaggctggagtgtggtggcacaatcttggcccactgcaacctccgtctcccaggttcgagcaattctcctgcctcagcctcccgagtaactgggattacaggcgcccgccaccatgcccaggtaatttttgtatttttagtagagatggggtctcaccatgttggccagactggtttcgaacttctgacctcaagtgatctgcccaccttggcttcccaaagtgtcaggattacaggcatgagccaccatgcctggcctggccttttatgttttaagttgcttccactgattctcttgggctttgctcccctccagaactggccatggtttaggatgctgtccacctgctgctgcttgtccatgaaaacgagccataaacccttttcttttgaaagacttaattgtttatcactatggagaaagaggggatggcaagaagtagcaaatacagggaatttgcagaacttggtcttgagccctgggtccagaaacttcttctggaaggtgcttggtgtttgtccaagctcatgataggtttctgttggctgtactgccagatctgtagatgcttttttaaggcttggatgacttgttcaaaacaatgttttggagtacaaatttggctgtggggacatcaagaccttgttgggaaacttgggtttaaggtacaatttcttaaactaggatggtgggaatggggatgtgaagggagaatgaatgtgagaggtattacagggtaaggatggagatgattcagattccttaagtggatttaataatcacactgtagctttgaacttgagtgactggggaaatatttgtggtgtttttggaaataagggccagaaggactattggtttgggtaagaagatagtagggggatgtataggtggacctgctagtggggagctgagatttggagggctgagatgtagtgctcttcactgccgtagggcagtatcctcttgtatgtgccatcctctagtgcccattgttcatcatgtcatagtaagcccaagatgttcatgccttttttcagcactgcattagggcttatatctgcttctctttctctctctctctcgctctcgctccctccctctctctctctttctgttttttttttttttttagacggagtttcacttgtgttgcccaggttggagtgcagtggcgcgatcttggctcattgcaacctctgactcccgggttcaagcaattctcctgcctcagcctcccaagtagctgggattacaggcatgtgccaccatgcctaattttgtatctttagtagagatggggtttctccatgttggtcaggctggtgtcaaactcccaacatcaggtgatctacctgcctcggccgcccaaagtgctgggattacaggcatgagccaccgcgcccggcctctctctgcttatttctacacagtgttaccaatgagattggtgttactgctgggctccaaagcaatcagacagattaaagtagattgaatatgaaagaatttagaggcctttttccaagtgatttgtgctctatttaatttctgtgcatttgcagatatagcccacagtaattcttagtgaactagaaccttcaggttattgaattttactgatttgggtactgacatgcgcttttaagaagacattaggttttctatagtgtagattgtacactaacaatataattcatatttaagaatgtctcaaaatttagtatactgtgttcaactaacttaactttctttgttttttttgttttgttttgtttttgttttttgagacggagtcttgctatgccacccaggctggagtgcagtggcgtgatcttggcttactgcaacttcaacactcctgggttcaagtgattttcctgcctcagcctcctgagtagctgggattacaggcacccgccaccacaccggctaatttttgtatttttagtagagacggggtttcgccgtgttggccaggctggtcttggactcctgactcaaatgatctgcctgccttggcctcccacagtgctaggattacagacatgagccactgcgcccggccgctaacttaactttcattccacaacttccatcttttatccaaaatctgtgatcattgaatactgtcaccattaatcattggcatttcagtgtttggactttttttttcccccttcgtctttgtggactcttttttaacactcataaagttttaactattgaaaagcaaaggaaacggtgagtgactttttggagtctgtctacccagtggtcacacaaaaggcttactacattacaggaaagataggatgggaaagggatactagaaaattctaagtcaggaacgggggtgtgtattagaaaaattctgatcctggcatgccagatggccttacatctcaatttcttccgtgaaattcctgccaacaaatcatagtgttagaagtacagaagggtccatgggaacagaatttaagggctccgttggtgatacggaactgatcagatggttctcacttgttctcagataacctgtatactgaatatcacaggaagggtatagacgtcatggcagtggttagatattcttgcacctgctgaagctgagaaaattaaagtaattttttttcctgtggaaagtagaaaatcaagcttttgtatgatttcacacagctttctattctctcttttgttgactctgttaagagtaacatttagtggtggaaactatttcaggatcacacccacaacactagagactgtattaatcacttacacacacataggtatagagtaatcttgaaggggctgtaggccaaagataatgcttttttgaagaattagagactagttaccagcacctggtatttgctgtttcctacagagctgactggacagcctagagtctgctgaggaattcagaggatggccagtagaatgttctttccaccccagaatatttggtagggactcagctgctgtggaatgccaaaaaggctttgagtttgtttcactattcttaagattacacgtaattgtttttttgtaagagattatatatattcaagttgaggatggctttgagttagactttccttaatttggaatcacacagcagatgatacatttatttccatctgataagttacttgatgatgtaaaaagacatttgagttaaagatttttgggaaaaaagctgaatgttgagccatttatgttgtgtactggttccctattcacttggacaattttaagtcttaaaacaatcttaaccatgtgcacaagagatttcacatagtatttggtaattaaattaaggaattctagctcaagtcatgctttttgctgaaatagttgtatatatttagtgcggaaacctgtgttttcaaattaatgtaataaaagtttcaataaaatggaagcctttattaccgtgtttcaaatgctatgctaaaccttttccatttgttattatattaacctcctcatacatagccctactaatttttttactttctattttgaaataattacagatttataggaagttgtgaaaaatagtacagagcccatgttcccttcaccaagtttcacctaatggtagtagctcacataacgataatttaatgtcaagaaccaggaaattgtcatcgttgcaatccataagccttttttagatttcaccagtttcacatgtatttgtgtgtgtgtgtatatatataattgtatgcaattttatcatgtgtagatctggatagccactgtaacagtctatagttctatatacagagctactccatcacctcagggctccctatgctaccactttatagccgcacgcacccttccagcaaccactaatctgtttgcatctctgtaattttgccattttgagaatgttatataaatggaatcatacagaatgtaactttggctttttttcttttaccatacttcctttgagagccatccaaattgctgcatgtatcagtagttcatttctttttactattgagtagtagtccatagtatggctgaaccacacaatttgtttaaccatttacttattgaaggacataccagaagggtggtttccagttttttggctattgcaaataaagctgctataaacattcatgtatataaatatttttatgtgaatataaagttttcattttgggggaataaatgcccaaatgtttggattgtatggtaagtgcatgtttggtttttagagaaactgctgaactatttattttctagaatgactatatcctcttatattcctatcaacaatatatgagatatccagtttctctgcatccttgctagcatttagtgttaccacttttttatttgagcggttctaatatgtgtagtgatagcctgttttgccttatattaatcaataaaaatagcctcatctaatcttaactttttttattttaaaacatcttggcagtattgaactttctcaatgaaaaatctctaaaattgtgacttgaaaggctttaattttccagtttttctttggttttactcttagcagtaacattttaacttttttttgtctttgaagtaattttcagtgtttcctttacatgttgctttttcttagaaactagttactagcatgaagtagatctttagcctcgttttctaaaaacataaaaaagtaaaactgtggggtttatttcaaaattgagagtcctgtcttttcatatgaggatattttatagtctgttggcttggctatattttagggagtaaacctgtggttagtggtttgttgttggtggtggtaaagttttcttacagtatttttatacctgaataatacctttagactctatagaatagatacttgatcttcaaatctatcctagaataaattgttttatctaaacagctttgtgacctgagaattgggacttagtcccttagttttcccttactggccctttgtagtcactgttttgattttgtgaaagtaacttaactcttagcactgtcaggtattgtacattcctgccaaagcaagaataagaatacataggattgtgttttaattctataattaggtgacttttggctaatttccaggaacttggacttaataaagtactagtgataagtttggaaattttagtgtccttgttctttgaagttattcaccctttactttcttgtttgtttggggtgtttatactactgtccctaaatatagctgaaataaaggaagaaaaataacccctgtaatatcactaccaggatataatttcttttttttttttttttttgagatggagtctcgctctgtcgcccaccatctcggctcactgcaagctctgcctcctgggttcacgccattctcctgcctcatcctcccgagtagctgggactacaggcgcccgccaccacacccggcttattttttgtatttttagtagagacggggtttcactgtgttagccaggatggtcttgatctcctgatcttgtgatccacctgcctcggcctcccaaagtactgggattacaggcatgagccaccgcgcccggcctgatataatttctgttaacagtttgatgtaaatattttttgactttttagtgtttttatatatatatatattttatgtttttcttttatcaatacgcactcttactgtgggaataattttaatgtttttaaagagttgggttttatttgtttattttattttatagaaatggggtctcgccgggtgcgatggctcacgcctgtaatcccagtactttgggaggccaaggcaggagcatcacctgaggtcgggagttcgagaccagcctgaccaacatggataaaccgcctctctactaaaaatacaaaattagccgggcgtggtggcacgtgcctgtaattccagctacttgggaggctgaggcaggagaatcacttgaacccggccggtggaggttgcagtgagcaaagattgtgccattgcactccatcctgggcagcaagagtgaaacttcatctcaaaaaaaataaaaaataaaaaagaaagaaagaaagaaatgggatctcaccattttggctggttttgaacttgtggtctcaagcagtcttcctacctcagcatcccaaagtattgggattacaggtgtgagcccatcctgtttgttgttgttcttttgttgttgttgtttttagatgaagtctccctctgtcacccaggctggagtgcagtggcgctatcttggctcactgcaagccccgccacccaagttcaagcaattttctgcctcagcctcccgagtagctgggattacaggcgcccaccaccatacctggctaatttttgtatttttagtggagacgaggtttcaccatattggccaggctagtcttgagctcctgacctcgtgatccacctgcctcggcctcccaaagtgctgggattacaggtgtgagccactgcgcctggcctgttgttgtttaaataaaagaaatttattctcttacagtcgaggccagaacttagaactggttttcaatctaaattttttttcttctttgggagaagggcatcagaatattgtggatatacttttttgacttaaaaaaaaaggttttactgggctgggcatggtggctcacctgggattaactgcctgtaaccttggcactttgggaggctgaggcaggtggatcgcttgagtccaggagttcaagagcagcttgggtgacatggtgaaactccgtctctaccaaaaaaaaaaaattagccaggcatggtgatggcgtgcccttgaagtcccagctacttgggaggcttagctgggaggatcgcttgagaccaagaggcagaggttgcagtgagctaagttcatgccactgcactccagcctgggtgacagagcgagacctcgtctgaaaaatttttttttttttttactaatatgacaaacatcttttcatttcaaatatatttctataccatttttaatatctcattgcctttagaatgaccttgtattcatagtacatatgtatgtgatattccatttatttattttttttcttttgtctttttttggttatattccattgatttaatgtaccttaatttatcttaccaatttcttgttgaccattttgtttccagtcttttgtttttttaccagacatggattaagctgagcctttgccccagacgacattatttcttttttatcagcaaaatatgcgtgtaatgaaattagaattaaaaggcaaaaaaggttatcctttatttttctacttatttttattgagatagtaattcacataccataaatttaacccttttaaagtgtacagttcagtggttttcatatattagaaggttgtacaaccatcgcaactaattccagaacattttcatcaccccagaaagaaactctgaacccattatcactccccactccctcacacaccctaaccctggcagtcacatatagactctctgtctctgtggatttgtttactctggacctttcatataagtggaatcataacagtttgtggccttttgtgcttggcttctcaaacttatctgtttccaaaggttatctgtgtcgtagcatgtgtcagtacttcattcctttttatggctgaatattttattgcatgtatatgccacattttgtttatccattcacctgtagaaggacatttaggttgtttccattttttggctgttatgaatattactgctgtagacgttcatgtacaagtttttatgtgaacgtgttttcatttttcttgggtatatacttaagtgaggaattcctgggtcttaagttaactctctgtttaacattttgaggaactgccaaattattttttaaagtggctgtgacattttatattctaccagcagtgaatgaaatttccaatttctccacatacttgacagcacttttttttttttttttttttgaggtgaagtcttgctttattgcccaggctggagtgcagtagcatgatcttggctcactgcaacctccacctcccaggttcaagcaattcttgtatctctcagcctcccgagtagctgggattacaggcgcatgtcaccatgcctggctaatttttgtattttttatagagacagggttttgccatgttggtcaggctggtcttgaactcctgatttcaagtgatccacctgccttagcctcccagagttctgggattacaggcgtgagccactgcacccagtctgcactttctttattatctgtcttctttattatagccaatctagtgggtatgaagtaagtgtgtcatttgtgattttgattgttagtggtgactaaaaatgttgaatatctttacatgagcttgttggccatgtgcacatctttgttggagaaatatctattcaaatcttttgactattttaaaattgggttatttatctttttattgttgagctataggagttctttattttattttactgagacagggtcttgctctgtcacctaggctggagtgtagtgatgccatcttgactcactgcaacctctgcccccaccccaggctcaagtgatcctcccacctcagtcagcatcccacagctgggaccacaggcgcatgccaccatgcctggctaattttttttttttttttttttttgtattttagtatagacagagtctcaccttattgcccaggctggtctcaaactcctgagctgaagcaatccgcccatctcagcttcccaaagtgctggaattagaggcatgagccactgtgcctggcctattttattttaaagatgaggcctcactttgtcacccaggttggagtgcagtggcgtgatcatagttcactgccattttgccctcctgggctcaaacagtactcacgactcatcttcctgagtagctaggactgcaggcatgtcgctagcatgcccagctaaaacagttctttatattctagatcggggtgtccaatcttttgacttccctgggccacattagaagaagaagaattgtcttgggccacacataaaatacactaacagtaatgacagctgatgagctaaaaaaagaattaccaaaacatctcataatgttttaagaaagtttacaagtttatgttgggccacattcaaagccatcgtgggcctctggccgtgggttggatgagcttgttctaaatgctagacccttatcagatggatggtttgtagatatttatcgcatgctgtgggttttttttttttactttcttttaggtttttttttttcttaaataattaaactgattaaaagctttaatcttttcattttcttgataatgtcttttaaagcacaaagttttgtttcaatgatgtctaatttgtctatttttttttctttggttgcttgtcatacgtaagaaactgttgctaaatccagaatgctgaagatttacttgtgaactttgtttccttctatgagttttatagttttagctcttgtatttaggtctttgatacattttgaggtttttttgttgttgttgagacagtcttgctctgtcgcccaggctggagtgcagtggtgtgatcttggcttactgcaccctctgcctcctcggttcaagcaattctcatgcttcagcacccgagtagctcggattacaggcgtgcaccaccaagcctggctaatttttgtatttttagtaaagagggggcttcaccatgtttgtcaggttggtcttgaactcctgggctcaagcaatcctctcatctcggcctccccaagtgctgggattacaggcatgagccaccacgcccagcctgttttgagttcatttttaaaatatggtgtgaggtagaggtcccatttcattcctttgcctgtgggtatccagttgtcccagaaccatttgttgaaatgactcttgtttcctcattgagcaatgtcgtgagaccctatctccataaaaaataattaaaaaaaaaaaagaatgcagaaggaaacagttttgccaattttgtagtatttactgacaatttgcatatgtctttacattctttagctatttatttttcttttgaattactgcctttgttcatttttcttttggagttgtttgtctttttcttattaatttgtaagagattttgcaaatatatacaatttcttttctcttttttttgagatggagttttgctcttcttgcccaggctggagtgcagtggcatgatcttggcttactgcagcctctgcctcctggtttcaagagattcttctgcctcagcttcctgagtagctgggattacaggtgcccaccaccacacccagctaattttttttttttttttttgtatttttagtagagactcggtttcatcatgttggccagactggtctcaaactcctcacctcagttgatccacccaccttggcctcccaaagtgctgggattacagttgtgagccaccgtgcctggacctcccacattattttgaaacaaattccatatcacataatttcttttttttgagacagagtctcgctctgtcacccaggctggaatgctgtggcgtgacctgtgcttactgtaccttctgcctcctaggttcaagcgattctcctgcctcagtctcctgagtagctgggattacaggcacgcaccaccacacctggctagtttttgtatttttagtagagatggggtttcaacatgttggccaggctggtcttgaactcctggcctcaggtggtccgtccacttcggcctcccaaagtgctgggattacaggcttgagccactgcacccagccaatatcatataatttcatataaatagttctttgtgtatctttagataaggacttaaaagaaggcataatcgtaacaccattattaatacctaaaagaagtgagcaataaataattcatttgccgtatcaaatatccaatgttcatatttcctccattgtcccataataatttttaaaagtttgctcaaatcaaaatccaaacaagattatttcaaagcattgtttgaggtacattttaaatcttaatttatagatttctctgctgtctcttttcccccatatttatttgttgaagaaaccaagcgttgtttcctgtggactttcctactctctggattttgctggttatattcctctggtatcagtttactatgatccctttttcccctgtattttctgtaaatttgtaactagatctagagatttgtttagattttgtgggttttttttttttttttttttttttttgcaaaaatgcatcataaatggtggtgtgtacatctctcagaagacacatatcttaatgtctttttgtggtattagttattaatgattactgcctatatttattaattcattatttggattgtaagtttatgatagtctcttgatgctttttctgttgttagctggaatgcttctaaaaggagaaggctttcctcttcaagctacttggttgtcttgagggtttgcttcttatagggaaagcaggctaagggtgaaaaaggaaatagtttctaactgggtctgttaatgagctgtcaccccaggcaaagagaagcaaggcaggtcacaggaaagtgaagtgggcttgggatgattggtgccccatgcgtgcatgcatgaagggaagttaatcctccctgtagtgaactctactgggcttttggtcagtagccaagactgtcaaggaagacctttgtcagaagccatacctggcctttgcttttagctgttggtagctgaaggaaaccagaacagacctatgacctgtgaacttctgctcagtagacaaagttctctcagcctaaattcagtaagcaggagtaagatgcttgctttcccttgaagtgaaacgtgaattatatgtttcttcaacttgtgctaatattctttttttttttgagatggagtctcacactgtctcccaggctggagtgcagtggtgcaatctccgctcactgcaacctcagcctcccgagtagctgggattacaggcgcctgccaccacgcctggctaattttttgtatttttagcagagatggggtttcactatgttggccaggctggacttgaactcctgacctcacgatctgcctgcctcggtctcccaaagtgctgggattacaggcgtgagccaccacacctgggcaacttgtgctaatattcttaaccttcatgtgaatcattcctgccctcaggctagcataacccatacagccttccttataggaagatttcctactgggagtgaatttgtccagtgattcccccaagatatcccccaatcaaatattttaaaagtcatcatttacatgtaaaaactatgtaacaagcatggtagcagcagcgttaaagaaatggcagtatggcccctgtaagggaaggctccagaagatgagccgcactcagcctctaggtcacagctaccttaggagtttgcagttgttcctggggaagtcagtagacaaagctatctctcaggcctgggcaagatagggattttttttttttctttgagatggagtctcaccctgtcatccaggctggagtgcagcagcatgatctcggttcaccacaacctccacctcctgggttcaagtgattttactgcctcagcctcctgagtagctgggactacaggtgcgggccatcatgcctggctcatttttgtatttttagtagagatggggtttcaccatgttggctaggctagtctcaaactcctgacctcaggtgatccacctgcctcccagagtgctgggattataggcatgagccactgtgcccagtgtttttttttttttaattgtagtgacaggatctcactttgtttcctgggctattcccaaactccaggcctcaagccgtcctcctaccttagcctcccagagtgctggggttacaggtttgacccactgtgcctagtctcagaattcatgtttttaaaagtcactctgtgccaggctcatgcctgtaatcctaatactttgggaggctgaggcaggagggttgcttgagcccaggagtttgagaccagcctggaaaccatagcaaaatcctaactctacaaaaaatacaaaaaatagccaggtgtggtggcatgcacctgtagtcccggttacttgggaggctgaagtgcaaggatcgcttgagcctaggaagttgaggctgcagtgagctgtgatcatgccactgcacaacagcctgggcaacagagtgagaagtaactctggctgtggtggggaaagtggattagtggagaatggaagctgggaaacatggtggttcttgctaagtcagtatcaagggatcacagatgagggggctatttcgtcctaataagggccttggtctcccagatagtcatggatttttctatttagaagctccttctcagtttttcttgcccaaggcatatacggttgatatttgtacaacacaggctggatctgtatgggtccacttatatgtggattttttttcaaccaaacttggattaaaaatatagttgtaggccaggcacagtgacttatgcctgtaagcctagcactttgggagcccaaggcaggcggatcagctgaggtcaggagtttgagaccagcctggccaatgtggtgaaaccatgtgcctactaaaaatacaaaaaatagctgggtgtggtggtgtgcacttgtaatcccagctactcaggaggctgaagccagagaattgcttgaacccgggaggtggaggttgcagtgagctaacgcagcagaggttgcagtgagctaacgcagcagaggttgcagtgagccaacggggtggaggttgcagtgagccaagattgcaccaccacactctagcctgtgtgacagagcaagactctgtctcaaaaataaataaataaaaatacagtgtaggccaggtatagtggctcatgcctataatcccagaactttgagaggccaaggcaggcagatcagttgaagccaggagtttgagaccaacctggctaacatggtagaaccccacctctactaaacagaagtacagaaattaaccaggcataggtggtgcatgcctgtaatcccagctgcttgctaaactgaggcaggagaattgggaggcagaggttgcagtgagctacgattgtgccactggactccagactgggtgacagagcgagactctgtctccaagagaaaaaaaaaaattgtacttacaggacatgaaacccacctgtacggtgtgctgactgggagactggagtatgcatagttcttggtaaacaaggggattcctgaaaccaatcccctgagtatatggagggttgactatatattttaatagaatttattacttttttttttttttttagcagttttaggtttatggaaaaattgagcaggagtacatagtttctctatctccctcacatttccccattactagcatcttgaaatagtgtggtacatttgttacaactgaagagccaaatattgatacattactgttaactaaggtccgtaatttactttagagttcactcttggtgttgcagtttctatgagtgttggcaaatatatcatgacatgtatctagcattatagtatcatattgagtagtttcactgccctaaaaatcccctttgttccaccttttcatccctccatctacctgaacccctgataaccactgatccttttacagtctctatagttttaccttttacagaatgtcatatagttggaatcatacagattggcttctttccatgttccttcctggcttgatagctcttttcttttttttgagatggagtctcgctctcgcccaggctggagtgcagtggcgcaatcttggctcactgcaaactctccgcctcctgggttcaagcaattctcctgtctcagcctcccaagtagcttggactacaggcgcatacctcccctgcctggctaatgtttgtatttttggtaaaggtggggttttaccatattggtcaggctggtctcaaacacctgtcctcaggtgatccacccacctcggcctcccaaagtgctgggattacaggcgtgagccaccctgccctgccagctcttttttttgtactgctgaataatactccattgtataggtgtatgagtttatctattcaccttctgaaggacattttggttgctcctaagttttggcaattatgcatgaagttactataaacatctgtgtgtaggtttttgtgtggtcatgtttttagctcatttggataaataccaaggagcacgattgttggatcgtatggtaagagtatgtttagttttgtaagaaactgccaaactgtctttcagggtgactgtaccattttgcattcccaccagcaatgaatcaagttcctgtcgctccacatcctcgttagcatttggtgttgtcagtgttttggcttttcaccattctaatagatatgtagtgatatcttgtcttactttgcagttctctaatgacgtatgatgttgagcatcttttcatctgcttatttgttgttgttgttgttgtgttgttcattgaaatggaatctcgctctattgcccaggctggagtgcaatggtacaatcttggctcactgcaacctctgcctcctgggttcaagtgattctcctgcctcagctccccaggtagctgggattacaggcgcccgccaccatgcccggctagtttttgtatttttagtagagacaggatttcaccatgttggccaggctggtcttgaactcctgaccttaggtgatctgcccgcctcggcctcccaaagtgctgggattacaggcgtgagccactgcgcctggctttcatctgcttatttgatatgtgtatatgttatttggcaaagtatctgttctgatcttttgcccattttttaatcagattgttcttttattgcttctggggttctttttgtttgctttttttgagacagagtcttgctctgtcgcccagtctggaatgcagtggcatgatctcagctcactgcgacctctgcttcctgggttcaagtgattcttgtgccttagcctcccaaatagctgggattacaagcatgtgccactgcacctggctaatttttgtatttatagtagggacagggttttgccatgttggccaggctggtcttggactcctggtcttcagtgatccacccacctttgcctcccaaagtaatgagattacaggcgtgagccaccatgcccggcttattgttaagttttaagagttctttgtatatgtgtattttttgattcttttaaaattaatacttaataaaataattgtacatatttatgggatgcatgtgatattttgatacatgcatacaatgtggatcaaatcaaggtaattagagtattacctcaaacatttgtcatttctttatgttgggaacatttcaaaatgtctagctattttgaaatatacaataaattattatctataagtcacctcattgtgctgtcaaacattagaacttattctttctacctggctttattttttttaccccttaaccaaccattcttcatcagctccccgtctcccctactctttttttttttttttttttttgatacggagtcgctctgttacccaggctagagtacagtggcacaatctcgactcactgcagcttccgcctcccaggtttaagcaattctctgcctcagcctcccgagtagctgggattacaggcgaatgctaccacacccgactaatttttatatttttagtagagatggggtttcaccatcttagccagactggtcttgaactcttgacctcctgatccacccgcctcagcctcccaaagtgccgggattacaggggtgagccaccatgcctggcccctcttactcttttcttagcctctggtatctatcattctactctctacttctatgagatcaacttttttttagctcccacatatgagtaagaacatgtaatatttctctttctgggtctggcttctttgtatattttggataataagtcttttattagatacgtgttttgcaaatattttttccgagtccgtgacttatcttttcattctcttaaatagtgtcttttgcagagcacacattatacattttagtgcagtccagtttaccaattctttctttgatggattttgcttttggtattgtgtctagaaagtcttcgccaaaccacagtcatctagagttccccttatattatcttacaggagttttatagtttttgttttacatttaggtctgtgatctattttaagttaatttttatgtgaaagatataagatctatgtctggattctctctttttttgagatggagtctcgctttgtcgccaggctgaagtgcagtggcgcgatctcggctcactgcaacctctgactccctggttcaagggattctcctgcctcagcctcccgagtagcacatgacaccacgcccagctaatttttgtattttgagtagagacggggttgcaccatgttggccaggatggtcttgatctcttgacctcgtgatccgcccgcctcagcctcccaaagtgctgagattacaggcatgagccaccacgtccggccagtttttttgttttatttatttatttatttgaaacagggtcttgttctgttgcccaggctgcagtatagtgacaccatcaaggcttcgttgcagccttgacctcctagggtcaagttatcttcttgcttcagcctcctgagtagctgggactacaggtgagcaccactctgaccaggtactttttaaatttattttagagacagggttttaccatgttgcccaggctggtcttgaactcctgggctgaaatgcccctcctaccttggcctcccaaagtgttgggattacagacatgaggcactcagcccagccaatataattcttttttttttttttgagacagtcttactctgttgcccaggctggagtgcagtggcatgatcacagctcactgcaacctctgcctcctggactcaagctgtcctcccacctcagcctcccaagcagctgggattatgggtgcccatgaccacacccagctaagtttttaaatttttttagagattgaatctttctttttctcagcctggtctcaaactcctgagctcatatgatctgcccgcctccgtctcccaaagtgctgcgattacaggcatgaaccactacgcccagcctacaatttatttgtaatccaagttttattgaaaaaaaaatccacatataagtggacatatgtagatccaacctgtgttgttccagtgtcaaccatatataccaataattcttttttttttttttttttttttttttttttgagatggagtcttgctctgtcgcccaggctggagtgcagcggtgcaatctcatctcactgcaacctctgcctcccgggttcaagtaattctcctgcctcagcctcctgagcagctgggactacaggcatgcaccaccacgcccagataatttttgtatttttagtagagatggggtttcaccatattggccaggctggtctcaaactcctgacctcaagtgatccacccgccttggcctcccaaagtgttgggattacaggagtgagccactgtgcctggcctataattctttacgtatattgttagattcagtttgctagtattttatttagcatttgtgtatctgtgttcatgagaggtattgttctgtagttttctttggtttcttttctgtctggtttagggtaatgctggcctcatagaataggttaggaaatatttcctctgcttctgtttctgaaagagaattgaggtaatatctatttttttttttttgagatggaatcttgctctgtcgcctaggctggagtgtagtggcgcaatcttggttcactgcaacctctgcctcccaggttcaagtgattctcctgcctcagtctcctgagtagctagaattacaggcatgcaccaccatgcctggctaatttttgtatttttagtagagatggggtttcactatgtgggccaggctggtcttgaacttctgatctcaggtgatccacctgtcttgtcctcccaatgtgctgggattacaggcgtgagtcactgtgcctggcccgagataatatctaatttaacagtttggtagaattcaccagtgaacccatctgggcctggtgccttttgctttagaaggttattgattattgattcaatttccttaatagataaaggtgcattgagattgtcttttcttcttgggtaagttttaatacattgtgtctttcaagaaattgttccatttcatctaggttatcaaatttgtgggattagagtccttcataatatttctttgttttgcttttggtgtccataggttcagaagtgatggccctttttcattttttctattagtaatttgtgtctttgcccttttttttctttgttaatctggctagaagcttatcaattttgttgatcttttcaaagaaccagtttttggtttcactgatttttctctattaattttgttttcaatttaattgatttctgctctaattggttttcttctgctcactttggatttaattttttttagtttttctagaaaactaagtttttaagtgaaaactgagattattgatttttagatcttttttctaatgtttacagttaacactgtacaatttcctgtaagcactgctttctctatatcttacaaattttgatgtcatattttcattttcatttagttagaaatatctcttgagacttctttgacccatctgttatttagaagtgtattgtttaatctccaagtatgtattttgggatttttctggctatctttctgctgttgatttctagtttaattacatgtggtctgagagcataccttgtatgctttctattcttttcaatttgttaaggtgctctttgtggctcaaggtggtctactttttttttttttttttttttaaagaaaagctggccaggtgcagtggcttatgcctgtactccagcactttgggaggcgtaagtgggaggatcacttgaggtcaggagtttgagaccagcctgggcaacatatagagacttcacttgcacaacaaatttttaaaatattagttgggtatggtggcatatacctgtatatggctgaagtgggaggattgcttgagccctggaggttgaggctacatgagccatgatcgcaccactgtactccagcctgggcaacagagtgaaattttgttctctcttgaaaagaaaaaaaaagttgatgacataaagttcattcatcttttttgtatgtgacttcaaaataactactgatggttaaaaaaaaaatcagaatgatgcaacccaagtgtccatcaatggatgaatagataatatgtggtgtatgaatacaatgggctactattattcagcctttaaaaataagaaaatgctgacactgctgtaacatggatgaacgttcagatcattatgctaaatgagaaaagccagacacaaaaggacaaatattgcatgattgcacttatatgaggtatctggaatataagagtcatagaaacagtaattcagtaattagaataatgcttgccagggcctgtggggaggagggaatgaggaattcatgtttaatgggtacagagtttcatttggaaaagattaaaaagttatggaggtggatggtggtgaggattgcacaacagtgtgaatgtacttaataccactgaactgtacacctaaaaatgattaaaatggtacattttatgttacatatgttttacaacaatttttacagatggaaaaaaattataaaaaacatcaggatggtgttgacagtgaaaaggttaaagagttactttaaaaatttactttattccagccgggtgcggtggctcacacctgtaatcccagcactttgggagaccgaggcgggtggatcacctgaggtcaggagtttgagaccagcctgaccaacatggagaaaccccgtctctactaaaaatacaaaattagccaggtgtggtggcgcatgcctgtaatcccagctacttgggaggctgaggcaggagaatcgcttgaacccgggtggtggaggttgcagtgagccgagatcttgccattgcactccagcctgggcaacaaagcgcaactccgtctcaaaagaaaattttttttttttactttatcccaaatgtttatatttactttggggcttatgtgaccagtttaattttcatttgtaattgacttgatagaacacactaatgttcagttaagatttcttatggtgtggtgaggagtaggatttttatgtaaataagcccaaaattgtatatatgaggttaatctgatatttgcagaagatattcatgcattactgtaaggaccactctgcttattcatttgaccgatttgttacaacatggttagaaatcatcaaggtgtttgagatcaaaggatcttcagaggtgatttactccaatccttttttaaaaaattaataacttgagcctcagagaagttaagtgacattaccaagttctgctgttagtatagtgactttatctttacctgaatccagggtttcttagccctagtctgtaatgtgtcctagtgtgcctctagaatctggtcctgtcagcccaagtctgttaaatcaaataaaaccagggcttggtgcttcaccttgtcttctgccataccgttgggtttcctgtggaccatgcagataatgatgatgggctcagtgggcttgatagtgataactcctaaagcagctccttctaagtgcggttctcaatctgaggaagttaaaaaaaaaattagtgactagaacccacttctcaggtactctgataaaatacatttgtaggggagtgatagttttcactttctttttttctttttcttttttttttgagatggcgtctcgctcttttgcccaggctggagtgcaatggtgcgatctcagcttactgcaacctctgcctcccagtttcaagtgattcttctgccttagcttcctgagtagctgagattacaggtgtgtgccaccatgcctggctaatttttgtatttttattagagacgggatttcaccatggttggtcaggttggtctcgaactcctaaccttgtgatctgcctgcctcagcctcccagagtgctgggattacaggcatgagccactgtgcccagccttcacatattttttgaaataataggccagttgcggtggttcatgcctgtaatctcacactttgggaggccgaggtgggcagatcacttgaggccaggagttcaaggccaccctggccaacatggcgaaaccctgtttctactaaaaatacaaaaaaattagccgggtatgatggcatgtgcctgtggtcccagctactctggaagttgaggcatgagaatcgctttaacttaggaggtggaggttgcagtgaggcaagatcgtgcccctgcactccagcctgggtgacagagcgagactccatctcaaaaaaaaaaaaaaaaatcgtatgcagtaaaggttgaaaactgctgcccaaaggcgctattaaactataggttcccaaacctggccaattgtcaaaatccctcaagaaggggcagtggggtctaagggaccccattgctgtagaggagattagtagtccaagagtgagatgaactgttggaagtcctcaaacttccaaactattaaaatagaatagttttgcttccttaaaatagaatagttttcttcctcactgatttttctgtattgattagaaccataacaagtgaattaaacaactacaaaatagttatgtgggccacagacattattgtaatgaagtgaagtttggctcaggccttgtaacacaattgctttttggattaaaagtaaaaatattaaattgtgaaattatgtgtaagttttaaaaaattggtcttgtacaaaagtgttgggtttttctttgtttttaactggatttgtttttaagcaagacagaatatttatattgttggagagtcacaaaggaggtgtgtttgtggatttaaatgtggagacagtgtgccttgaaatgccctttatcagtctgattcaagccacctgcaatcatggatttgaacttttttttttttttcccctgagatagggttgcctaggctggggtgcagtggtgtgatcttggctcactgcaacctctggctcagcctcttggagtacctgggactataggcacacaacatcatatccagctattgtatttttttttttttttttttttatagagacagagtttcaccatgttgtccaggctggtcttgaactcctgagctcaagcaactcacctgcctcggccttccagagtgctgagattataggtgtgagccaccatgcccagccttcactttatttaaaaaccatagtttttaaaagccacattcctactgatgaacacagaggttgtttccagtgttttcatttgcagggctgtagtgattgtttttgcacatgcctctttatgtacatgtgctgtgtcttctgggacagagagtggacattttaagtgttttattggtcctgctaaattgtctttcagccaaactgctgcagaggtgatggagatgaggtgggtactcaggagaattatgctcagtgcttgtgtgctagtcactgacctggaaacattttattaaaaatgctagattaggttagtgatgtaaataccaggtgatagtaaccagaataattgtgtcaaaacatcaagaatcatcaagagatgccaggcatggtggctcatgcctgtaatctcagccctttagtaggaggccgaggtgggcagattgcttgagctcaggagttcaagaccagcctaggcaacatggtgaaaccctgtctctaccaaaaatacaaaaatttgctggatgcagtggtacgtgcatgtggtcccagctactcagtaggctgaggcgggaggatcgcttgagcctgggaggcagaggttgcagtgagccaagactacactacagcccgggcaacagagtgaaaccctgccataaaaaaaggagaaaaagaatcatcaagagaaaacttaatttgatgtgctctgcgttttctttggtgcttcatgtcagtgttagaaactataggttgtatatttattaatttttctcctacatttgttcaacttgactaaaatattaactccaaatgcctagaatttcaaaatacctcttcgttataaagtatcaactatttcttagtccccttaagctgatagtattgtgtcattgtaaaagatcccttgtgaaaaataatttttgtcaacatgaaaggtcttaatgtgtctcctagtttacattttacatggtcttttccatgtatttatatagttgacatatatagctttttttgtaaatacactttcctatgtgaacatgccaaggtttacttaagcattctcttattcttggacatctaaattgcttcttattttctattgtaaataaagtgctagaagcttctttcctgaaaagttatttacttttcacctagtatttccatctgtgttcctcaaaataagattgctgagattcatgtatgttgccagaaagattgtgaggtttaacagtgaatgaggaaaacttttaacactcaaggtctaccaagtacagcaagttttattttacctttttttttttttttttttttttttttttttgagttaggccaagttgcctaggctgggctcaagcaatccttctgcctcagcctccggagtagctgggattataggtgtgcagcaccacacccggctttcttgtattttttttttatttttatttatttatttatttttgagatggagtttcactcttgtcacccaggctggagtgcaatggcccaatctcgactcaccgcaacctctgcctcccaggttcaagcgattcttctgcctcagcctcccaagtagctgggattacaggcatgtgccaccacacccggctaatttttctatttttagtagagacggggttcctccatgttggtcaggctggtctcaaactcccgacctcaggtgatccacccacctgagcctcccaaagtgctgggattacaggtgtgagccaccgtgcctggctgctttcttgtattttatcttgctgtagcggttgtgggatttttgcctggtgtgttcattggagtgtgtgtgtgtgttttgagatgtatgactgtgttggttgtgttgtcatactttgaaggttcattaatgtgctggtctttctatttttcttgttatacttagtcacttaaaaacccttttttttttttttttggaattcttatttttacagtactttgaattcctgttttattaatcaccttcttatctgaaagtgaagtaatagtgtacttggcaccattgaattagaaaattgtgtgtccttggccagaagatcacatacacaggaactcgataagttgagagatttagccgtttcagaaatgggcatttgtgtcttccagtggagaagcatctgcaaaagaattgggcagatttggccaggcgcggtagctcatgcctgtaatcccagcactttgggaggccgaggtgggcagatcacctgaggtcaggagtttgagaccagcctggccaacatggtgaaaccccgtctctactaaaaatacaaaattagccaggcgtggtggctaacccatttaaagtgggtgaattatatcttttatgttttaatgtattcctagagttgtgcaaccatcaccagaataagttgtagaacattttcatcaacccaaaaagaaactttgtattcattagtcgttcctcctcatttctcccctaacctcccagcactaggcaaccatcagaatactttttgtctccacggatttgactgttttggacatttcatattaatggaatgcacaatacagtagtataatacattaattttggaaggccaaaattaatggcttttgatgtctgccttttttcacttagaataatgtcttccaggtccatctgtgttatagcatgtatcattactttatcctttatgtggctgggtaatattccattgtatggttataccatgttttgtttatctattcatcagttgatggacatttaggttgttttccattgactattaagagtaatgctgccggccgggcgcggtggctcacgcctgtaatcccagcactttgggaggctgaggcgggtggatacgagggtcaggagatcgagaccatcctggctaacacggtgaaaccccgtctctactaaaaaacaaaaaattagccgggcgtggtggcgggcgcctatagtcccagctacgcaggaggctgaggcaggagaatggcgtaaacccgggaggcggagctggcagtgagccgagatggcgccactgcactccagcctgggcgacagagcgagactccatctcaaaaagaaaaaaaaaagagaataatgctgccatcatgcttgagggtttttttttattttgttttgttttgtttgtggggggagcggagggcacagtctcactctgttacgcaggctggagtgtagtaggcttactgcagcctcctccgccccctggttctagtgattcttgtgcctcaggctcctgagtatcatgctgcaatttttgtgtgagcatacatttttcatttctcttgggtcaatatctaggagtatccccacttttggttctgagtgttaattgagcctgttgtgttctcacattccctgtacttagatggaaatagtgctttgcctaaaaagaaaataaaagacctgattgtgcaggcgagtgagaaagagagagaggcgctagggttatttccaccctgatactctttgggtagtcttggtatgactagcaaagaagcaagctccaagttgtagtttgcttccaagtttctggcttctgtgggaatttctgcatctaagtaatgacaattttcagttacttgcagtaagtaaattatcaaccaatcttactgtgtattactagcctagtaggaatttacttgtatatcgagaggaatgctgcagctttcaccttacttctaatggggattaatgcttacttaacttgcagttttggaggcaagtacaaagtacaggaccaattatggtcatgaagtgagagagaagtctggctagtgaatggtgattggcaactccagttgactgttcatggcatcttagatctgtgaggagggaggagggaaggaaagttcaagctggtctttatggtaagttctggaacatttccctgtgtcaatgggtcatctgttcattcactgtgtaaaatggttgagggaagttttaatttacatgcttccttattgtgtaaacctttgatttttagtgatttcagagtttgtttttataattacttaacacgtgaagaggatgcagagtaacgtatcgaagctctggttaccttccactgggatttgacacatttgatttcctttattccctccttccttcccttcctccctctctcttttcttaaggaatgcaactactcagattcacctgcacacccttggcatacctctcactcccccttacccccacttcctcagaggtgacctgtcctcagaggcaaatgtgtgccctttccatccgtacttttatgctctcatctatgtttacatctattagtacactattgtctgtatttttaaacattacataaatggtgtaatttttacttttaattctgtagtggtgtttctcaaattaagttctgcacaaaacatttttatagatatccagtgttagcttaacgtttttcttattgtggtaaaatatacataagataaaatttaccattttagccatttttaagtttacaagtcagtggcattaagtacattcacagtgttgtataaccatcaccattgtccattgccagaacttttcatcatcctaaacagaaactctgtactcattaaacaatagtttatcactccttccctgcaactagatgctggcaatcaccattctactttctatctctatcaatttgcctcttccatctaagtggaatcctacatatttgtcgctttgtttctggcttttttttcttcttgtgatgctttgttttaattatgttcctggctttcatcatctagcaggctgattccaaggtttgtccatgtggtagcttgtatcactttaatgtttttagagatagttaatattacattgtttatatataccacattttgttttttcattcaaccttgatggacatttgaattgtttccccctttacctgttgtgaataatgctgccgtgaacattgataaccaaatatttgtttgaatctctgatttcagttcttttggttccatacctaggagtggaattgctggatcatatgataattctatgtttaactctttgagggatggccagacttttccaccatagctaaatcattttaccttcccacaagcaaagttcaagggctccagtctctccccataaggtcctttgcacttttttttttgagacggaatctcactctgttgcccaggctggagaacagtggcaccatcttgcctgacctcaagtggcacctgccttggcctcccaaagtgctaggattgtaggcgtgggccactgcactctgccaattttttaatttttattttcatttatttttctttttttaatttttaatttttttattttttgaagggataaggtctcactttgttgcccaggctggtcttgaactcctggcttcaagcaatcctcctacctcggcttctcagagtgctgagattataggtgtaagcccctgcacatggcctttactctcttgatagtgtcctttgatgcacaaaagctttcaattttgatgaagtttattttttatcttgttacctgtacatttggtgtcatatatctaagagaccattgccaaatgcagtgtcatgaagctttccctcagtgttttctttctgcagttttatgattttagctcctaagtttaggtctttgatccattttgagttaatttttgtatacagtttgagagtcacacttgaggctctgggcgcagtggctcacgcctgtaatcccactacttggggaggccgaggcggatggatcacctgaggtcaggagtttgagaccagcctggccaacatgccgaaaccctgtctctactaaaaatacaaaaattagccaggcatggtgatgcatacctgtggtcccagctacttgggaggctgaggcaggagaattgcttgaacacaggaggcggaggttgcagtgagccgagattgtgccactgcactccagcctgggcgacagagcgagactccatcgtgcggggtggggggtaaaagtcaaacttgagtcttttgcctgtggatatccagttttcccatcactatttgttgaaaagactatcctttctcaactgtgaatggtcttggtaccctagctgaagttatttttattattatgttacttaggaatgcacataaggcctggcacggtggctcatgcttgtaattgcagcactttgagaggtcaaggtgggaggattccttgagccgaggagtttgagaccagcctgggcaatatagcagcaagaccccatctctatattttaaaaaaagaagaaaaaaaaacctctgatgcataaaatatttaaacttgtatgcattcttttctttctttattttttaaaaattgagacagcagcttactctgttgtccaggctggtcttgaactcctgggctcaagcagttcctctcaccttggcctgcagtgctgagatgacaggtgtgaaccactacacctggcctgcttacagattataaaaagaaaataagtttacaagttaaagacagataaaatgacaaaatcagtaaaattaaaattacttttatggagccgatgatgtttattccagttgctcctctcattgtgaatatggtattgttgctgtggcagatttggaggccgtggcagatttggaggctttggcaatggcttctgttaccttgccatgaggtaactcagttccctcatcacttttctctgagaactataaaaccttggaggggtgccttctgcccttcgcttggcatgtatattatgcagggatcaggtcttactccgttcttgattgttagtacaaattagttaaaattgtattgtttggccttagcctgatggtaaacacaacagcacacgtgggctgtgaaatctctgggcagctctgtgtttctagggaagcatctcgatgatccagaacaggcttatactaatgttttagtgtaattttgaaatgaaaacacagcatttaaaaattcttatagagaatgtatagaccttgagaagtgttagcagacccagtttacgacatgtctcaatattatgaaacattgctttattccctatcctgcttgtacatttaattttttcatccagttttaaacaacttgggtactgtggcctgtgcctgtattcccagctactagggaggctgaggcaggaggattgcttgagcacaggactttgagggctgtagtgagctgtgattgtgcctgtgaatagccattgtgctccagcctgggcaacatagcaagaccctgataccttgggtttttaaaaaacaaaacaagatacatgctgacatttctggtttggcaggcagagcttgttctgctccccaccctcccttttcccatagtaaccatttataggacatctcactgttgtctactctgtgttgcctctgcttccctgcgtggtagatctaggaatcttaggatttcttagttttagctggtgatccgtatctttttcttaattccattgtaacttcagcttttcttattgcttgtaggaaggctgtttccattgaatacaaacaaaataaaagcttttattcttaatcttagagataggatgtttgtatttaaaaataattgtgctgtcaaaattctgtcaagttggcttttaccacattagttttttttaatgtggtttatatgaccctggagtaccttgtcttctcactgttaaattctcaactgagttgtccctatttaaagtgtgagactgtgccagtttgattttaaaatattgcaagtgcgttatggcaagataaaactgcaaagaaagaaccttcatgtccctttgattataaatgcttttggcacttgtttctactttttcctaatgttttttgaggaaagaacctccaactctccagacaggtctgggggcaaatgactaaaacatgaactgaggccctgggctgtctctgtgaggatatcccctctattctctctgaaatgtcccagcatgtggtgcatttcttgttagtgtggactcctctgtatataacacatcttatttatcttctgtgcataacatgaagtagtgccctaatgcaattccaggatgtaattcagcatttctataaaaatacagtgtttttctacatttgcatcaaaaaataaccagataattatatttattaagaaaatagcatttttggctgggtgtggtagctcacgtaatcccagcactttgggaggccgaggcaggcagatcacttgaggtcaggagtgaggcaggcagatcacttgagatcaggagttcgagaccagcctggccaacatggtgaaaccccatctctactaaaaatgcaaaattagcctggcgtagtggtgcatgcctgtaatcctagctactcaggagactgaggcaggagaatcacttgaacttgggaaggggagattgcagtgagctgagattgtgccactgcactccagcctaggcaacagagtgagactctgtttcaaaaaaaaaaaaaaaaaacaaagaaaagaaaagaaagaaagaaatgtatttttggtatttgttttcacaaactagagcatttatgtgaaataacattgctagtattgatattataccatagtataatacttagttcttcagcgatgtatctctgctgatcagctacatgatatctacttgagctgttggattttttttaagaacagtgcatttttgaatgcttttgaaaaattgtagtaaaatacataaaacaacatttaccttgtaagcattttaattggtacaattcagtgacattaagtacagtcccagtttagtgcaaccactgttactgtctagtttcagaacgtttttgccccagatggatactctgtacctgttgaacattcagtcctcatggcccaataatctttatgtctgtatagatttgcctattctgcatattttatataaatggaatcatgtcttttgtgtctggcttcttttacctagcatagtattttcaaggttcatccatgttgcagcatgtttcaatactttgttcctttttatgtccattgtatggatatgccacatttcgttaatgacaattcttttgggtagctacattttaaaacattatagtagaatacatatagcatacaatttactatcttaaccatttaagcctgcagttcagtggcattaaatacattcacgttactgtgcaattatcaccaccatctgtttgcagaaacttttcatctcctccatttgaaactctgtatacattaaacatgaactctcccttctccccttcctccagccctggcagccaccgttctacatttttatctttctgacagagattttactactctaggtacctcacataagtgaaatcaaccagtatttatccttttgtgaccagcttatttcattagcttaatgtcctcaaggttcatccatgttgtagcatatgtcaacatgactttccttttaaggttgaataatattccattgtatgtatatgtcacaatttgtttctccatttatccatcactggacatttgggttgcttttacctatcggctgtcttgaatcatgttgctatagctgtacaagtatctatttgagtttctgctatcaattctttaagtatatgcccagaagtggaattgctggatcatatggtaattccgtgtctggttttttttttgaggaagtgccatgctgttttccacacagctgtaccattgtacattccccccagcaatgtacgagggctctgatttcttcacatccttgctaacacttagtattttttttgatagaatagccatcctaatggctacttttaaagtatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatcccagctactggggaggctgaggcaggagaatcacttgaacctgggaggcggaggttgcggtgagtcgagatcgcaccattgccctccagcctgggcaacaagagcaaaactccatctcaaaaaaacaaacaaacaaacaaaatatatatatcattaataggccgggcatggtgtctcacgcttgtaatcccagtgctttgagaggccgaggtgggcagatcactggggtcaggagttcgataccagcctgggcaacatggtgaaaccctgtctctgctaaaaatacaaaaattagccacgcatggtggtaagcacctgtaatcccagctactcaggaggctgaggctggagaatgcttggacctgggaggtggaggctacagtgagctgagatcacactccagcctgggtgacagagcaagactctgtctcaaaaaaaaaaaaaaaaatcattaataaatgtgatcttttttcttcctatacaacaagttgtcaagcaagtatgaccttcttaattgaccctttgacatgaactgggatgagatcgtggaggatgttgaggagacagttgttaccatagtgcacttctaaaaactttaattctatagatttctttaaaattttttttaaaattattatgagtacacaataggtgcatctatagatttcattaccctcaaataaatgtacaaggcaatgcagagaaatgcacagtgtaacttggtagacttgacctatcaagttactgttgaatatattatggagcctgtgtattaccaggggcagcagacttttcctgtaaagatagttgttttcagctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttgtctgatggttggttggacaaaagcctgggcatgttgtcaccttccataagtgtttgtgggaatgtaggtaatgaggaggagtaaaggattcctgaaggatgaggaggagggctggtggctgccataggaagtgatcactgttttggcagacctgtcttagagtaatgaccgtcatactctctcattgcccttgtgaactcatgaaatcccatggctgctaaagctgaaggtcaagtggggacttcccggccactgggcttagcaccccacagagctgtggagtgggcattaatgtcccttttttatagatgcggagactgagaatgaggactgttggtaacttttgaaagggcactcagctagaaaagtctgagccaggatttcaagtcccatggctttacctctgtggtcctaatatttggtgtgttcaagtgagatctgtttttttcctatttcattttgattattgattttcataaatttttttctcttttgagatagtatcttctctctcttttcttttttctgttctttctttctcttttctttctttttttttttttctctgagacggagtcttgctctgtcgcccaggctggagtgcaatggtgcaatctcagttcactgcaacctctgcctctcgggttcaagcgattctcccatctcagcctcctgagttgctgagattacaggcacctgccatcttgcctggctagtttttgtatttttgtagagacggggtttcatcacgttggccaggctggtcttgaacttctgacctcaggcgatccacccgcctctgcctcccaaagcgctgtgattatatgcatgagccaccatgcctggccattatttctttctttctttctttttctttttttcaggttcattgaatttgctttgagacagggtcttgctctgttgcccaggctgaagcgcagtggtgcagtcatggctcactggagcatcaatttcctgggctcaagcgatacttgcacttcagcacccctccacccccacccgctcctttcccccacagtagctggaactacaggcgctagccaccgtgcttggctaattttttttttttttttttttttgagacggagtctcgctctgtcacccaggctggagtgcagtggcgcgatctcggctcactgcaagctctgcctcccaggttcacatcattctcctgcctcagcctcccaagtagctgggactacaggcgcccgccaccatgcccggctaattttttgtattttttagtagagacggggtttcaccgtgttagccaggatggtctcgatctcctgaccttgtgatccgcctgcctcggcctcccaaagtgctgggattacaggcatgagccactgcacccggcctggctaatttttaaatttttttttgtagactgcccaggcttgtttaattgattttctatgtgatcttagggaaatcgattatttcccataaacatttttttaattagaagttaaattctgcctagtttgattcacaggattattgtggatgactgaaacagagaataggtaagagcttctttgaaaaatatgaggtaccatacagaagttagatgctttgtcctggtgataccccctccaaagcacagctaaggaaatgtggaaggcactcttatctcatcatatagctttgaaagcctagcattgaaagtacgaacttgattcttttggagaaatcctttggctctcagtgagtttactttctattaatgactgtgttaagcggaatgaaaactgaaagaggaaaggggaggaagtcagaattaagcaggaagagtgagcccatagcagagtccagatttagaccccaagctacttggaatgatactggacaattatgggtgtgtttaatgatggtcctgagtcatgaaaacaaaaggaggctttaaattatgtctggcttagtgtacagcatatttttgtcattattcaagttttagcatgtaaagaggaaagtgtgcagtacttatgcatatcattttcattaatgaaactaaatgaggcctctttaaaattatcagtgttcacagtatcttccaaaagacatgtaaatgtataaaggtataaaaaatatacatataaattttacaattttgtgagctatatagtagatctcttattttgtccataggtcttaaagatcttatactgtattcaggaataaagataacttcagtgggaggcctttacagggctaatgagtaagcattattttgataaagttctgtgttgtctacaatagatatagtagaaatactcttggaatggtaatcatcccaggccctgctttggagcggaagaaatagtcaatgtagaactttacagtatattgtacacagatgtgcctgctaataacttctgtagacagcaaagtttaagagaaattaggtggtaaatgcaacatatgtatctaaataaatttggtctgagggatttgataagatgaaacagtacatagtccagaaaatttttatactcaaagaattatagaaaatatctgaaatgttttcagttttgtgcatatccagaaaatgtcatcctgtgatctgctggttggcagcccaatggcagtattagatgtattgtttttattttgttttgtttgctatttatttggttaagagagttacctaattaggagtgtgaaaaaaaagatttattatagtagtgggcttttgtttgacttaaaacatttttgttgttaccacagtatgagtgccttgtttgtgaaatttgtttaccgggaagccatatacttagagtagcttttagtttatcattatcatcatcatcatcatcatcatcatcatcatcatcatctccttcatcatgaaaggaagaagctaccaatgttgctttattctgcaaaaaatacaatagatgcttgttgaaagtatggagtgaaatcttaaatatgtctgttaaaaagagtacaactggccaggggtagtgcctcatgcctgtaatcccagcactttgggaggccaaggcgggcagatcgcttgagccaggagtttgagaccagcctgggcaacatggtgaaatcctgtctctacaaaaaaaaaaaaaatagacaaaaattagctgggtgtgatggcatgcagctgtagtcccagctacagtggggctgaggcagggggattgcttgagcccaggaagtaaaggctgcagtgagctatggttgtgccactgcattccagtgtgggtaacagaacgaaaccctgtctcaaaaaaaaaaaaatagtacaactttaagcaggatgtgggcacatgcctgtagtctcagctacttgggaggctaagtcaggagagtcacttgagcccaggagcttgatgctgcagtgagatgtgattgtgccactgccttccagcctggggatgatagcaagaccccatctctaaaaaaaaaacaaaaaacaaaaaaaaaacagagtacaacaacctttggtaaacttggaatataaaggtgtttccttaacctgttaaagagctgataaagagtggtactttcaaaccagtacacattatgtgaaacactagagacacttcccatttgttaaaagaaaaaccttagccaaattaaatttaagttttttttggagacagagtcttgctttgtcacccaggctggagtgcagtggtgcaagcacagctcactgcaacctccgccttctgggttcaagtgattttcctgcctcagcctcctgcgtagctgggactacaggtgtgcaccaccacgcctgggtgatttttgtattttttgtagacatggggttttgccatgttgcccagtctggtcttgaactcctgggctcaagcaatctgcctgcctgggcctctgaaagtgctgggattacaggcgtgagccaccatgccatttaatggtttaattgagcaaagaatgatttgcaaattgggcagcctcccgagccagagtaggttcagagactccagcacagccatgtcgtggaaaaagatttatgaatggaaagaggaaagtgatgtaccgaaaacggaagtgaggtacagaaacagccggattggttacagctctgaatttgccttatttgaacacaagttgaggtttgtacagttggccacctttgattggccaaaactcggtgattggcacaagagcaggttatagtctgtttacatctccattttggttatagttcattatggacagaaaaacctgtaggtcaaacttaaaatatgtaaggagacagttttaggctaaacttgatttaacacattaaatccgtaacaagacaggatgcctgccctcaccatgttatttgatcttattttagtaattctagccaatgtagtagggcaagaaaactgcctgcttggctacaaaataaacacacaaaagtcagtatctgtaatatgtgacagaaaatataattaaaaaaaaaaaaaaaagccgggcacagtggcccatgactgtaatcctagcactttgggaggccaacgtgggtggatctcttgagctcaggagttcaagaccatcctaggcaacatggcaaaaccccgtctctacaaaaaatacaaaaaaattagccacgtgtggtggtgagctcctatagtcccagctactttggaggctgaggttggaggatcatttgaacctgagaagcacaggttatagtgagctgagatcacgccactgcactccagcctgggtgacaaagtgagactctgtctaaaaaaaaaaaaaaaagaagaaaaggaaaggaaagtaaaagaaaaaataatttcacttactagagcatcaaatccctaagataatttagagcaaagccagaaaagtgaagaaaatataaaaatctttacagtgggttgcattttaaaaaaaaacttgaagatatcagatcaactcactaatgtattaattaatataatttaaattaaaatcccactgatttttttgtggggagggtgggagagtcatttgttaaaatgattctaaagagcatctggaagaataagcaggcaagaatagccaagaacattttgaaaactaaagatgagtttggaagacgattggttttgtactgtcaactacttatagattttacatgaattttaaagggtaatctgagccctcgaatagacagaaatagccatagatctgaaagaacacttaagacctgatccagctatccatgagagtatatataatcaaagtctttgtgtgtgaatcaggagtctttcaggtgcaaggtaaataaactcataattgcttacgcaaaggtggtatttgctttagtgactccagagaaagctcaagtgcctatctctcccctgactttgattctttttggggttggctccattctctcctgttgctaatggcttcctttgtgcagccagaggaaaggaggtgtggttttttgatacttccaggcttctatttttatagcttgagatcaaagagggaagtgaccttccttagagtcagtgtgtaaagtcctaaggaagataccacgtggggtgctggggccatgtgcccatccctggcccatgaccatggggatgctacactaactgggggccacgcatggctgttcctgccctgaactgccagctggctttgcagtgcagcctcaccagaatcacatggaatagtagggatatgaattgtttcccaaagaaagtgtgtggggtggtagaattactagtgggggagtaaggggacaggccattgggcatactggagcagcatttactcagtcattgagaaaaggatggaacattcaataaagggtgctggacacatttgtgctctaaaaattttgtgtttcacctattaatttatccctccccttagcccctggcaaacactgatctgtttactgtctccatagttttgcctttcccagaatgtcacacccttggaatcatacagcatgtaaccttttcagattggcttcttttacgtagtaatatgcatttaggattccttcatgccttttcctggattgatagctcatttctttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccctctcctcagcctcctgggtaactgggattacagctatacaccactgtgcccagtgtgacaattatgaataaggctgctgtaaacttctgtgtaggtttttttgtgtgtggacattggttttcagttcattatggtaaataccaaggagtgcagttgctggattgtatggtaaaagtatgtttagtttgctaaggaactgccagctgggtgtggtggctcatgcctgtaatcctagcataatgggaggctgagacaggaggatcccttgaagccaggagttcgagactagcctgggcaacatagtgagacctcatctctacaaaaaatttaaaaattagctgggcgtggtcttatgtgcctatagtcctaactgcttgggagactgaggtgggaggatcacttgagcccaggagctggaggtggcagtaaactgtgatcataccactgcactgctgcctgggtgacaaagcaagaccctgacttaaaaaaaaaaagagaaaagaaaaaaagatgagtcagagggtaaggaagcaaaaataagtaaataaataaatagaagagaaaagaaaaaagaaaaaactgtctttcaaagtggctgcgccattttgcattcctaccagcaatgaatgagagtctgttgttgcacatcctcaccagcatttggtgttgtcagtgttctggattttgaatattctattaggtatataatgctgtctcacttgttttaatcaatgatatatgacattgagcatctttttaatatgtttacttctcatctatgtatcttctttagtgaggcctttgtttaggtcttctgcccattttaaaaaatgggttcattttcttattgttgaatatcatgagttctttgtctattttgaatacctgccttttgctttatttttgtgttttttattttttttttttattgagacaagttctcactctgttgcccaggctagagtgcagtggcatgaacatggctcactgcagcctcaacttctcccagcctcaagcaatcctcttgcctcagccttccgagtagctgggactataggcacacaccaccatgccctgctaatttaaaagagtttttttttgtagaggtgggatctcgccatgttacccaggtggtcttgaactcctggcctcaggcaatcttccagccctcagcctcccaaagtgctgattataggcctgagccacttagcctagctcagaatttattttttatttgttaattttgaaaaaatataggacctcataaaagtcagtctacatttgtacacattatgtttttggtgaatatgtaaatggattctttgtgaatcaatttggttttgtttttttgcttttaaaaataccagccctgggctggatgcggtggctcacgcctgtaatcctagcactttgggaggctgaggcaggtggatctcctgaggtcaggagtttgagaccagcctggccaacatggtgaaacgctgtctctactaaaaatacaaaaattagctgggcgtggtggcgcatgtcagtaatcccagctacttaggaggctgaggcatgagaatcgattgaacctgggaggcagaggttgcagtgagccgagatcgcgccactgcactccaaccttggcgatagagcaagactctgtctcaagaaaaaaaaaaatgccagcagtggctggctgaggtggctcacacctataatcccagcactttgggaagccaaggcaggtagatctcttgtggtcaggagttcaagaccagcctggcgaacatggcgaaaccccatctctaccaaaaatacaaaaattagctggatgtggtagtgcgcacctgtaatttcagctgctggggaggctgagacatgagaatcacttggaccctggaggcagaggttggagtgagccactgtattccagcctgggtgaaagagggatactctatttaaaaaaaaaaaaaaaaaaagcgggctggatacagtggtgcacacctgtaaccctagcactttgggaggctgaggtgctcagattgcttgagctcaggagtttgagaccagcctagacaacatagtgagacatcgtccctaaagaaaaaaaaaaaataccagcacttagccaaaagatttcaacagtgcagaaaaagaaagttgtgatatcttttctccaaattagtcttgttttcagtttcattatccaagtaaccactactaatagttaaaacatttgaaatacgtgtgggagcttgtcctatttaatataaattatttattgagcaaataatcaccactagtatgttttggatactggaattttcatatgtaggagtccttgaatgtaaggtgcccctttggtagttctgtgcttcttttacctgtactgtaacatagggaaagatgttacaaatggttgtatttttaacagagcagtatctattcttaaacaccagcccttccactaaaggtaaacaacaaatgaatacataaatgaagttttggtattgggattatgtgggttaaacacatccatatttcattattaatatttaagaatataacaaactttttattggcatttggaccttgtagctaaggaaagattaaactttgtttatttgtgctttgttttttttcttcactcagatatttgaggatttcccatttgaggaatacatttattaatcaagctttagtttcaagatccttgatcttagggaataccatcaaccgttcttctttaagcttcctaactttgcccaaatttggttagaactactcaagagtagtttgggtaattcagaaattttattggaaggggaaagaatttttgacccaaattagataaagcaactcttgggtaatgatttcttttcttgttctctctttataatcaattgaaagtagtagtaaggctgggtggcaaaagaaagaggcctggggagaatcgcgtggttttcattatctcttttcatagcagcaaagtgggaagggaccaagaggaaatcaactgaaaaaccatccttctgaaacattggcctaaaaaactgtagtccagaaattgagtgcaactggcagtggcatttaaaaggaatgctctaatttctaggaaagcaggcacgagtacctcttaaaagaagaaaaaaatgaaaactgtaatttaggacacatagacgagtatccattccctgtacttttactctcatgtcctaaccaaggaagggttgccatagcaaatatggcattccttagccatgattcactgttgtaaatgcctgcagcattcataaaagtaagatatatgggctcttctttttccttttaaatctttatttctgtatttaaatctgtatgtcatcatctgtattttctctcttgttttttttaaatcttgggagatggtacaaattatttaggggagggaatgagtttcttgtccacaaatagaggagagagagggctttttgtctttctgctttggaactggagagcttcctatttaggcatggcctttttcaagtgaccttgtattgttatcagtactgtagaaggtaggcacgttgtgtaaactttaaaattgaaagccattaggcattccacttgtaaaccttggctttttaaagaaaattacatgttcattgtgaatattttcttatcgacctatctctgtgcacatgcagacttcctttgcctacattctgaaaggtgtaattgccttctttaaggacagcggacatctatagttcttgggtcaaattgtcctccttctggttttgtcagttctcagccacactgtgtgagcatccattttcttggattctggttcggagctcattttaaggaacatcatgtcccttttgagactctgtggacattggggtgggtagatgtccccctgtgaacagaaggtccctccctaaggaggtgcttctctgtgttgagtcctgcatctgggcacacagagcccgaagcaggaagagttgagtctgaatagggaggcctgtaagcctgactgctctgccacgggtaggcctggtctgccatgctccaggagcccccaggaggctctgaagtcattctgcctctgggaattttacagaggagctaatatttgagctgagtgagaaggtgattcttgaaaaagcaaggcgtgccctggtccagttctgtggggctgtcgtagaagagggctcggaagctcttgggagtgaggctagaaaggtaggcagtgttaccataaggaggttggaagtgacacagataggctaaggaaggggacttcagtaatcatgcagcaatggcctggaaaagggagaggctcatagtagggagaccagtttggaggctgccatagtgttctactgagagagaaaaagacttgaactcagagcacggtcagggaaggtggaggggcagggtctgatttggaagtgttttgttttttggttttgggaacaaggatttggaaacctcttggctccgtagatgaagaaaggtgaaccaaggaagactgaagtttccactcaaggaaacagtaactcagggaagaaaacacaggagtaggaataggtttaagagaatgacaagcagttgtgttttggacttgtttagttcgaggtgacatctttgtagggatgtctagctggtagctgcaagtataggaggaggctggatgtgtgcatgagtttcttggtaaagatccatctgcagtctcctgaagatgtcacccagattgccctgccatcaccccagggccttgagtcactcgcttctcttggtgtctaggcaggcttgaagaaaatcaaacagtacaaaatcatgcaaattcagacctctattccaccccagaggaaagtcctgctagcagtttttgtgtattcttccagaaatttgccttgcaacgcgtttgagtatataaataatcccagaaaggatgggccagacactagcagaaactcaccacacacactgcactgggcatgcagaaactttgcaaaatgtactggtgtgtgctgtcactgcattcctgggtttggaggtcttctgtgtccccagctgtcagtattgcccacaggctgaccactgagctccttccacagccggcccatatcaccctctttcgaagtgtgtctgcaaggctagattattagagtaatttaagtgtttctgctttgtgttttctttaatgaatttttttatgatgaagttcttgttttaaaaatatacagtggtaattaacatgtatgcatttttcttaaaatgacccccccagtccctcttcggatgtgatcactgttaacagtatcgtatatagaccctgttctgtgtggggcgggcagagggctggttagtgggtggaacatgcatactcacaaccatatttttcacatgggaaaatataaaggtgacaacaaatctcctggactataatctcatcaagcagacaataatctctgtttcaaaagtggacaaatacatgctgattttttaaaaaaaattataatagtacagaaagatacaaaaataagttaaagtcttcctaactctcctgcctgtgccctccactgggcaaaagtccctgtccctaaggtaatatctgttaacagttctccttccagaaaacttgcaatgcaaataggaacattttgtgtgtctgcctctgtgtgtatgtgtttacatgtcttttttttttttttttttttttttttttttttttttttttttttttttttgagacagagtcttgctctgttatccaggctggagtgcagtggcatgatctcagcttgctgtgatctctgcctcctgggttcaagtgattctcatgcctcagcctcccgagtagctggaattacaggcgcctgccaccacacccagctaatttttgtatttttagtagagatggggtttcgccatgttggccaggctggtctgaaactcctgacatcaagtgatctacccgcctcagcctcccaaagtgctgggattacaggtgtgagccactgcttctgcccctgcacatgtctaacgcacacaaaagagattctgctgaacacattttttatgctttttctttccaatttaacatatttgacatctttatcagcttatatagctttatttttttaagaggttattggctataaagggaaagtgctttatgggtgcttctgttgttatttaattggatcctgttgatggacattgatatcatttctaaattttttagtatcctaattaatcctgtggtgagcatccttatacagatatccttgttccctcatgaaaatatttctggaggatggaaagaagggaaattttaaaaattatttgtgtaaacattatcgtttgttagtagaatgacctcaggagagattgtagtaatttatacttccccacatgcatatgaatgccttttcaatatattgtttcaaaattggatatcatgaaccttaagagataaatatatatgtatgtattttttttttttttttttttttggtgggggcatgtcctgttattgacagtttgttttggtggagggatgtcctgttattgacagttatcgaatagaactttgtcagttccttcatgtaagggatgaatttggtaataaaacaggtctgacttcagttatggaactgggaaagctggaccttgatgtggaggtgggctcagacatgctgtgtctgggcaggtatctcttgggaagcagtgtcatccctgaacagaaacatggatgagccgcaggggacggtgctgagcagaggggctggccgtgggtcatctgcctcccttggcctagaaggcacaagggagctttccaccttgcctttggttttgagaatgcagaagctactaagcaactcacagtgtgcccagggtggtccagctgaaggatgcgaaatggttcttccttttccagccaaagatcttgaacctcccaccccatgacaagcattataaaattcacataattttgataggctggattccttttctgtagcagatctttcctcagaacagaagtttgttttttttttttaacctaaattacctgtgagttttattttttaaatatggaatctgttttttggacacctccttgtcatattaaatgttctgttattaattttgagattttaatgtaaattttaccccagcaaattaattttgtttctcttgctctctctttttttttttttggcatcctttcccgttgtatagtggtgctcattttatcatactgcttttatatgacttttcttttgtgaacagggatcttgttcacttttccttttttaaaaatttttttatttttttgagacggagtcttgctctgttgcccaggctggagaacagaggcacaatctcagcccactgcaagttttgtcttccgggctcaagcgattctcccaccttagcctcttgagtagctgggattacaggcgtgcaccatcacgcctggctaatttttttgtatttttgtagagatggggtttcactatgtcatccaggctggtctcgaactcctggactcaagcgatccacccgcctcagcctcacaaaatgctagggttacaggcgtgagccactgtgcccgagccacttttccttttaacataaaaacattgatatcctagagagggcactgtattttgggtacatacaggttcagatcacggaagagttgtattctatactttttttcatcattcttagttcagtatgatgtattttataatttcatatgagaaactgtaacaatgggcatgtgtcatccagcaatacctactcataaatcatattaaattttgatccaaacatgggagaaactgaagttttctctgtgtacttggatgctttcagaggcataaaattatattaccatgtgaaagcaagcctacaaaattcctcaggtggtccactctgccactcaaatgagagccagacttacagtgcacactctacaaacggacttccagctcgtcagggtattttaagtgcctgaatatgcaaggcactgtgccagtaaaattactcagtcctgaggatagagcctgttagaattattttaaaatctgtacttgaagtttatttcctcagtattccaagatattttatctggttgttctctgagtatttcacacgtagctagttacatataggtgagatggtgatgcttgtgcctggtgtggatgagaaactgagcctggcagacccgagattggatttcctcttctgactttgcaagtgtggctttgctttaataatagccctcctctttttctgtattcctcttttctccttccagtgtggcaaatatgcatcaatcaaaatacaataacctgtggaaccattttttctaaaataggaaggtggtgccatgggctattgattgttgagggtagtcttcagagcctgtcttataaatctataataattccccccaaattaatgtgctagttagaaccctagaattgcagcactgaaagtgaattttagaatcttttccaactttttaccaagctcagaaagcccttttattggacctttgtttgcctcatggtcatctggtttctttatgctggtagtaacaggaaccttactaacctacaaggtgacccagtccatcctgggcagctgtgatcattggaaagctctgaatcattcatctggaagctgcctgtggcagaatagtacagaacatatgcattgcacacactacaaaactgctttaaataagtgttccttttcattgttagatggaagtgacccagggcaaggatcatgttttatgagccagttttctcctagtgccttgaacataggcacttggtagtgtttagagaatgaattgtcttttttttttttgagacaaagtctcactccattgcccaggctggattgcagtggcacggtgtcagctcactgcagcctccacctcccaagttgaagtgatttttgtgcctcatcctcccgaggagctggaattacaggcatgcgccaccacacccagctaatttttatatttttagtagagatggggttttgcgtgttggccagatggtctccaactcctggcctcaggcgatctgcctgcctcagcctcccaaagtgctgggattacaggcgtgagccactgcgcctggccagagaatgaattcttaataagtttcttatgacttcagattgactggcagttgtgctaaatattttttgcctttatttgaattagaaaattcgtaagggggccttgagagtagatgcagtcacatttaggagatttttcccccccattggttaaaatgcagtttttctatggatctgctttagaactacaaataaactccgatcactcacagcagactacgcaatgagataagaagcagtccatttgttctgtcgtttattcatggccctcatctttgccagccaacctgtgcagaagagcacagcaaagcataagcttcctaacagctattcccattcagctgctgtcttcaagaagcagaagggtttagataaccttagagaacataatcaaacctgggaaactcaaatcaaaacaaaacttcgaaacggaagttgaaggtcctgaggtacccagaggcatagcaaggaaaacgtccccactgggatatcttctggattcacctacagacctctctggagttttaagatccacgttttatgacatattgcatagcaaacaggccgaacgctgttgtaaatcatcctctacgaaaggcccaggttttgaaactgaaggcctgaaaaggctcctgcttaccagctgtgtgctgtacctgacacactgaagcctgagagtgccagtcacctgtcagagggaacacagctgccctcaggcagaacctgagtctagaactcaaggtttttgactcttaggctaaaaataaaaaatcagaaggaggaactatggattgcttaatcagtcacattttcactttctaaggtttcttgtagcaaaagttatagtctttggggattgggatgtagacacttttttttccttccctaaaacaatttttggcctgccagtttttcgagcttcctgctctggaccctgaagttgccatgcagttgcagacatgctcctccttcaaggctctgttaagctgtggctgcccttccttaccactgctgtgccccaggccaaaccccctgcccctccttcccctaaggcactttgcacctgttgctccgagccttctggtctatcccagttggtagagtccctgtgcttacctctgtggctcagtcctcgtgggtggtcagtgctctagggaaggtgagctgaccacttcactttcccttcccagccatagctcttcacagcctcaccaacttagaaaggaatgctgcttttctctctgtcccccgtcctgactatgttcaagtcattgctcagcccagtgagtttgtcctttcttccagaccagtagttttcccccagtccctcaggcttcagcccttgaaggcatccttagccccccaccaccatgatagtcaggcgctgcgcctatccgcagggtgtgggtatgtgtgtgtcttttgtttctggagcccattcctttccttccaccagcctctaggccttcatccaatccttttgcaactcagtgattcatgacttttccctgcatccagtctagtctctttgctggtccattgtttccatagttgccagtttaatcttcttaaaatgctgcatttttgaagtcagtctcttttggtccctctcagaaacatttaaatagctatctgttgccacagggggaaagcttgaacctcttagccagtcattcagagcctgccctctgctggggcctgctttcctctacagatgcttctcccactctgcctgccacagcccttgtagctggctgattgccctgtacctcgcaggctctggaagtcttcagctccttcatggagcctttgccagccattcttttcaagactttgctgttgttcactgcctgatttgttcatttgacacttaattcactgagcaaacattatgaaagatgtactgtttgctactgtgaggaatggatccccaagagataagagggtcagtccctactgccaggaaacttgcctgtgtcacctgggttcagtatcttgtgtctattagatcagaagtggaaaggcagaggccagcccgtatgcttgttttattttatttaaatcaccagcaccccagcaagtgttttgcacaggaaatttctcattatttaattattttgggttttttgattaaattctgtacattcccattttagcttatcttgagttataacattaaaattaaggtagtcatcagctgaattataagacttaattagataagattatttaagatagtgatttctcattagattggccctgttcatattaacttttctgtttttttcttcagtctgcatgaagaaatcagtgatttttatgaatacatgtctccaagacctgaggaggagaagatgcggatggaggtggtgaacaggatcgagagtgtaattaaggagctctggcccagcgctgacgtgagtcccttcctgggtagcttatgcttcggacagtccttgtccacgggctagaagcctatctgctggtatctcatgctagtcctcacatgcaagtagaagtgctctgtagagttgtggtctaattaaattttaaaggcaaacaattttctgcagtctttagaattgaggcttcctaactattttcattggattggatgactaacaactattttttttttgtagtgctaatagcaactactaaaggcaagctatccttagaaattattagtgtaaagagaagaaagacaaatcaaacctcattgttgtagtggtctgttattggatatgatatatcaaaacctcattactacttagttccagcctgccagggtaaacattatataattgtttacagctaaatgaaaatgtcaagtaagaacttttgtcacttgaagttcatttcctttggctaatgcacgcataagtcttttcttatttctttcctgaaattgccatttttcatctctctcagaccagctaattgccttttagacagctcccagtcagtgaacaaaatgattactcaggatttcttcttggcttatttgtcgtttttgttactggtactaagtcttttgttttttgtttttgagatggggtctcactctgttgctgaggctggagtgcaatagtgcgatcacgacttactgcagcctcgatttcctgggctcaggtgatccacctcagcatcccgagtagctgggactgcaggtgcacgccaccacacttagctaatttttgtatttttttgtagagactgagtctcactatgttgcccaggttggtcttgaactcctgggttcaagcaatgtgcccgccttggcctcccaaagtgctaggattacaggtgtgagccaccacacttggcctgttactggtactaagttaatacgtcactttttagggcactttgagggcctgttctacaattttgtgtatgcaaagaagtacacaaaataatactaataaaatccattactttgtgtttgtagcttttcttcaggcactgtcctgggtggtggtgggaagctagggaaggtttttttccaattggcaaaacaaagaagtttcattgtatgtaaaacttgcaagtatatgacagtatgtatatgacactgtaggtaaagggaaaaggcaagggtactaatgttttatgagcaatgaccatacatcgcattctttctcctatgtgatccaaatcagtggttctcagctagtggctattttgttctccagggggcatttggcaatgtccgagacatatttgattgtcctgactgggtacgcactgctagtacctagtgggtagaggccatggatgccatcagccattctatgatgaacagtataggcccttacaacaaagaattatccacccccaaatgccaatgttgagaagccgtgatctaacttaacccttatctttcttaggtggaggttgattatctatctatctctttctctccagccagccaggcagccatcatctgtctacctacagatgaggaacatgagcttgtggttaggttcccaggtccatctcgcctcagaggttgaactggtttcactgtttatcatttttttcccccgagatggagtctcgctctgtcgcccaggctggagtgcagtgacatgatctcagctcactgcagcctttgcctcccaggttcaagaaattttcctgtctcagcctcccaagtagctggggttcaggcgcccgtcaccacacctggctgatttttgtaattttagtagaggtgggatttcatcatgttggccaggctggtcttgaactcctgacatcaggtgacccacctgccttggcctcccaaagtgctgggattacaggcgtgagccactgtgcccggcctatcctttttttattacaattacctgcatacatatttctgcctgagttccaccgttctccatgggttgagatggaatgcatcccagttttatgccacagcatgatgttacctgatgttctttgtggaattgacctaaaggccctcacttgccctacagttaaagtagtctgatcccaatttagtaatctattcgaagactcctgcttagagaacaaaaatgaaggatttgtgattgtgtctctggataatgagggaacattagtgatctgaactgcttctgaaagtttcctgtggttggctttctgtatccacaggtaccacacctccatattaaaccaacaatggattgaaaatattcagaaaaaactataaaaataacaatgtaccaataaaaacaatacaaattattttaaaaatacagtataacaactatttaggtagcatttacatcatacttggtattataggtattataagtaatctaaagatgatgtaaagtacatgggaggactagcataggttgcatgcaaatactctaccattttatagcagggactcaagcatcttcagattttggcatggtgggactggaaccaatctcctgccgataccaagggacaactgtattttggtctatgtgtttcatattgaaccagataagtttaaattatattcagaatgtctgcttgtgaaacagaatccccgcttcatgaagcttggggttagaaaaaaatgctcttgtcataccaaaaagtaccagtagagggtagcaaaaactgacatttctccatatcttggtgactcaatatgataacaacttctgataactcaatataataacaacttctttttctgtttcaggtccagatatttggaagttttaaaactggactttatttacctactaggttagtacactcatgaatctttcaaaggacttttcttagagtgtattcattttggctgtcaaatttgtaaggagtagaaacaaaacaaatttataaaacaaaatggggctgggcatggtggctcatgcctgtaatcctagcacttcgggaggccaaggagggtggatcatttgaggtcaggagttcaagaccagcctggccaacatggtaaaaccccatctctactagaaatacaagaattagccaggcgtagcagtgcgcacctgtaatcccagctactcaggaggctgaggcaggagaattgcttgaacccgggaggtgaaggttgcagtgagccgagatcgcgccactgcactccagcctgggcgacagagcaagactctgtctcaaaaaataagtaagtaaataaataaaggatttaccagcatttaatttgatttaccttgaagtagaatatcacttcacatcatcttaccaagacatagatggtacagagagatggaaaagggatcatgttgcaatggaatcaattagttactaattttagaaattgactgcctggcagagtattgctcagtcccataacttaacccactgacacagatgttaatgtagtatcatgataaaatgtctgattatatatcctcttgaatgtgagttcccgctgtcttgctcactcactcttacactcaccctcgctttcaaattaagaactcattctactagttatggctccagcatcctgatccagaaattcagggtacagatctcttctctgagaaagatcttggcctttcaggactgttgttcagtttcagtcttctcaaatgagacctcttgtgacgcacagccttggaggctctcttttgggaaatgataatgtttctccaaagggtgaatacttgctctctaagaattgaaattgtttgaacattccatcatggttattattattattaccttaaattttaatctctccagaataaagtcagcatcatgtttttccatttgagcttgatttggtatactttaccccaacttaaagtgtgctgaagtggatggaccctggcaatttccgttcttctcatagatgcccttggcctgcaaaagtcataaaatactcaacttcgagttaatatttcttatttaggttgtcagcatcagtaaaacatgaaaaatcacctttcttaaaaaatttaattaaattttatgaataggtagtacattcacatagttcacatttggaaaaggcacaaaaatcaatacagggaaaagtctcagtcccacctctgccccctggttctccttggaacagccgcttttaccagtttctcacatatcctttcagagatatctgtgcatataaaaggacatgtgtgtatattaacacaaatggtagcatgctggatacctgttctgcatccagcttaaagcacttcataatatttctgagttgcaattaatctcatccggataggaaaatcattatgtctagtaccacaagcgtttattaaagaaaatacatgaagtgctttttgtttttttttctttgaggttttacttctttcaaaatcaccctatttcctgaggcctgaattctgtgaaatgactgagaggaggagtttgttaaaatcaacaactactatttcccttctccacaaaaccattatcaccaacacatttagtcttcgttggccagggtgggaaataggttttaattgtactaatgaagtctataagcatgagtgtcagttaaaacaagtttccaacttcttccgaccctcttgtatatgtattctgtgttcagtgacatcgacctagtggtgtttgggaagtgggagaacctacccctctggactctggaagaagctcttcggaaacacaaagtcgcagatgaggattcggtgaaagttttagacaaagcaactgtaagttctgcagcatttcatattaaaatccttagttatttacctatgaaacttgaattaaaattaaagtttggtgagcacagttgcattgcaagtgagtgattctttcattttgttaatgtcaccgtgcttgcacataaaaagttttctggttgtccacactggagtgtgaccatacaatctcggctcactacaacctgtgcctcctcggctcaagtgatccttctacctcagcctcttggggagctgtactacaaacacaacctgccatgcctggctaattttgttgtattttttgtagagacggggtttcaccgtgttacccagactgatctccaactcctgggctcaagtgatccacccacctctgcctcccaaaatgctgggattacaggcgtgagccactgcacctggtctgcatttcttttcacagcagcaaaatatgcaattttattatacacagtactcactgtagagatttttgtttgttttattcattttttttagagagatacagtctcactatgttgcccaggctggtctctaactcctggactcaagtgatcctcccacctcagccttatgtgtatctgggactaaggcgcaccctaccacgccctgcttatttaaaaaatttttttttgtagagatagggtctccctgtgttgcccaagttaggccattttttgaaaagaactgctgatagctcatgtaaataatcctgtcagctttttagaataatttttatattttatcttgtcaggttgttttttgggctatttgcaaaactgaccagtaatgcaagtgggttgtagtgtacaccttaagaatccagcaattttcttattagaaacagtttgatgatacaaaacatttaatacctggcattcctagttcttcatcttatactcagaaagtgttctccaaattattgaggaaggtttttgttcattttaaaattatcattataactatatgtcaactaataaatgagatgatgggcatattaatttatttaactgtagtaatcacttcagtatgtatatcaagataagtatatcaaaacatgtacaccttaaatataaacaataaaaataaataataaaaaattggacaccaaacaaaattctcggttgatagaaattatactgtaatatactgtatgggacccagtgctaaatatgcagcatatagtatttgtagcagaccaggtttactggggtgtgccatatttagaatactcagtgttcttatgctctcatgagatgatggagacctcatgtctagtaggcttccatcccctgattttatcatttaatctggttaaagcatttacattttacctttcttctctttataggtacctattattaaattaacagattcttttactgaagtgaaagttgatatcagctttaatgtacagaatggcgtgagagcagctgacctcatcaaagattttaccaaggtcagagaatttagcgtttatacaacaaaactattagaaacgtaattttaagattctgttgtggtggtgttctaatatttttatatgcatgttgctgtctctctctctctcttttaaatagagctagggtctcactctgtcacctaggctggagtgcagtggctggatcatggcccgctgcagcctcaaactcctgggttcaagtggtcatctcacctcagcctcccaagtagctgggactacagacgtgagccactacacctggctattttttgtattttttttttttttttagtgttggggtctcgctgtgttggccaggctggtctcttaactcctggccttagcctcccaaagcactgggattacaggcatgagccaccatgctcagcctgcaccttacttttgtatgcaacggttttgctttctttgaatctgcttgtaatgatcagtgattaacttataatgtgacctcaagtaagaattaaaagttgagaaagcttttgaagaaattgtctgctctagatccttccttgtagagacagaagagatggaattctactacacagttgattccatctgtttttaaccttcaggagttcagattaagaacctttcctttaacccatttcccatatgccccaagaatactgtgcgggcagtgagctgcactttttttttttcttttttcgaggcagagtctctctctgtcacccgggctggagtgcagtggcacgatcttggttcactgccacctccgcctcccgggttcaagcaattcttctgcctcagtctcatgagtacctgggactcgtgcctgggacgagtaccaggcacctgccaccatgcctggctaatttttgtatttttattagagatggggtttcaccatattggccaggctggtctcgaactcctgaccttgtgatccgcctacctcggcctcccaaagtgcccggattacaggcgtgagccaccgtgcccagctgtacttttttttttcctaaacaggaaataggttaagagttttaagagccttttctagatttcaatccctaaattacctttaaggtgtttcctacaggcttccttacttctgttttgaaattatttaagtttatttctattctgttttcttccaagatagagaataatttgtcaccatcatctgtggaacattttacatacttaggtagttgtcagctttctcacctctaacctaagccattaactcctttggcttctgttagaatattcacaattttttttttctgtagcagctctaaagtttctatttcttcttttttgttttttaagaaaaaaatgttaactacttgatgttacaagcattatcatcttgcataaatgtatggaagacagaaaagcagaaaaataaaagaaagattatccataatcgcactatattgggggtgtgtgtgtgtgtgtctgtctaatattttctttttctggaaaaaacttttaaaaattgaaattcatatgcatgataacattcatcagtataaagagacagtgtaaagtgagtcacccttacaccatagatacttagatcatttttacagaatttctcattgccaattattgttttttgcgttgcttttttatgttctttaaaattataagcaaaaggagtagcacattatacacacattgtcttataacttcataaaaacttaatgttttggaggtttcttccatattagcacatacaggcttgctttattctttttgttggttacacaggcagtagtcttttataaggctgtgactgcttgatttagcagttcttcagtattgttccagttttcttttgctattagaaaaagggattgatgaatatacttccatacatgcatcttgctttacacatgcaaaatgtttgtagaaagattcccaaaagcaaaattttgaggtcgaagggtatatccagataaaattctgttggatatttccctaattatttattctttcatattctcattttctctctctccctcccccttttcttctccctccccctcttcctctatccctccctttcccttttctctctttttctttccctcccttttcttttctcttttctcttcttcctttttcttccttcccctttcccttttccttccttctgcttcctttttttcctttctttcattttttgacaccgagtctcactctgttacccaggctagagcgcagtgatcatggctcactgcagcctcggcttcttgggctcaagtgatcctcccaccttggcctgagtatctgggatcacaggcttgcccaccacacctggctaactttttttttaatttttttttttttgagatggagtctcactctgttgcccaggctggagtgcagtggcgcgatcttggctcactgcaacctccgtctcccaggttcaagcgattctcctgccttagcctcctgagtagctgggattagaggcgcacaccaccacgctcagctaatttttgtatttgtagtagagatgtggttgcaccatgttggccagggtggtctcaaaccctgacctcaggtgatccgccctcctcagcctcccgcagtgctgggattacaggcgtgagccactgagcccggccacttttttattttattttttaagtagagatgaggtcttgctatgtggccacttttttttttctttttttttaagtagagataaggtcttgctatgttgcccaagctgttcttaaactcctgggctcaagcagtcctccttccttgacctcccaaagtgttgggattacaggcatgaaccaccacacctgacccctaattgttctttgaaagggaactgtatctagactgacttaaccaccatgttttgttttgttttttgagacagagtcttgctctgtcactcaggctggagtgcaatggtgcgatcatggctcattgtaccctccgcctcctgagttcaaacgattcttgtgcctcagcctccagaatagctgggactacatatgtgtgccaccacgctgggctaatttttgtatttttagtagagatggggtttctccatgttggccaggctggtcttgaactcctgacctcaagagatccacccgcctcagcctcccagagtgctgggattacagatatgagccaccgtgcccagcccacaatgtttaaaaatacttatttctccatatttttgttctttcctatgcttgcttagtttgatacaatttgcaaaagtataagcttttttttcttttttatagaagccatgcgtgttcattgtaggacatctagaaaacagagataagagtaaagaaaaaaaaatggaaatcaccggccaggtgctatgtttcacacctgtaatcccaacactttgggaggcccagacaggcagatcatttgagcttaggagttcaagaccagcccgggcaatgtggtgaaaccctgtctctacaaaaatacaaaaattagctgggcatggtgggctgaggtcggaggatcacttgagcccaggagctggagattgcaatgagccaagattgtgctactgtactccagcctgggtgacagaatgagggggaaaaaaatggaaatcactagtaattttaccaccctaagtaataatagctgttaagacttctttgaagatgttgtgcctgctttgtttccctccgtggccccagcctatggcatggtttacagaggagtgaatgaatatgtgcacagcaaaaggtggactcattctgtacatacttgcccactcaggtgttctctcgggtagccctgcctcattccctgtgaagcgtggaagggaggggtggtctgtgtgtagtcatcagcccatgtgcaagtcagcaggcaggactcttgtttgccccagggctgtggcagaataatctaaaggtcgctagtctacagtggtacatcaccaagaaaagtgattcttaaaaatctcactgatttagtgctttaagatgttggttactttgtccttgtactctttctattctctgtttacaaatgaatattagagggtcatggtcacaaatgagcatcatcagttacatgctgttagtgtttctatcctatagcaagtacttttttttttttttgagatggagtcttgctctgtcacccaggctggggtgcaatggcacgatctcgcctcactacatcctctgcctcccgggttcaagtgattctcctgcctcagcctcccaagtagctgggattacaggctcccaccaccactcctggctattttttgtatttttagtagagataggcgtttcaccatgttggccaggctggtctcgaactcctgacctcaggtgatctgcccgccttggtctcccaaagtgctaggattacaggcatgagccaccatgcccagccctgtagcaagtacttagatactattattcatttgtacatgtcttacaatttaagtataaggggagaaccattcattacctatagtttacttttttttaatagcttactcttaaaatagaaaattaagtatgttgtatatctctaccaaattttataatgtaaggaccaatttatgcccctcttaatgcttagatctgttgctgatacaggaattcattgaaaatacaattttctttttcagaaatatcctgtattgccatacttggttttagtattgaaacaattcctattgcagagggaccttaatgaagtatttacaggtggaattggttcttatagtctctttttaatggcagtcagtttccttcaggtaagtcatatgggtatagcatgctagtgcacactaaaagcaaaagtgatcaatcagctgggaaacattttggaaaaaatcgaaatcaacctgtaattgcattgctttccttgattacttaacggcttttccctttaaactgggtacattttatcatttagcaaatatgtatttttaaattcctatgaaagaatatttttggttttaaatcccatacattctagtatttttgagacttttcactgcaaattttaacatgcaaaatgtacggcctggtttccataagcataaatagtataaatgccaacaataagaatgtcttctaagcagctaaatcttgtaagtttagttggaattgagaccagctatttgggtaagcgaattagagtcttagtattgtaagtgggtatgtttatgtggcacagggttgccaactgcctgagtctattcgtgagtcagaacgactttgctgatgtgttgggccaagccagccctggttggcagcctggtgcagccgtaaaattcagccttacaaacagtctcccgccattcccgcaccatgggactttagtgttgtgtgtaacaacagtataacctgctgttagcccattatcaactgactgctatgctaaaccaaaattataataatattgcttgtagaagttagaatataatttattccccctctccttgataatttagcaaaaatccaatataatttcttcttttctgcttttagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtattgaaattaggtaaatttgtgggcattcaaagagagggcactgtcagtcaccttattatactttaaattctctttagatgaaaaatgaaggaacaacttctaattgttattcttttttcatcgaaatatttcatgagcaaacatactaaaataaacagacacagacaatagaaaaacaccttggagacttccagataagtagggagtagaatctgtttaaccctaaaagcatagtagaaaaggcattcacttatttggatgggttcatgtttggtggctgtttctccttcttgggtccttattgccttgattacaaccaattgtcagcaattaatgaggctttaatgagatgattctgaagtcctgagaggcagcaagcatagtaatatatctttgaattcatgagcagaagggtgcaaggagacaatgtattttctttttgaatttctcctttcctgtttgattttgcatgtctctttgtgctttttccagcttcatgtgggcttgaaagtaagcagaaagtaaattccttccatgcttttctgaagttctgtttgcttgcttgtgtcctgatttttgtgagcaatattttttcttgatataattgtaaaatagattctgcgttattggacttcagtggaagtgcttttagtcatttgctttaatgtgtaaactttgaaaatgagtaaggaaagggggtgaagagatagagtagttgcctaggaaccattttctggcttattgagctgccttataaacattaatagttctatgtgtttattcattgaggaaacattacattgattgggagcctgctctgttcaaaagtattgggccaaaggacacgaagacttttcagcaagacgatccttgctttttaggggctcataatttagagtgagaaatagatatatagctaatataaacccaaaaaatatagaagtatttctgatgtaacttggggtttcactcttaggagtgaacagggcactatttcttttgtttgcataactgtttatgtatggaatgggataattcttgatgggccagaatacattccggcaactgatacaccataatgaagtaccaactgcatgattcacatattcagagactggggagctttggggacagctcacagctcagcttccaggcacaactctggtgggataactatggcccttgctctcctggaagagagtcatcaacatttagtgcatattaagcacagtcaggcttactatgttacgtatatttcttttaaaggtaacgatgttggaaggagttcatatggggccatgcaagtgaagcaggcctttgattatgcctacgttgttttgagtcatgctgtatcaccaatagcaaagtactatcccaacaatgaaacagaaaggtaaaagttcatctataaccagcccattgtgtcaaaattagttgtggcttcttatcttcaaattaatgttattccctccctctccctttctttttaaacacatgcagcatactaggtagaataattagagtaacagatgaagttgccacatatagagattggatatcaaagcagtggggcttgaagaatagacctgagccttcatgcaatggtaagatattttccttggtcgattgactgagtattagaggcttttctgtgttgtgtgcgtttaatgggaagaaacgttttccaatcttttgccactctttcaggaaatggtgttaccttgatagtagatactcagcagttagataaatgtaataataatctatctgaagaaaatgaagcccttggaaaatgtagaagtaaaacctcggaatctcttagtaaacactcttcaaactcttcatcaggtccagtgtcgtcctcttctgccacacagtccagctctagtgatgtagtaagtatgaaagcctcggctcttctgaactcagatgcatgcacgttctcttgctggggttaacactgtctcgaaggctaaggctacttcctttgcttacatgttactgggatattttaataactttcatgcttgtacattttctcaacattttgttatgaaaaagttcaagcatatagtaaaagtgaacaaattttagtgagcattcatgtactcaccagtagattctgctattaaccttttacttgcttatgtcatacctgtctatccatcactctatccattaattcatcttattctttgatccatttcaaagtagattacagacatcagttcccctagagtactgtagcttgtgcatccttgtagccagactccagtatttgtttattgttttttccttttttttttttttgagacgggatctccctctgtcacccaggctggagtgcagtggtatgatctcggctcactgcaacctccgcctcccatgttcaaacgattctcctgcctcaacctcctgagtagctgggattacaggtgcgtaccaccatacccagctaattttttgtatttttagtagagacggggtttcaccatgttggtcaggctggtcctgaactcctgatcttgtgatccacccgcctcaacctcctaaattgctgggattacaggcatgagccaccacacctggcctttaacgtttttcttttcttttcttttcttttttttgagacggagtcttgctctgtcacccaggctggaatgtaatggcatgatcttcactcacctcaaccttcgcctcctgggttcaagcgattctcctgcctcagcctcctgagtatctaggattacaggcatgtgccaccacacccagctaattttttgtatttttagtagagatggggtttcaccatgttggccaggctggtctcgaattcctgacctcaagagatccacccgcctcagcctcccaaagtgctgggattacaggcgtgagcccagctgttatgactttttaacaccatagttagttttgcctgtttcagaatttcatacaaatggaaccacatagaatatagtcttgtgtaaggcttctttcactcaattttttttcagctttctggttgaattttttgttgttgttgttttgttttgttttttgagacggagtctcgctctgtcgcccaggctggagtgcagtggcgcgatcttggctcactgcaagctccgcctcccgggttcatgccattctgcctcagcctcccaagtagctgggactacaggtgcccgccaccacacccggctaattttttgtatttttagtagagccagggtttcaccgtggtcttgatcgcctgacctcatgatccgactgcctcggcctcccaaagtgctgggattacaggcgtgagccaccacgcctggccaaatttttttttagttgagatatagttaacataaaattcagcattaaaaatgtacaattcagtggtttttagaacatattcacaatgttgtgcagccatctccagtaattctagaacatttccatcaccccaagaagaaaccctgcatttagcagtagtttcttctaattcttccttccctcccttaacctctggtaacctctaatctactttctctttctatcctgatagaattttttttgttcccccatcctgatagaatttatgtgtcaattataatgtaagttaccttttaaaatcaaagtgaatttgtagtgtactgatttgagatctaaagcaggcttacctgtttgagtttaactttattaagtgtaggacatgaaaagtaatctaaatattgtatgttgttgatgatgaccatgtgtcaatatggaatcataaatcctcctgtgcagaatctccctgtgtgcttttttggttcctagagcagtatgctttggaggacagaagccaagctagatgtcacagacacagggagatggagtgttggggactgagagaatgtgactctgacatgctgggtagagtgccagggccagggtggagacctgcagagagacgtagcattgtcatggcccatgcagcccagaaataggtggagctcagcccactgtcgcgggaagtccacccccacccacaccagtatgtttggttagaatgatcactgatttgtcatcacagactctcagagattgaaccccttaaacccatcatcttgtgtctggctgaagccagggactaggacctaggttcctcactctttaccatactctttcattttctataaataaaaaaacaaataaacttagacctctgtgagctccttcaaggtcagatgtgggcagtggatttaacaatgaacagaagctctctgataaaatcagtcattttaaatgtttggaggaaaatttaaacaaacagttaattttttgtgtgcttcttttaactcccaaatgtttaaatttagtccagagagtactttaaccaaaattgtttttctttctgaatattgagtatctaaattactaatatgtcacattataactcacgtgacttgtgttaggattccgatgcaacaccatgcaaaaccccgaaacagctgctttgccgtccgtccactgggaaccgagtagggtcgcaagatgtatccttggagtcctctcaggcagttgggaaaatgcaaagcacccaaaccactaacacatccaacagcaccaacaaatctcaggtgtgtggaacgtgggtttttaattgttagtatttgatacaaaatatttagaatttcccacatgtaaataatatgcagcatgggtttgaagaaaacgctagattgaagaacaaacttattttattctaagaggttccaacacatgacagtgcttctaggaacaggatgtcctaaggatccttgtgagacaccattgtaacataaatctcttcaggaatctattgactggtccttataagatgttccagccaaactaccatataaaaagtgtctcagttgtacatgaaataagctggcatgaaggttttgtgaggcctcatggcagtgtgcatatctgggaataatgtatccttttctaatattttaatgttcaataccttgttgctggtgttgaaatgatcagctggctgtcaggcgtggtcagttgattaacattagcttggacttaaaaggccacagagatactctagtttaagtttttttgttgcctagaattgtcattaactgagtaatgactcagagtgaggggaggaagccattgatatggggctctggcctaaggctgggtcactcctcactatagctgggaacctgggaataggcctcttggctgtaaccttgtgtctgatttgactcactgagttcactttacctacgcggccttagccatgtatgccagacacagacttatcacaaaataccagttcaagtgacagggttgacagaagggactgaggtcacgagaaagccacaggccatgagtagcaggaagggagtagccacctgtgctgacccaaacctaccagtgtgcctgtcatgcccaagagcctcttcccgctctgtcacttatgatgtggtgtttgggttggtaagtttcttaagaaaacctttgcatcccacacactgttaagaaggcgggcgagtggtctatgcttttcattatttccattaaaataaagtaagggttttagagctaaaaagaacccctgtaacagctttttctgcccactagataagtcagtgatcagtaaggtaacaatctagccagcatattcctagttttgaaagcttccccaaatccaggtgtttgagaacactctgcttttctgcaatactgatgtctttgtggtcgttttctgtttctgcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaacaaaacaaaaaaaaaagcaagcaaaaaagagggaaaaaaaaggctgcttatttgataagtcatatgctacaacagggtcattttaagatttaaagcttgaatgtaaaataaatatatttctcattggctttatgcagagttatagggaatagtattcagtgttggtagggtgatagaaacaaaaaacagtatcagaggatgaggtggggaaggaaaacaaaggtatctgataggaagtccagattccaaaggggaaagtgatctgtgcatgttttttttttaaatatttttgcatatatttaccattttattgtgtgtatatatagaagaccatataggagattgatatttgtaatagtggatttgttaataatactttttacataacattactgtttaaattgtaaacagattttttctcaggattagtttgaaaaataatctaaattgtcatcttaacatccatatatagggaagtgattagttctattactcaatttgtttttctcagcattgaaatgacttaatagaacccttgtgtcctgctgcaaaaatttttcctctctaaagaaaaggtttatggtggcaaatgatgtttattttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctcatttgttttatacatttcatctatttgactcctatcttatttcttttttgagttttaatacttcctatattttgtgaatatatcagaaatgtgtcatttatatattagagtccattcatatccatgaatcataaccttcctttgctaatacttgttgaatgggattttacaaattctccctcactctggtgacatttctcaggcagtcatgtatgtgtacctggccattagaaatattaatatttaaagactgttttttagaggagctgatgggttggtgaggtgtcagcacaaaatcttactggttatgttttgatgataaaagtatatccattttttccctccagctttaaggtgactgtgaaggtgcctggttttgaatgtctttgtttggtttggagatgtcgcactcagttttcaaatctagcttggatctgtaggacctatgttttttacaagtaattgccctccagtcttcaacagttgattctgttttatttttatcctgttttgagtgtactttacctttacttgcattttgagcctcattaatatttaggttatttgatttggctccagatattcctagatctgcacagggcaaaacatgggctatagggtgagcatttttaattgtctttttctgctggaaccttatatctctccatgtgttttctgctccttccctcccccatgaaatggtaagtgtgacttgtgtttgcctgaacctgtggactagtgtttggggtttctggaaacactagagggtcagaaaagagtaatgaccaccgtgacgtgcaggattctcttgctgtgacatgttcattgcaaagccctctccagtgactaggaggtgtagttattaaggttgatctgttagaaatcaccattattaggtattagtggtagatgttgctgatacttttattggtcatgactacatctcagttttactttaatattgatctatagtttgatcagttccttgaattctaatatgttgatttctcagtgtttctgtcactaaccaagaatgtttctaggcagttggttgcttcacagtcaaaactaaatggtaaactatcaaaaatacattcccaattttgctgtgataaatattgaaatgttaaaattaatgaacagaagaatttattcttacccatctattcttgttctcctagttcattaaactttcagttattggaaaggcacattctcaaagtattttatgagcaaaatattctataaatgcgtctaacaaacctaattgaatataaaagttatatttagtagttactgttgatagtaattttcatcagggtcatagttcatctagtaaaatatttagagaatgatgttaacattccagcattaaagtgggaacaaagatttatatatgaaattccttaaaagagttcatcttgccttggtttctgaccctcaagactctagctacctgccatcttgtcaaaacatttgtgggtagaataagtgttaaagatcaaattttaatatgcttctcgatatttaacatagctaagaagccagattttactgtagaagttatttacatgatttgaaaacttgacctaactggaagcctttttctcagtcatcttgttctaagccatcttgacttcacacccttagcgacttttcttttttttttggtcaaagataatgagctaaatatatatagacgttgaatgttgacaaaattattaaccagaaaaattgcttataaaggctgctgatctatttgatacctagaattaaatatttgaggacagtttttagttaataaactgctaatgtttattttactgtctctcaggtttttggtttttttaaaaaaaatgtgtttggcctttacattttctacttaagtgtgtactttattgagtttaaccttgtctgtagcctagtagcctgaaagaaaaggagacagaaccagagagatggatgtagtgcattccctttggttattacacatttgtggtagctcctggatttactgagagatattttagctatgtcaataagaacagctaatgatgtggaaatcaggtgttctcttgtgtatttcagtgaacatttttattagtagttgcatatcatctctagttccacattttaacttaacgtctttgtggcttcaccactgagctacctttcactacaccagcttctgtgtggcctggtaacatggaaggtctctcctaaggacagtctggacgtattttgggggaatgttatttatcttaaagatgcctagaaacaaaacgcatatagtaccagtgagaaactatgaagtaaacaagttgctcaggccgggcatggtggctcacgcctgtaatcccagcactttgggaggccgaagcgggaggatggcttgaggctgggagtttgagaccttcatctcttaaaaaaacaaacaaaaacctgaatggtgaggtgtggtggaattgggtaggggagggaaaggaggacttggaaaagcattctccaaagccagcaacttggtgaagttcagtacttgcctcttagaggttaggccatgcctttcaaagagagtgaaatgatgggttatcagccacattcttggagttaatatttttcttcatctttcagtttgggttctgtgctattcatagttcttccctaagaccatttcattattaccttttatatttagttgcaatttattataatatgttgttttgtccctgaacttaatctcctaattttaagatcctctctgatttttgcatattgaaacttacagaagtcactttaaaaaagtcttttgaaagtcctacaatcctaaaataaatcacaagcttgtttgttagacgtgtcaagagtctccagtctttactactaaaaagcagcactgccttaacacacattgttatgggtgaaaagtgagggacgaccagtgtagtttctggatataaagtgtgaaggactgttgagttaaacatttttagtggaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttcaa

SEQ ID NO: 1436 - DNA, 82391 bp, Homo sapiens; identical to SEQ ID NO: 1435
